United States Patent
Gil et al.

(10) Patent No.: US 10,006,042 B2
(45) Date of Patent: Jun. 26, 2018

(54) ISOLATED POLYNUCLEOTIDES AND POLYPEPTIDES, AND METHODS OF USING SAME FOR INCREASING PLANT YIELD AND/OR AGRICULTURAL CHARACTERISTICS

(71) Applicant: Evogene Ltd., Rehovot (IL)

(72) Inventors: Lidor Gil, Rehovot (IL); Ronit Rimon Knopf, Modiin (IL); Noa Matarasso, Tel-Aviv (IL); David Panik, Rehovot (IL); Limor Poraty-Gavra, Holon (IL); Ehud Katz, Tel-Aviv (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 168 days.

(21) Appl. No.: 14/904,758

(22) PCT Filed: Aug. 26, 2014

(86) PCT No.: PCT/IL2014/050769
§ 371 (c)(1),
(2) Date: Jan. 13, 2016

(87) PCT Pub. No.: WO2015/029031
PCT Pub. Date: Mar. 5, 2015

(65) Prior Publication Data
US 2016/0272987 A1    Sep. 22, 2016

Related U.S. Application Data

(60) Provisional application No. 61/932,373, filed on Jan. 28, 2014, provisional application No. 61/870,380, filed on Aug. 27, 2013.

(51) Int. Cl.
*A01H 5/00* (2018.01)
*C12N 15/82* (2006.01)
*C07K 14/415* (2006.01)

(52) U.S. Cl.
CPC ........ *C12N 15/8261* (2013.01); *C07K 14/415* (2013.01); *C12N 15/8241* (2013.01); *C12N 15/8243* (2013.01); *C12N 15/8247* (2013.01); *C12N 15/8271* (2013.01); *C12N 15/8273* (2013.01); *Y02A 40/146* (2018.01)

(58) Field of Classification Search
None
See application file for complete search history.

(56) References Cited

U.S. PATENT DOCUMENTS

| 6,084,153 A | 7/2000 | Good et al. |
|---|---|---|
| 2002/0046419 A1 | 4/2002 | Choo et al. |
| 2005/0108791 A1 | 5/2005 | Edgerton |
| 2006/0179511 A1 | 8/2006 | Chomet et al. |

FOREIGN PATENT DOCUMENTS

| WO | WO 2004/081173 | 9/2004 | |
|---|---|---|---|
| WO | WO 2004/104162 | 12/2004 | |
| WO | WO 2004/111183 | 12/2004 | |
| WO | WO 2005/121364 | 12/2005 | |
| WO | WO 2007/020638 | 2/2007 | |
| WO | WO 2007/049275 | 5/2007 | |
| WO | WO 2008/075364 | 6/2008 | |
| WO | WO 2008/122980 | 10/2008 | |
| WO | WO 2009/013750 | 1/2009 | |
| WO | WO 2009/083958 | 7/2009 | |
| WO | WO 2009/099580 | 8/2009 | |
| WO | WO 2009099580 A2 * | 8/2009 | ........... C07K 14/415 |
| WO | WO 2009/141824 | 11/2009 | |
| WO | WO 2010/020941 | 2/2010 | |
| WO | WO 2010/049897 | 5/2010 | |
| WO | WO 2010/076756 | 7/2010 | |
| WO | WO 2010/100595 | 9/2010 | |
| WO | WO 2010/143138 | 12/2010 | |
| WO | WO 2011/015985 | 2/2011 | |
| WO | WO 2011/080674 | 7/2011 | |
| WO | WO 2011/135527 | 11/2011 | |
| WO | WO 2012/028993 | 3/2012 | |
| WO | WO 2012/085862 | 6/2012 | |
| WO | WO 2012/150598 | 11/2012 | |
| WO | WO 2013/027223 | 2/2013 | |
| WO | WO 2013/078153 | 5/2013 | |
| WO | WO 2013/080203 | 6/2013 | |
| WO | WO 2013/098819 | 7/2013 | |
| WO | WO 2013/128448 | 9/2013 | |
| WO | WO 2013/179211 | 12/2013 | |
| WO | WO 2014/033714 | 3/2014 | |

(Continued)

OTHER PUBLICATIONS

Doi et al. (Journal of Experimental Botany, 55: 517-523; 2004) (Year: 2004).*
Jarillo et al. (Genbank Sequence Accession No. AF053941.2; Published Aug. 5, 1999) (Year: 1999).*
Takemiya et al. (Plant Cell. Apr. 2005; 17(4): 1120-1127) (Year: 2005).*
Keskin et al. (Protein Science, 13:1043-1055, 2004). (Year: 2005).*
Thornton et al. (Nature structural Biology, structural genomics supplement, Nov. 2000). (Year: 2000).*

(Continued)

*Primary Examiner* — Vinod Kumar

(57) ABSTRACT

Provided are isolated polypeptides which are at least 80% homologous to SEQ ID NOs: 710-1153 and 9276-15726, isolated polynucleotides which are at least 80% identical to SEQ ID NOs: 1-709 and 1157-9275, nucleic acid constructs comprising same, transgenic cells expressing same, transgenic plants expressing same and method of using same for increasing yield, abiotic stress tolerance, growth rate, biomass, vigor, oil content, photosynthetic capacity, seed yield, fiber yield, fiber quality, fiber length, and/or nitrogen use efficiency of a plant.

8 Claims, 11 Drawing Sheets

(56) References Cited

FOREIGN PATENT DOCUMENTS

| WO | WO 2014/102773 | 7/2014 |
|----|----------------|--------|
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Guo et al. (PNAS, 101: 9205-9210, 2004). (Year: 2004).*

Wells, (Biochemistry 29:8509-8517, 1990). (Year: 1990).*

Ngo et al., (The Protein Folding Problem and Tertiary Structure Prediction, K. Merz., and S. Le Grand (eds.) pp. 492-495,1994). (Year: 2009).*

Courtesy Letter dated Jan. 28, 2016 From the Canadian Intellectual Property Office Re. Application No. 2,910,060.

International Preliminary Report on Patentability dated Mar. 10, 2016 From the International Bureau of WIPO Re. Application No. PCT/IL2014/050769.

International Search Report and the Written Opinion dated Nov. 17, 2014 From the International Searching Authority Re. Application No. PCT/IL2014/050769.

Invitation to Pay Additional Fees dated Sep. 18, 2014 From the International Searching Authority Re. Application No. PCT/IL2014/050769.

Schmutz et al. "Hypothetical Protein PHAVU_011G015900g [Phaseolus Vulgaris]", Database NCBI [Online], GenBank: ESW03460.1, Database Accession No. ESW03460, Nov. 29, 2013.

Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.

Examination Report dated Sep. 15, 2017 From Instituto Mexicano de la Propiedad Industrial, IMPI, Direccion Divisional de Patentes Re. Application No. MX/a2016/000395 and Its Translation Into English. (7 Pages).

* cited by examiner pQFN, pQFNc

Normal conditions

Osmotic stress (15% PEG)

Nitrogen limiting conditions pQNa_RP pQXNc

ISOLATED POLYNUCLEOTIDES AND POLYPEPTIDES, AND METHODS OF USING SAME FOR INCREASING PLANT YIELD AND/OR AGRICULTURAL CHARACTERISTICS

RELATED APPLICATIONS

This application is a National Phase of PCT Patent Application No. PCT/IL2014/050769 having International filing date of Aug. 26, 2014, which claims the benefit of priority under 35 USC § 119(e) of U.S. Provisional Patent Application Nos. 61/932,373 filed on Jan. 28, 2014 and 61/870,380 filed on Aug. 27, 2013. The contents of the above applications are all incorporated by reference as if fully set forth herein in their entirety.

SEQUENCE LISTING STATEMENT

The ASCII file, entitled 64425 SequenceListing.txt, created on Nov. 5, 2015 comprising 41,570,453 bytes, submitted concurrently with the filing of this application is incorporated herein by reference.

FIELD AND BACKGROUND OF THE INVENTION

The present invention, in some embodiments thereof, relates to isolated polypeptides and polynucleotides, nucleic acid constructs comprising same, transgenic cells comprising same, transgenic plants exogenously expressing same and more particularly, but not exclusively, to methods of using same for increasing yield (e.g., seed yield, oil yield), biomass, growth rate, vigor, oil content, fiber yield, fiber quality, fiber length, fiber length, photosynthetic capacity, fertilizer use efficiency (e.g., nitrogen use efficiency) and/or abiotic stress tolerance of a plant.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons, which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; arabidopsis (dot) org/), TAIR No. AT2G43710)], OleosinA (TAIR No. AT3G01570) or FAD3 (TAIR No. AT2G29980), and various transcription factors and activators such as Lec1 [TAIR No. AT1G21970, Lotan et al. 1998. Cell. 26; 93(7):1195-205], Lec2 [TAIR No. AT1G28300, Santos Mendoza et al. 2005, FEBS Lett. 579 (21):4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmDof4 and GmDof11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using *Arabidopsis* FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. Publication No. 20020046419 (U.S. Pat. No. 7,262,055 to Choo, et al.); U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dof1 transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield). WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. No. 5,981,834, U.S. Pat. No. 5,597,718, U.S. Pat. No. 5,620,882, U.S. Pat. No. 5,521,708 and U.S. Pat. No. 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency.

WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2012/150598 publication discloses isolated polynucleotides and polypeptides and methods of using same for increasing plant yield, biomass, growth rate, vigor, oil content, abiotic stress tolerance of plants and nitrogen use efficiency.

WO2013/027223 publication discloses isolated polynucleotides and polypeptides, and methods of using same for increasing plant yield and/or agricultural characteristics.

WO2013/080203 publication discloses isolated polynucleotides and polypeptides, and methods of using same for increasing nitrogen use efficiency, yield, growth rate, vigor, biomass, oil content, and/or abiotic stress tolerance.

WO2013/098819 publication discloses isolated polynucleotides and polypeptides, and methods of using same for increasing yield of plants.

WO2013/128448 publication discloses isolated polynucleotides and polypeptides and methods of using same for increasing plant yield, biomass, growth rate, vigor, oil content, abiotic stress tolerance of plants and nitrogen use efficiency.

WO 2013/179211 publication discloses isolated polynucleotides and polypeptides, and methods of using same for increasing plant yield and/or agricultural characteristics.

SUMMARY OF THE INVENTION

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide at least 80% identical to SEQ ID NO: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, 15455-15721 or 15722, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence encoding a polypeptide selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide comprising a nucleic acid sequence encoding a polypeptide at least 80% homologous to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722, wherein the crop plant is derived from plants which have been transformed with the exogenous polynucleotide and which have been selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising a nucleic acid sequence at least 80% identical to SEQ ID NO: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, 8948-9270 or 9271, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of increasing yield, growth rate, biomass, vigor, oil content, seed yield, fiber yield, fiber quality, fiber length, photosynthetic capacity, nitrogen use efficiency, and/or abiotic stress tolerance of a plant, comprising expressing within the plant an exogenous polynucleotide comprising the nucleic acid sequence selected from the group consisting of SEQ ID NOs: 4-86, 88, 100-312, 320-389, 391, 395-475, 477, 489-696, 704-709, 1157-4245, 4247-8375, 8387-8683, and 8686-9275, thereby increasing the yield, growth rate, biomass, vigor, oil content, seed yield, fiber yield, fiber quality, fiber length, photosynthetic capacity, nitrogen use efficiency, and/or abiotic stress tolerance of the plant.

According to an aspect of some embodiments of the present invention there is provided a method of producing a crop comprising growing a crop plant transformed with an exogenous polynucleotide which comprises a nucleic acid sequence which is at least 80% identical to the nucleic acid sequence selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271, wherein the crop plant is derived from plants which have been transformed with the exogenous polynucleotide and which have been selected for increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased fiber length, increased photosynthetic capacity, increased nitrogen use efficiency, and/or increased abiotic stress tolerance, thereby producing the crop.

According to an aspect of some embodiments of the present invention there is provided an isolated polynucleotide comprising a nucleic acid sequence encoding a polypeptide which comprises an amino acid sequence at least 80% homologous to the amino acid sequence set forth in SEQ ID NO: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, 15455-15721 or 15722, wherein the amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to an aspect of some embodiments of the present invention there is provided an isolated polynucleotide comprising a nucleic acid sequence at least 80% identical to SEQ ID NO: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, 8948-9270 or 9271, wherein the nucleic acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polynucleotide comprising the nucleic acid sequence selected from the group consisting of SEQ ID NOs: 4-86, 88, 100-312, 320-389, 391, 395-475, 477, 489-696, 704-709, 1157-4245, 4247-8375, 8387-8683, and 8686-9275.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, 15455-15721 or 15722, wherein the amino acid sequence is capable of increasing yield, growth rate, biomass, vigor, oil content, seed yield, fiber yield, fiber quality, fiber length, photosynthetic capacity, nitrogen use efficiency, and/or abiotic stress tolerance of a plant.

According to an aspect of some embodiments of the present invention there is provided an isolated polypeptide comprising the amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to some embodiments of the invention, the nucleic acid sequence encodes an amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to some embodiments of the invention, the nucleic acid sequence is selected from the group consisting of SEQ ID NOs: 4-86, 88, 100-312, 320-389, 391, 395-475, 477, 489-696, 704-709, 1157-4245, 4247-8375, 8387-8683, and 8686-9275.

According to some embodiments of the invention, the polynucleotide consists of the nucleic acid sequence selected from the group consisting of SEQ ID NOs: 4-86, 88, 100-312, 320-389, 391, 395-475, 477, 489-696, 704-709, 1157-4245, 4247-8375, 8387-8683, and 8686-9275.

According to some embodiments of the invention, the nucleic acid sequence encodes the amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to some embodiments of the invention, the plant cell forms part of a plant.

According to some embodiments of the invention, the method further comprising growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nitrogen deficiency, nutrient excess, atmospheric pollution and UV irradiation.

According to some embodiments of the invention, the yield comprises seed yield or oil yield.

According to an aspect of some embodiments of the present invention there is provided a transgenic plant comprising the nucleic acid construct of some embodiments of the invention or the plant cell of some embodiments of the invention.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to an aspect of some embodiments of the present invention there is provided a method of growing a crop, the method comprising seeding seeds and/or planting plantlets of a plant transformed with the isolated polynucleotide of some embodiments of the invention, or with the nucleic acid construct of some embodiments of the invention, wherein the plant is derived from plants which have been transformed with the exogenous polynucleotide and which have been selected for at least one trait selected from the group consisting of: increased nitrogen use efficiency, increased abiotic stress tolerance, increased biomass, increased growth rate, increased vigor, increased yield, increased fiber yield, increased fiber quality, increased fiber length, increased photosynthetic capacity, and increased oil content as compared to a non-transformed plant, thereby growing the crop.

According to some embodiments of the invention, the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

According to some embodiments of the invention, the method further comprising selecting a plant having an increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the present invention there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide encoding a polypeptide comprising an amino acid sequence at least 80% homologous to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the present invention there is provided a method of selecting a transformed plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, the method comprising:

(a) providing plants transformed with an exogenous polynucleotide at least 80% identical to the nucleic acid sequence selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271, (b) selecting from the plants of step (a) a plant having increased yield, growth rate, biomass, vigor, oil content, seed yield, fiber yield, fiber quality, fiber length, photosynthetic capacity, nitrogen use efficiency, and/or abiotic stress tolerance as compared to a wild type plant of the same species which is grown under the same growth conditions, thereby selecting the plant having the increased yield, growth rate, biomass, vigor, oil content, seed yield, fiber yield, fiber quality, fiber length, photosynthetic capacity, nitrogen use efficiency, and/or abiotic stress tolerance as compared to the wild type plant of the same species which is grown under the same growth conditions.

According to an aspect of some embodiments of the present invention there is provided a method of growing a crop comprising:

(a) selecting a parent plant transformed with an exogenous polynucleotide comprising a nucleic acid sequence encoding a polypeptide at least 80% homologous (e.g., identical) to the polypeptide selected from the group consisting of set forth in SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress tolerance as compared to a non-transformed plant of the same species which is grown under the same growth conditions, and (b) growing progeny crop plant of said parent plant, wherein said progeny crop plant which comprises said exogenous polynucleotide has said increased yield, said increased growth rate, said increased biomass, said increased vigor, said increased oil content, said increased seed yield, said increased fiber yield, said increased fiber quality, said increased fiber length, said increased photosynthetic capacity, said increased nitrogen use efficiency, and/or said increased abiotic stress, thereby growing the crop.

According to an aspect of some embodiments of the present invention there is provided a method of producing seeds of a crop comprising:

(a) selecting parent plant transformed with an exogenous polynucleotide comprising a nucleic acid sequence encoding a polypeptide at least 80% homologous (e.g., identical) to the polypeptide selected from the group consisting of set forth in SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress as compared to a non-transformed plant of the same species which is grown under the same growth conditions, (b) growing a seed producing plant from said parent plant resultant of step (a), wherein said seed producing plant which comprises said exogenous polynucleotide having said increased yield, said increased growth rate, said increased biomass, said increased vigor, said increased oil content, said increased seed yield, said increased fiber yield, said increased fiber quality, said increased fiber length, said increased photosynthetic capacity, said increased nitrogen use efficiency, and/or said increased abiotic stress, and (c) producing seeds from said seed producing plant resultant of step (b), thereby producing seeds of the crop.

According to some embodiments of the invention, selecting is performed under non-stress conditions.

According to some embodiments of the invention, selecting is performed under abiotic stress conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
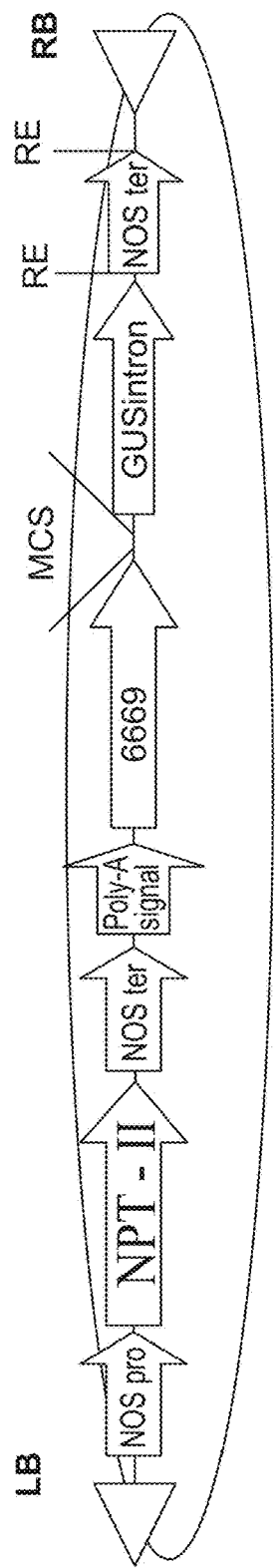
FIG. 1 is a schematic illustration of the modified pGI binary plasmid containing the new At6669 promoter (SEQ ID NO: 15751) and the GUSintron (pQYN 6669) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
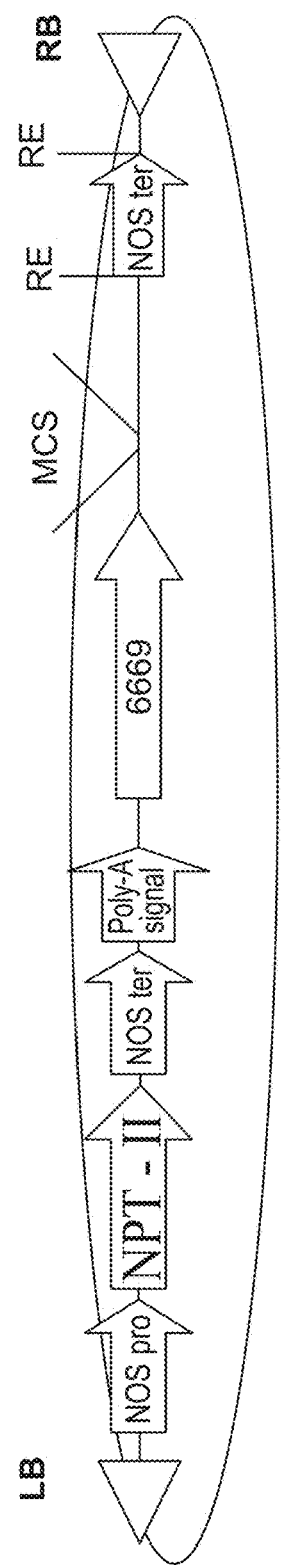
FIG. 2 is a schematic illustration of the modified pGI binary plasmid containing the new At6669 promoter (SEQ ID NO: 15751) (pQFN or pQFNc) used for expressing the isolated polynucleotide sequences of the invention. RB—T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); The isolated polynucleotide sequences of the invention were cloned into the MCS of the vector.
Figure 3A:
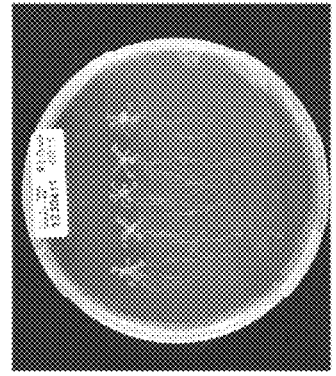
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3B:
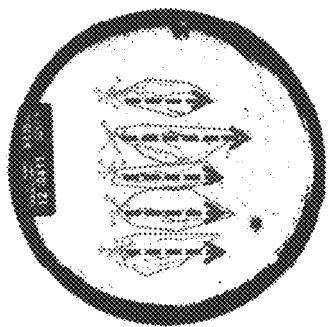
Figure 3C:
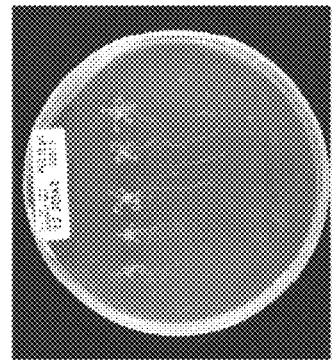
Figure 3D:
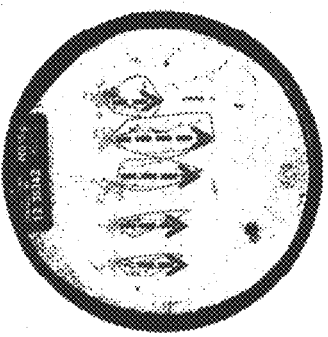
Figure 3E:
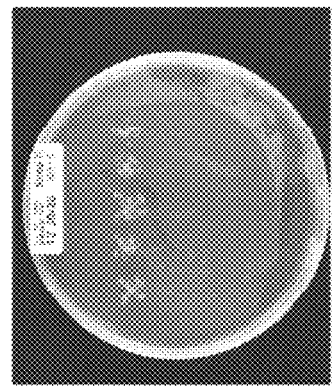
Figure 3F:
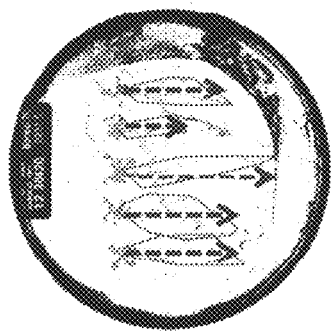
Figure 4:
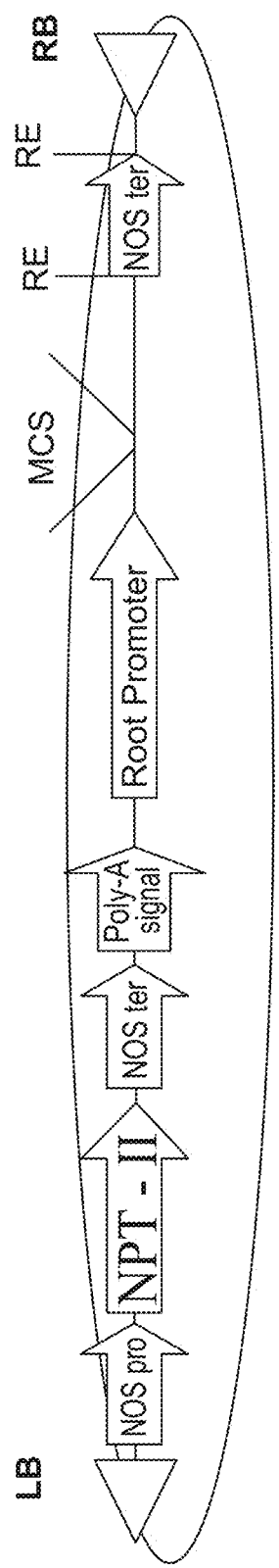
FIG. 4 is a schematic illustration of the modified pGI binary plasmid containing the Root Promoter (pQNa RP) used for expressing the isolated polynucleotide sequences of the invention. RB—T-DNA right border; LB—T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS (Multiple cloning site) of the vector.
Figure 5:
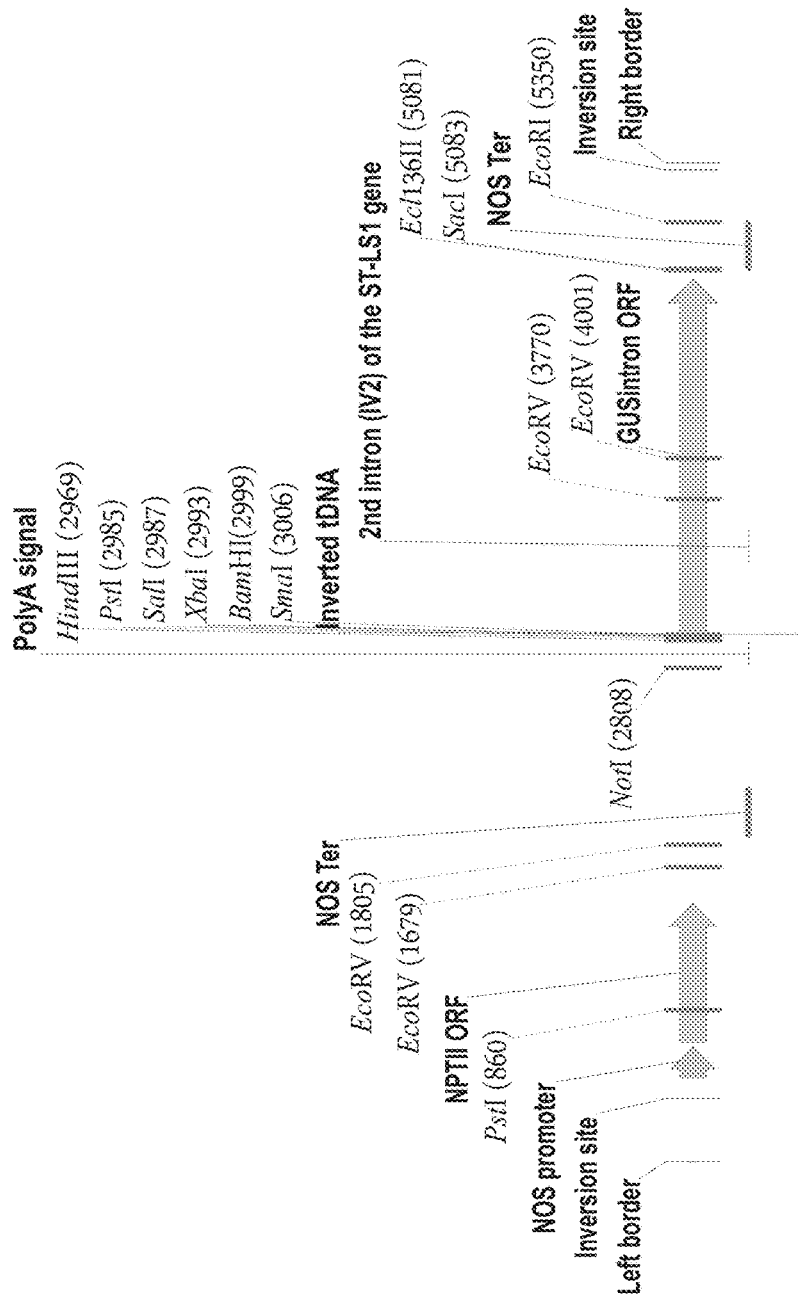
FIG. 5 is a schematic illustration of the pQYN plasmid.
Figure 6:
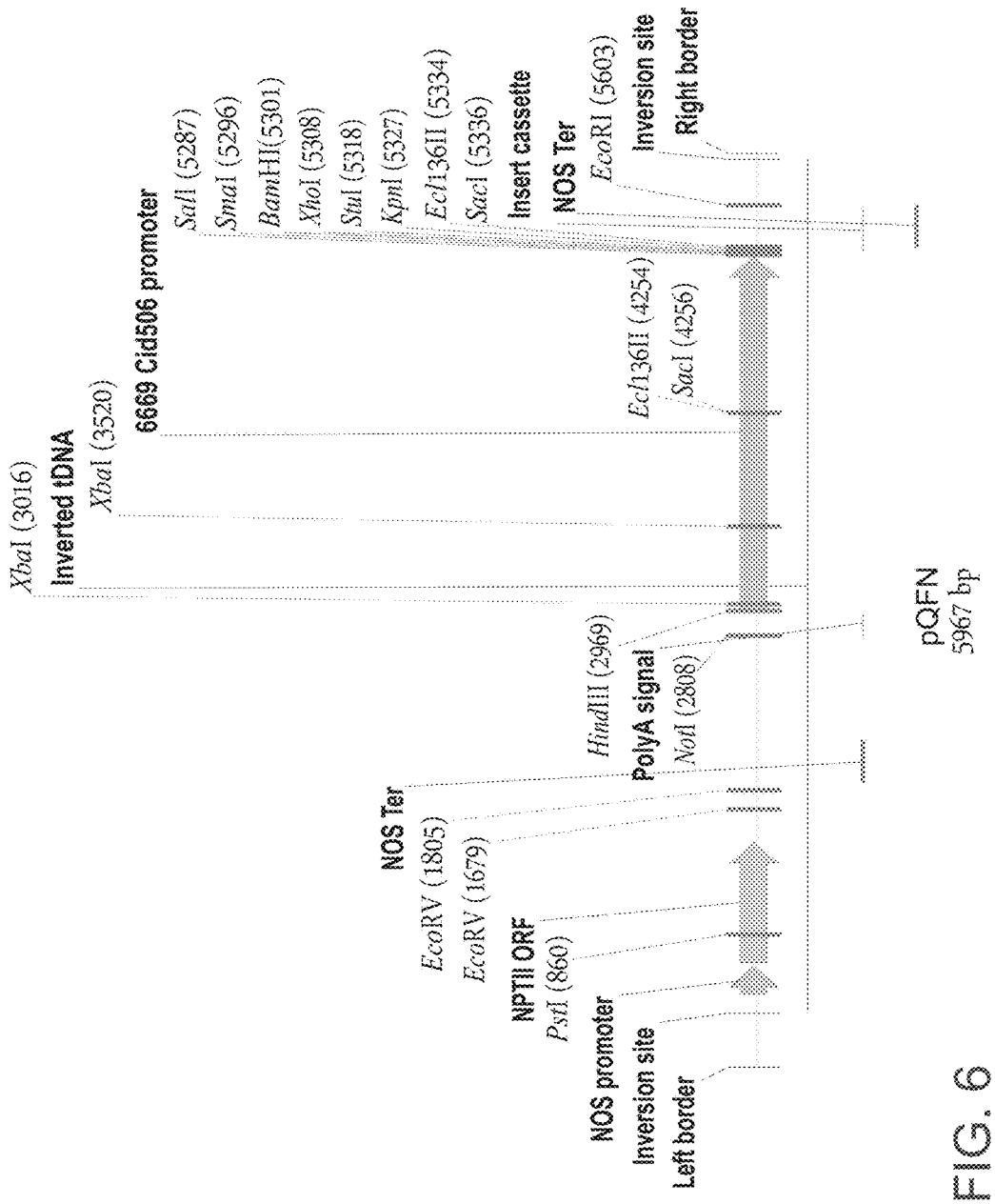
FIG. 6 is a schematic illustration of the pQFN plasmid.
Figure 7:
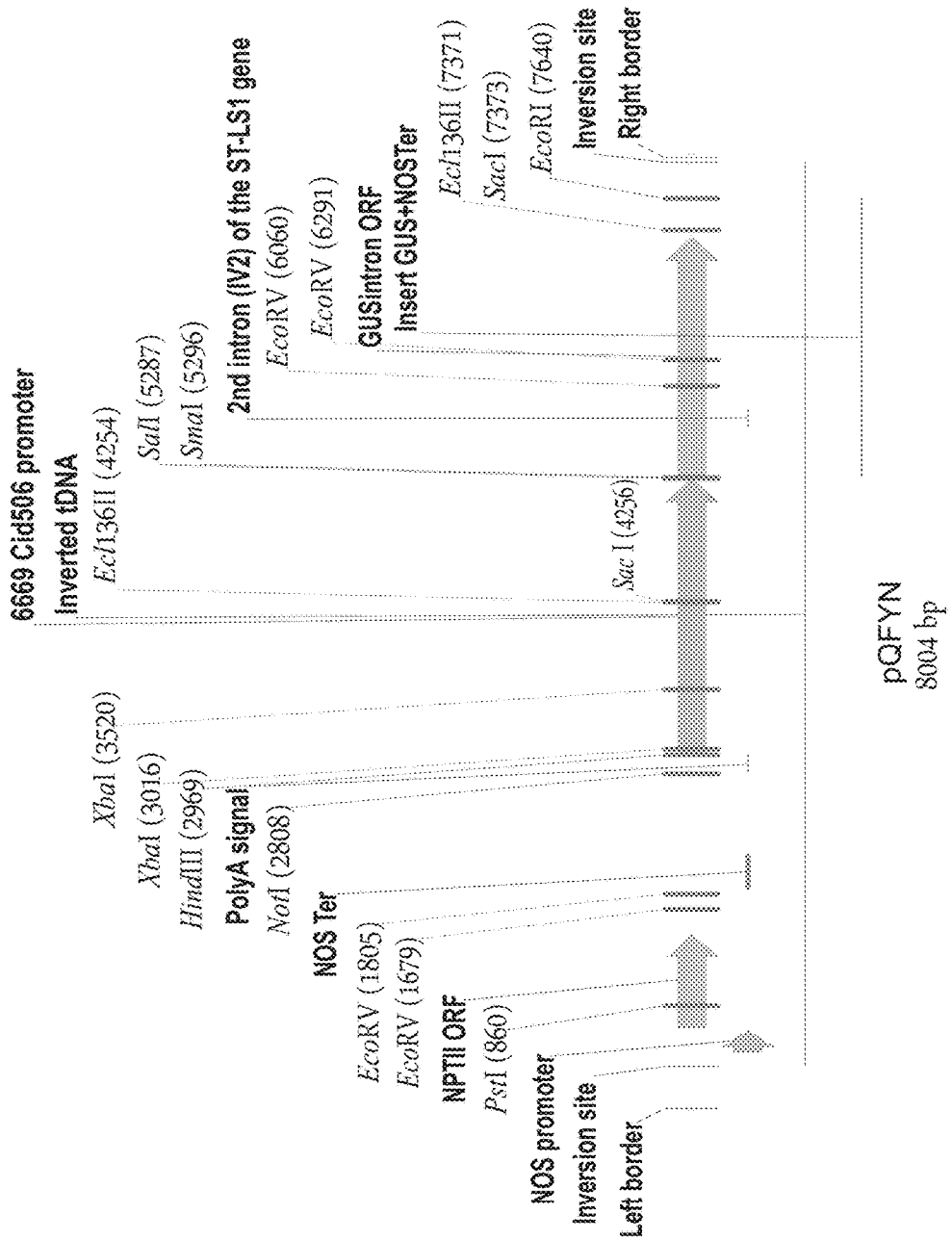
FIG. 7 is a schematic illustration of the pQFYN plasmid.
Figure 8:
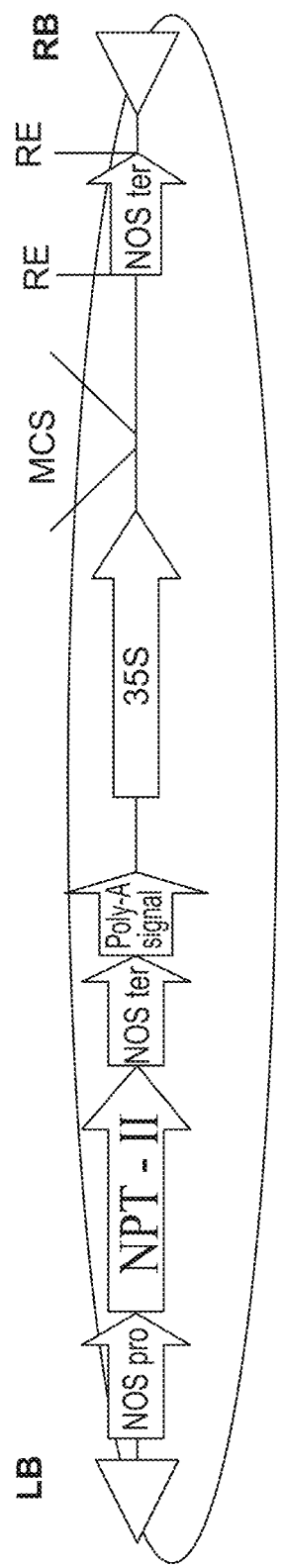
FIG. 8 is a schematic illustration of the modified pGI binary plasmid (pQXNc) used for expressing the isolated polynucleotide sequences of some embodiments of the invention. RB—T-DNA right border; LB—T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pqfnc; SEQ ID NO: 15747). The isolated polynucleotide sequences of some embodiments of the invention were cloned into the MCS (Multiple cloning site) of the vector.

The present invention, in some embodiments thereof, relates to isolated polynucleotides and polypeptides, nucleic acid constructs, transgenic cells and transgenic plants comprising same and methods of generating and using same, and, more particularly, but not exclusively, to methods of increasing yield, biomass, growth rate, vigor, oil content, fiber yield, fiber quality abiotic stress tolerance, and/or fertilizer use efficiency (e.g., nitrogen use efficiency) of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have identified novel polypeptides and polynucleotides which can be used to generate nucleic acid constructs, transgenic plants and to increase nitrogen use efficiency, fertilizer use efficiency, yield, growth rate, vigor, biomass, oil content, fiber yield, fiber quality, fiber length, photosynthetic capacity, abiotic stress tolerance and/or water use efficiency of a plant, such as a wheat plant.

Thus, as shown in the Examples section which follows, the present inventors have utilized bioinformatics tools to identify polynucleotides which enhance/increase fertilizer use efficiency (e.g., nitrogen use efficiency), yield (e.g., seed yield, oil yield, oil content), growth rate, biomass, vigor, fiber yield, fiber quality, fiber length, photosynthetic capacity, and/or abiotic stress tolerance of a plant. Genes which affect the trait-of-interest were identified (SEQ ID NOs: 710-1153 for polypeptides; and SEQ ID NOs: 1-709 for polypeptides) based on expression profiles of genes of several *Arabidopsis*, Barley, *Sorghum*, Maize, tomato, and Foxtail millet ecotypes and accessions in various tissues and growth conditions, homology with genes known to affect the trait-of-interest and using digital expression profile in specific tissues and conditions (Tables 1, 3-171, Examples 1 and 3-21 of the Examples section which follows). Homologous (e.g., orthologous) polypeptides and polynucleotides having the same function were also identified [SEQ ID NOs: 9276-15726 (for polypeptides), and SEQ ID NOs: 1157-9275 (for polynucleotides); Table 2, Example 2 of the Examples section which follows]. The polynucleotides of some embodiments of the invention were cloned into binary vectors (Example 22, Table 172), and were further transformed into *Arabidopsis* and *Brachypodium* plants (Examples 23-25). Transgenic plants over-expressing the identified polynucleotides were found to exhibit increased biomass, growth rate, vigor, photosynthetic capacity (e.g., increased leaf area for photosynthesis) and yield under normal growth conditions or under nitrogen limiting growth conditions (Tables 173-187; Examples 26-28), and increased tolerance to abiotic stress conditions (e.g., nutrient deficiency) as compared to control plants grown under the same growth conditions. Altogether, these results suggest the use of the novel polynucleotides and polypeptides of the invention [e.g., SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-

15441, 15443-15444, 15446, 15448-15449, and 15451-15726 (polypeptides) and SEQ ID NOs: 4-86, 88, 100-312, 320-389, 391, 395-475, 477, 489-696, 704-709, 1157-4245, 4247-8375, 8387-8683, and 8686-9275 (polynucleotides)] for increasing nitrogen use efficiency, fertilizer use efficiency, yield (e.g., oil yield, seed yield and oil content), growth rate, biomass, vigor, fiber yield, fiber quality, fiber length, photosynthetic capacity, water use efficiency and/or abiotic stress tolerance of a plant.

Thus, according to an aspect of some embodiments of the invention, there is provided method of increasing yield, growth rate, biomass, vigor, oil content, fiber yield, fiber quality, fiber length, photosynthetic capacity, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722, thereby increasing the yield, growth rate, biomass, vigor, oil content, fiber yield, fiber quality, fiber length, photosynthetic capacity, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the term "root biomass" refers to the total weight of the plant's root(s). Root biomass can be determined directly by weighing the total root material (fresh and/or dry weight) of a plant.

Additional or alternatively, the root biomass can be indirectly determined by measuring root coverage, root density and/or root length of a plant.

It should be noted that plants having a larger root coverage exhibit higher fertilizer (e.g., nitrogen) use efficiency and/or higher water use efficiency as compared to plants with a smaller root coverage.

As used herein the phrase "root coverage" refers to the total area or volume of soil or of any plant-growing medium encompassed by the roots of a plant.

According to some embodiments of the invention, the root coverage is the minimal convex volume encompassed by the roots of the plant.

It should be noted that since each plant has a characteristic root system, e.g., some plants exhibit a shallow root system (e.g., only a few centimeters below ground level), while others have a deep in soil root system (e.g., a few tens of centimeters or a few meters deep in soil below ground level), measuring the root coverage of a plant can be performed in any depth of the soil or of the plant-growing medium, and comparison of root coverage between plants of the same species (e.g., a transgenic plant exogenously expressing the polynucleotide of some embodiments of the invention and a control plant) should be performed by measuring the root coverage in the same depth.

According to some embodiments of the invention, the root coverage is the minimal convex area encompassed by the roots of a plant in a specific depth.

Figure 10:
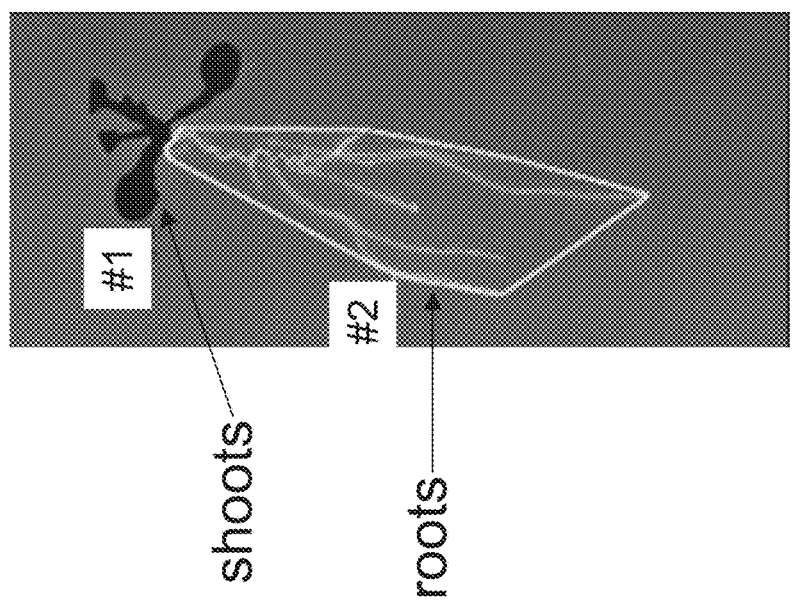
FIG. 10 depicts seedling analysis of an *Arabidopsis* plant having shoots (upper part, marked "#1") and roots (lower part, marked "#2"). Using an image analysis system the minimal convex area encompassed by the roots is determined. Such area corresponds to the root coverage of the plant.

A non-limiting example of measuring root coverage is shown in FIG. 10.

As used herein the term "root density" refers to the density of roots in a given area (e.g., area of soil or any plant growing medium). The root density can be determined by counting the root number per a predetermined area at a predetermined depth (in units of root number per area, e.g., $mm^2$, $cm^2$ or $m^2$).

As used herein the phrase "root length" refers to the total length of the longest root of a single plant.

As used herein the phrase "root length growth rate" refers to the change in total root length per plant per time unit (e.g., per day).

As used herein the phrase "growth rate" refers to the increase in plant organ/tissue size per time (can be measured in $cm^2$ per day or cm/day).

As used herein the phrase "photosynthetic capacity" (also known as "$A_{max}$") is a measure of the maximum rate at which leaves are able to fix carbon during photosynthesis. It is typically measured as the amount of carbon dioxide that is fixed per square meter per second, for example as $\mu mol$ $m^{-2}$ $sec^{-1}$. Plants are able to increase their photosynthetic capacity by several modes of action, such as by increasing the total leaves area (e.g., by increase of leaves area, increase in the number of leaves, and increase in plant's vigor, e.g., the ability of the plant to grow new leaves along time course) as well as by increasing the ability of the plant to efficiently execute carbon fixation in the leaves. Hence, the increase in total leaves area can be used as a reliable measurement parameter for photosynthetic capacity increment.

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant trait such as yield, growth rate, biomass, vigor, oil content, fiber yield, fiber quality, fiber length, photosynthetic capacity, fertilizer use efficiency (e.g., nitrogen use efficiency) can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

One unit of nitrogen refers to one kg (kilogram) of total nitrogen per dunam (1000 $m^2$).

Following is a non-limiting description of non-stress (normal) growth conditions which can be used for growing the transgenic plants expressing the polynucleotides or polypeptides of some embodiments of the invention.

For example, normal conditions for growing sorghum include irrigation with about 452,000 liter water per dunam (1000 square meters) and fertilization with about 14 units nitrogen per dunam per growing season.

Normal conditions for growing cotton include irrigation with about 580,000 liter water per dunam (1000 square meters) and fertilization with about 24 units nitrogen per dunam per growing season.

Normal conditions for growing bean include irrigation with about 524,000 liter water per dunam (1000 square meters) and fertilization with about 16 units nitrogen per dunam per growing season.

Normal conditions for growing *B. Juncea* include irrigation with about 861,000 liter water per dunam (1000 square meters) and fertilization with about 12 units nitrogen per dunam per growing season.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, osmotic stress, water deprivation, drought, flooding, freezing, low or high temperature, heavy metal toxicity, anaerobiosis, nutrient deficiency (e.g., nitrogen deficiency or limited nitrogen), atmospheric pollution or UV irradiation. The implications of abiotic stress are discussed in the Background section.

The phrase "abiotic stress tolerance" as used herein refers to the ability of a plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e g, ammonium or nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield. It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, *Ceiba pentandra*), desert willow, creosote bush, winterfat, balsa, kenaf, roselle, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, seed yield, biomass, growth rate, vigor, oil content, fiber yield, fiber quality, fiber length, photosynthetic capacity, abiotic stress tolerance, and/or nitrogen use efficiency of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13529, 13941-13942, 13946-14913, 14989-15034, 15037-15049, 15051-15072, 15074-15221, 15229-15252, 15254-15272, 15281-15409, 15425, 15428-15434, and 15455-15722.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y (Sequence-Evolution-Function: Computational Approaches in Comparative Genomics. Boston: Kluwer Academic; 2003. Chapter 2, Evolutionary Concept in Genetics and Genomics. Available from: ncbi (dot) nlm (dot) nih (dot) gov/books/NBK20255) and therefore have great likelihood of having the same function.

One option to identify orthologues in monocot plant species is by performing a reciprocal blast search. This may be done by a first blast involving blasting the sequence-of-interest against any sequence database, such as the publicly available NCBI database which may be found at: ncbi (dot) nlm (dot) nih (dot) gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [ebi (dot) ac (dot) uk/Tools/clustalw2/index (dot) html], followed by a neighbor-joining tree (wikipedia (dot) org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. [Amino acid substitution matrices from protein blocks. Proc. Natl. Acad. Sci. U.S.A. 1992, 89(22): 10915-9].

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration (dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss (dot)sourceforge(dot)net/apps/cvs/emboss/apps/needle(dot) html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter): EMBOSS-6.0.1 Needleman-Wunsch algorithm with the following modified parameters: gapopen=8 gapextend=2. The rest of the parameters are unchanged from the default options listed here:

Standard (Mandatory) Qualifiers:

[-asequence] sequence Sequence filename and optional format, or reference (input USA)

[-bsequence] seqall Sequence(s) filename and optional format, or reference (input USA)

-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)

-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)

[-outfile] align [*.needle] Output alignment file name

Additional (Optional) Qualifiers:

-datafile matrixf [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation.

Advanced (Unprompted) Qualifiers:

-[no]brief boolean [Y] Brief identity and similarity

Associated Qualifiers:

"-asequence" associated qualifiers

-sbegin1 integer Start of the sequence to be used

-send1 integer End of the sequence to be used
-sreverse1 boolean Reverse (if DNA)
-sask1 boolean Ask for begin/end/reverse
-snucleotide1 boolean Sequence is nucleotide
-sprotein1 boolean Sequence is protein
-slower1 boolean Make lower case
-supper1 boolean Make upper case
-sformat1 string Input sequence format
-sdbname1 string Database name
-sid1 string Entryname
-ufo1 string UFO features
-fformat1 string Features format
-fopenfile1 string Features file name
"-bsequence" associated qualifiers
-sbegin2 integer Start of each sequence to be used
-send2 integer End of each sequence to be used
-sreverse2 boolean Reverse (if DNA)
-sask2 boolean Ask for begin/end/reverse
-snucleotide2 boolean Sequence is nucleotide
-sprotein2 boolean Sequence is protein
-slower2 boolean Make lower case
-supper2 boolean Make upper case
-sformat2 string Input sequence format
-sdbname2 string Database name
-sid2 string Entryname
-ufo2 string UFO features
-fformat2 string Features format
-fopenfile2 string Features file name
"-outfile" associated qualifiers
-aformat3 string Alignment format
-aextension3 string File name extension
-adirectory3 string Output directory
-aname3 string Base file name
-awidth3 integer Alignment width
-aaccshow3 boolean Show accession number in the header
-adesshow3 boolean Show description in the header
-ausashow3 boolean Show the full USA in the alignment
-aglobal3 boolean Show the full sequence in alignment
General Qualifiers:
-auto boolean Turn off prompts
-stdout boolean Write first file to standard output
-filter boolean Read first file from standard input, write first file to standard output
-options boolean Prompt for standard and additional values
-debug boolean Write debug output to program.dbg
-verbose boolean Report some/full command line options
-help boolean Report command line options. More information on associated and general qualifiers can be found with-help-verbose
-warning boolean Report warnings
-error boolean Report errors
-fatal boolean Report fatal errors
-die boolean Report dying program messages 2. Between a Protein Sequence and a Nucleotide Sequence (Following the tblastn Filter):

GenCore 6.0 OneModel application utilizing the Frame+ algorithm with the following parameters: model=frame+_p2n.model mode=qglobal-q=protein.sequence-db=nucleotide.sequence. The rest of the parameters are unchanged from the default options:
Usage:
   om-model=<model_fname>[-q=]query [-db=]database [options]

-model=<model_fname> Specifies the model that you want to run. All models supplied by Compugen are located in the directory $CGNROOT/models/.
Valid Command Line Parameters:
-dev=<dev_name> Selects the device to be used by the application.
   Valid devices are:
      bic—Bioccelerator (valid for SW, XSW, FRAME_N2P, and FRAME_P2N models).
      xlg—BioXL/G (valid for all models except XSW).
      xlp—BioXL/P (valid for SW, FRAME+_N2P, and FRAME_P2N models).
      xlh—BioXL/H (valid for SW, FRAME+_N2P, and FRAME_P2N models).
      soft—Software device (for all models).
-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.
-db=<database name> Chooses the database set. The database set can be a sequence file or a database reference. The database format is detected automatically. However, you may specify a format using -dfmt parameter.
-qacc Add this parameter to the command line if you specify query using accession numbers.
-dacc Add this parameter to the command line if you specify a database using accession numbers.
-dfmt/-qfmt=<format_type> Chooses the database/query format type. Possible formats are:
   fasta—fasta with seq type auto-detected.
   fastap—fasta protein seq.
   fastan—fasta nucleic seq.
   gcg—gcg format, type is auto-detected.
   gcg9seq—gcg9 format, type is auto-detected.
   gcg9seqp—gcg9 format protein seq.
   gcg9seqn—gcg9 format nucleic seq.
   nbrf—nbrf seq, type is auto-detected.
   nbrfp—nbrf protein seq.
   nbrfn—nbrf nucleic seq.
   embl—embl and swissprot format.
   genbank—genbank format (nucleic).
   blast—blast format.
   nbrf gcg—nbrf-gcg seq, type is auto-detected.
   nbrfgcgp—nbrf-gcg protein seq.
   nbrfgcgn—nbrf-gcg nucleic seq.
   raw—raw ascii sequence, type is auto-detected.
   rawp—raw ascii protein sequence.
   rawn—raw ascii nucleic sequence.
   pir—pir codata format, type is auto-detected.
   profile—gcg profile (valid only for -qfmt in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.

-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
  Valid for SW and XSW.
-dtrans Performs a translated search, relevant for a protein query against a DNA database. Each database entry is translated to six reading frames and a result is given for each frame.
  Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
    zscore.
    escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS.
Possible values are:
    PFS—PFS text format
    FASTA—FASTA text format
    BLAST—BLAST text format
-nonorm Do not perform score normalization.
-norm=<norm_name> Specifies the normalization method. Valid options are:
    log—logarithm normalization.
    std—standard normalization.
    stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note: "-batch" and "-wait" parameters are mutually exclusive.
-version Prints the software version number.
-help Displays this help message. To get more specific help type:
    "om -model=<model_fname>-help".
  According to some embodiments the homology is a local homology or a local identity.
  Local alignments tools include, but are not limited to the BlastP, BlastN, BlastX or TBLASTN software of the National Center of Biotechnology Information (NCBI), FASTA, and the Smith-Waterman algorithm.
  A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.
  Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.
  Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.
  According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722.

According to some embodiments of the invention, the exogenous polynucleotide of the invention encodes a polypeptide having the amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to some embodiments of the invention, the method of increasing yield, seed yield, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722, thereby increasing the yield, seed yield, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, 15451-15725 or 15726.

According to an aspect of some embodiments of the invention, the method of increasing yield, seed yield, biomass, growth rate, vigor, oil content, fiber yield, fiber quality, fiber length, photosynthetic capacity, abiotic stress tolerance, and/or nitrogen use efficiency of a plant, is effected by expressing within the plant an exogenous polynucleotide comprising a nucleic acid sequence encoding a polypeptide comprising an amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726, thereby increasing the yield, seed yield, biomass, growth rate, vigor, oil content, fiber yield, fiber quality, fiber length, photosynthetic capacity, abiotic stress tolerance, and/or nitrogen use efficiency of the plant.

According to an aspect of some embodiments of the invention, there is provided a method of increasing yield, seed yield, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence encoding a polypeptide selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726, thereby increasing the yield, seed yield, biomass, growth rate, vigor, oil content, fiber yield, fiber quality, fiber length, photosynthetic capacity, abiotic stress tolerance, and/or nitrogen use efficiency of the plant.

According to some embodiments of the invention, the exogenous polynucleotide encodes a polypeptide consisting of the amino acid sequence set forth by SEQ ID NO: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, 15451-15725 or 15726.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271.

According to an aspect of some embodiments of the invention, there is provided a method of increasing yield, seed yield, biomass, growth rate, vigor, oil content, fiber yield, fiber quality, fiber length, photosynthetic capacity, abiotic stress tolerance, and/or nitrogen use efficiency of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271, thereby increasing the yield, seed yield, biomass, growth rate, vigor, oil content, fiber yield, fiber quality, fiber length, photosynthetic capacity, abiotic stress tolerance, and/or nitrogen use efficiency of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271.

According to some embodiments of the invention the exogenous polynucleotide is set forth by SEQ ID NO: 4-86, 88, 100-312, 320-389, 391, 395-475, 477, 489-696, 704-709, 1157-4245, 4247-8375, 8387-8683, 8686-9274 or 9275.

According to some embodiments of the invention the method of increasing yield, seed yield, biomass, growth rate, vigor, oil content, fiber yield, fiber quality, fiber length, photosynthetic capacity, abiotic stress tolerance, and/or nitrogen use efficiency of a plant further comprising selecting a plant having an increased yield, seed yield, biomass, growth rate, vigor, oil content, fiber yield, fiber quality, fiber length, photosynthetic capacity, abiotic stress tolerance, and/or nitrogen use efficiency as compared to the wild type plant of the same species which is grown under the same growth conditions.

It should be noted that selecting a transformed plant having an increased trait as compared to a native (or non-transformed) plant grown under the same growth conditions can be performed by selecting for the trait, e.g., validating the ability of the transformed plant to exhibit the increased trait using well known assays (e.g., seedling analyses, greenhouse assays) as is further described herein below.

According to some embodiments of the invention selecting is performed under non-stress conditions.

According to some embodiments of the invention selecting is performed under abiotic stress conditions.

According to some embodiments of the invention selecting is performed under nitrogen limiting conditions.

According to an aspect of some embodiments of the invention, there is provided a method of selecting a transformed plant having increased yield, seed yield, biomass, growth rate, vigor, oil content, fiber yield, fiber quality, fiber length, photosynthetic capacity, abiotic stress tolerance, and/or nitrogen use efficiency as compared to a wild type plant of the same species which is grown under the same growth conditions, the method comprising:

(a) providing plants transformed with an exogenous polynucleotide encoding a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (e.g., having sequence similarity or sequence identity) to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722, (b) selecting from the plants of step (a) a plant having increased yield, seed yield, biomass, growth rate, vigor, oil content, fiber yield, fiber quality, fiber length, photosynthetic capacity, abiotic stress tolerance, and/or nitrogen use efficiency (e.g., by selecting the plants for the increased trait), thereby selecting the plant having increased yield, seed yield, biomass, growth rate, vigor, oil content, fiber yield, fiber quality, fiber length, photosynthetic capacity, abiotic stress tolerance, and/or nitrogen use efficiency as compared to the wild type plant of the same species which is grown under the same growth conditions.

According to an aspect of some embodiments of the invention, there is provided a method of selecting a transformed plant having increased yield, seed yield, biomass, growth rate, vigor, oil content, fiber yield, fiber quality, fiber length, photosynthetic capacity, abiotic stress tolerance, and/or nitrogen use efficiency as compared to a wild type plant of the same species which is grown under the same growth conditions, the method comprising:

(a) providing plants transformed with an exogenous polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271, (b) selecting from the plants of step (a) a plant having increased yield, seed yield, biomass, growth rate, vigor, oil content, fiber yield, fiber quality, fiber length, photosynthetic capacity, abiotic stress tolerance, and/or nitrogen use efficiency, thereby selecting the plant having increased yield, seed yield, biomass, growth rate, vigor, oil content, fiber yield, fiber quality, fiber length, photosynthetic capacity, abiotic stress tolerance, and/or nitrogen use efficiency as compared to the wild type plant of the same species which is grown under the same growth conditions.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N[(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 1810, 3292, 3297-3302, 4172, 4177, 4180-4183, 4185-4189, 4193-4207, 4216-4235, 4245-4257, 4265-4283, 4285-4290, 4292-4311, 4320-4324, 4327-4328, 4331-4334, 4337-4341, 4348-4360, 4363-4371, 4373-4378, 4381, 4383-4391, 4393-4394, 4396, 4398-4404, 4406, 4408-4410, 4413-4417, 4419-4421, 4424-4431, 4677, 4702, 4887, 5003-5004, 5107, 5277, 5354, 5676, 5697, 5714, 6024, 6031, 6565-6566, 6958, 7117, 8233, 8263, and 8667.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to some embodiments of the invention, the exogenous polynucleotide encodes a polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to some embodiments of the invention, the polypeptide comprising an amino acid sequence at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the amino acid sequence of a naturally occurring plant orthologue of the polypeptide selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271.

According to some embodiments of the invention the nucleic acid sequence is capable of increasing yield, seed yield, biomass, growth rate, vigor, oil content, fiber yield, fiber quality, fiber length, photosynthetic capacity, abiotic stress tolerance, nitrogen use efficiency and/or water use efficiency of a plant.

According to some embodiments of the invention the isolated polynucleotide comprising the nucleic acid sequence selected from the group consisting of SEQ ID NOs: 4-86, 88, 100-312, 320-389, 391, 395-475, 477, 489-696, 704-709, 1157-4245, 4247-8375, 8387-8683, and 8686-9275.

According to some embodiments of the invention the isolated polynucleotide is set forth by SEQ ID NO: 4-86, 88, 100-312, 320-389, 391, 395-475, 477, 489-696, 704-709, 1157-4245, 4247-8375, 8387-8683, 8686-9274 or 9275.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722.

According to some embodiments of the invention the amino acid sequence is capable of increasing yield, seed yield, biomass, growth rate, vigor, oil content, fiber yield, fiber quality, fiber length, photosynthetic capacity, abiotic stress tolerance, nitrogen use efficiency and/or water use efficiency of a plant.

The invention provides an isolated polynucleotide comprising a nucleic acid sequence encoding a polypeptide which comprises the amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722.

According to some embodiments of the invention, the polypeptide comprising an amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to some embodiments of the invention, the polypeptide is set forth by SEQ ID NO: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, 15451-15725 or 15726.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia*

*glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys veffiicillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus,* a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 15727; Albani et al, Plant Cell, 9: 171-184, 1997, which is fully incorporated herein by reference), wheat LMW (SEQ ID NO: 15728 (longer LMW promoter), and SEQ ID NO: 15729 (LMW promoter) and HMW glutenin-1 (SEQ ID NO: 15730 (Wheat HMW glutenin-1 longer promoter); and SEQ ID NO: 15731 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 15732 (wheat alpha gliadin, B genome, promoter); SEQ ID NO: 15733 (wheat gamma gliadin promoter); EMBO 3:1409-15, 1984, which is fully incorporated herein by reference], wheat TdPR60 [SEQ ID NO: 15734 (wheat TdPR60 longer promoter) or SEQ ID NO: 15735 (wheat TdPR60 promoter); Kovalchuk et al., Plant Mol Biol 71:81-98, 2009, which is fully incorporated herein by reference], maize Ubl Promoter [cultivar Nongda 105 (SEQ ID NO: 15736); GenBank: DQ141598.1; Taylor et al., Plant Cell Rep 1993 12: 491-495, which is fully incorporated herein by reference; and cultivar B73 (SEQ ID NO: 15737); Christensen, A H, et al. Plant Mol. Biol. 18 (4), 675-689 (1992), which is fully incorporated herein by reference]; rice actin 1 (SEQ ID NO: 15738; Mc Elroy et al. 1990, The Plant Cell, Vol. 2, 163-171, which is fully incorporated herein by reference), rice GOS2 [SEQ ID NO: 15739 (rice GOS2 longer promoter) and SEQ ID NO: 15740 (rice GOS2 Promoter); De Pater et al. Plant J. 1992; 2: 837-44, which is fully incorporated herein by reference], *arabidopsis* Pho1 [SEQ ID NO: 15741 (*arabidopsis* Pho1 Promoter); Hamburger et al., Plant Cell. 2002; 14: 889-902, which is fully incorporated herein by reference], ExpansinB promoters, e.g., rice ExpB5 [SEQ ID NO: 15742 (rice ExpB5 longer promoter) and SEQ ID NO: 15743 (rice ExpB5 promoter)] and Barley ExpB1 [SEQ ID NO: 15744 (barley ExpB1 Promoter), Won et al. Mol Cells. 2010; 30:369-76, which is fully incorporated herein by reference], barley SS2 (sucrose synthase 2) [(SEQ ID NO: 15745), Guerin and Carbonero, *Plant Physiology* May 1997 vol. 114 no. 1 55-62, which is fully incorporated herein by reference], and rice PG5a [SEQ ID NO: 15746, U.S. Pat. No. 7,700,835, Nakase et al., Plant Mol Biol. 32:621-30, 1996, each of which is fully incorporated herein by reference].

Suitable constitutive promoters include, for example, CaMV 35S promoter [SEQ ID NO: 15747 (CaMV 35S (QFNC) Promoter); SEQ ID NO: 15748 (PJJ 35S from *Brachypodium*); SEQ ID NO: 15749 (CaMV 35S (OLD) Promoter) (Odell et al., Nature 313:810-812, 1985)], *Arabidopsis* At6669 promoter (SEQ ID NO: 15750 (*Arabidopsis* At6669 (OLD) Promoter); see PCT Publication No. WO04081173A2 or the new At6669 promoter (SEQ ID NO: 15751 (*Arabidopsis* At6669 (NEW) Promoter)); maize Ubl Promoter [cultivar Nongda 105 (SEQ ID NO: 15736); GenBank: DQ141598.1; Taylor et al., Plant Cell Rep 1993 12: 491-495, which is fully incorporated herein by reference; and cultivar B73 (SEQ ID NO: 15737); Christensen, A H, et al. Plant Mol. Biol. 18 (4), 675-689 (1992), which is fully incorporated herein by reference]; rice actin 1 (SEQ ID NO: 15738, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 15739 (rice GOS2 longer Promoter) and SEQ ID NO: 15740 (rice GOS2 Promoter), de Pater et al, Plant J November; 2(6):837-44, 1992]; RBCS promoter (SEQ ID NO: 15752); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026; 5,608,149; 5,608,144; 5,604,121; 5,569,597; 5,466,785; 5,399,680; 5,268,463; and 5,608,142.

Suitable tissue-specific promoters include, but not limited to, leaf-specific promoters [e.g., AT5G06690 (Thioredoxin) (high expression, SEQ ID NO: 15753), AT5G61520 (AtSTP3) (low expression, SEQ ID NO: 15754) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 15755 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 15746; U.S. Pat. No. 7,700,835), early seed development *Arabidopsis* BAN (AT1G61720) (SEQ ID NO: 15756, US 2009/0031450 A1), late seed development *Arabidopsis* ABI3 (AT3G24650) (SEQ ID NO: 15757 (*Arabidopsis* ABI3 (AT3G24650) longer Promoter) or SEQ ID NO:15758 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (SEQ ID NO: 15727; Albani et al, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 15728 (Wheat LMW Longer Promoter), and SEQ ID NO: 15729 (Wheat LMW Promoter) and HMW glutenin-1 [(SEQ ID NO: 15730 (Wheat HMW glutenin-1 longer Promoter)); and SEQ ID NO: 15731 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO: 15732 (wheat alpha gliadin (B genome) promoter); SEQ ID NO: 15733 (wheat gamma gliadin promoter); EMBO 3:1409-15, 1984), Barley ltrl promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO: 15745 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217: 240-245; 1989), *Arabidopsis* apetala-3 (Tilly et al., Development. 125:1647-57, 1998), *Arabidopsis* APETALA 1 (AT1G69120, AP1) (SEQ ID NO: 15759 (*Arabidopsis* (AT1G69120) APETALA 1)) (Hempel et al., Development 124:3845-3853, 1997)], and root promoters [e.g., the ROOTP promoter [SEQ ID NO: 15760]; rice ExpB5 (SEQ ID NO: 15743 (rice ExpB5 Promoter); or SEQ ID NO: 15742 (rice ExpB5 longer Promoter)) and barley ExpB1 promoters (SEQ ID NO: 15744) (Won et al. Mol. Cells 30: 369-376, 2010); *arabidopsis* ATTPS-CIN (AT3G25820) promoter (SEQ ID NO: 15761; Chen et al., Plant Phys 135:1956-66, 2004); *arabidopsis* Pho1 promoter (SEQ ID NO: 15741, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments, there is provided a method of improving nitrogen use efficiency, yield, seed yield, growth rate, biomass, vigor, oil content, fiber yield, fiber quality, fiber length, photosynthetic capacity, and/or abiotic stress tolerance of a grafted plant, the method comprising providing a scion that does not transgenically express a polynucleotide encoding a polypeptide at least 80% homologous to the amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722 (e.g., in a constitutive, tissue specific or inducible, e.g., in an abiotic stress responsive manner), thereby improving the nitrogen use efficiency, yield, growth rate, biomass, vigor, oil content, seed yield, fiber yield, fiber quality, fiber length, photosynthetic capacity, and/or abiotic stress tolerance of the grafted plant.

In some embodiments, the plant scion is non-transgenic.

Several embodiments relate to a grafted plant exhibiting improved nitrogen use efficiency, yield, growth rate, biomass, vigor, oil content, seed yield, fiber yield, fiber quality, fiber length, photosynthetic capacity, and/or abiotic stress tolerance, comprising a scion that does not transgenically express a polynucleotide encoding a polypeptide at least 80% homologous to the amino acid sequence selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726 and a plant rootstock that transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722.

In some embodiments, the plant root stock transgenically expresses a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous (or identical) to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722 in a stress responsive manner.

According to some embodiments of the invention, the plant root stock transgenically expresses a polynucleotide encoding a polypeptide selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to some embodiments of the invention, the plant root stock transgenically expresses a polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271.

According to some embodiments of the invention, the plant root stock transgenically expresses a polynucleotide selected from the group consisting of SEQ ID NOs: 4-86, 88, 100-312, 320-389, 391, 395-475, 477, 489-696, 704-709, 1157-4245, 4247-8375, 8387-8683, and 8686-9275.

Since processes which increase yield, seed yield, biomass, growth rate, vigor, oil content, fiber yield, fiber quality, fiber length, photosynthetic capacity, abiotic stress tolerance, and/or nitrogen use efficiency of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on nitrogen use efficiency, fertilizer use efficiency, oil content, yield, seed yield, fiber yield, fiber quality, fiber length, photosynthetic capacity, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency (e.g., nitrogen deficiency or nitrogen limitation), nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions), wherein the normal or optimal conditions include about 6-15 mM Nitrogen, e.g., 6-10 mM Nitrogen).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722, wherein the plant is derived from a plant (parent plant) that has been transformed to express the exogenous polynucleotide and that has been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the polypeptide is selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271, wherein the plant is derived from a plant selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a control plant, thereby producing the crop.

According to an aspect of some embodiments of the present invention there is provided a method of producing a crop comprising growing a crop plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, and 8948-9271, wherein the crop plant is derived from plants which have been transformed with the exogenous polynucleotide and which have been selected for increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a wild type plant of the same species which is grown under the same growth conditions, and the crop plant having the increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency), thereby producing the crop.

According to some embodiments of the invention the exogenous polynucleotide is selected from the group consisting of SEQ ID NOs: 4-86, 88, 100-312, 320-389, 391, 395-475, 477, 489-696, 704-709, 1157-4245, 4247-8375, 8387-8683, and 8686-9275.

According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, 15455-15721 or 15722, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the polypeptide is selected from the group consisting of SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 4-7, 9-25, 28-32, 34-35, 37-56, 58-75, 77-79, 81-86, 88, 101-102, 104-167, 169-180, 182-220, 222-312, 320-389, 391, 395-398, 400-416, 419-423, 425-426, 428-447, 449-464, 466-468, 470-475, 477, 490-491, 493-555, 557-568, 570-605, 607-696, 704-709, 1164-1439, 1453, 1468-1733, 1788, 1795, 1806-1860, 1884, 1899, 1917-2324, 2331-3501, 3504-3506, 3509-3511, 3518-3526, 3528-3530, 3532, 3534-3536, 3540-3547, 3549, 3638, 3641-3643, 3652, 3661, 3663, 3668, 3671, 3683-3684, 3689, 3695-3696, 3700-3702, 3708, 3715-3718, 3720-3721, 3723-3724, 3726-3727, 3732-3733, 3735, 3737, 3740, 3750-3751, 3753, 3757, 3764-3765, 3768, 3772, 3776, 3783-3785, 3789-3792, 3794-3795, 3800-3803, 3806-3818, 3827, 3889, 3894, 3898, 3900, 3915-3916, 3936, 3943, 3964, 3971, 4099, 4101, 4103-4245, 4247-6064, 6103, 6112, 6137-6138, 6150, 6155, 6162, 6165-6237, 6245, 6249-6406, 6408-6434, 6437-7124, 7140-7141, 7145-8305, 8387-8453, 8457-8472, 8474-8505, 8507-8683, 8691-8720, 8722-8748, 8757-8898, 8915, 8918-8927, 8948-9270 or 9271, wherein the plant is derived from plants which have been transformed with the exogenous polynucleotide and which have been selected for at least one trait selected from the group consisting of increased abiotic stress tolerance, increased water use efficiency, increased growth rate, increased vigor, increased biomass, increased oil content, increased yield, increased seed yield, increased fiber yield, increased fiber quality, increased fiber length, increased photosynthetic capacity, and/or increased fertilizer use efficiency (e.g., increased nitrogen use efficiency) as compared to a non-transformed plant, thereby growing the crop.

According to some embodiments of the invention the exogenous polynucleotide is selected from the group consisting of SEQ ID NOs: 4-86, 88, 100-312, 320-389, 391, 395-475, 477, 489-696, 704-709, 1157-4245, 4247-8375, 8387-8683, and 8686-9275.

According to an aspect of some embodiments of the present invention there is provided a method of growing a crop comprising:

(a) selecting a parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of set forth in SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress tolerance as compared to a non-transformed plant of the same species which is grown under the same growth conditions, and (b) growing progeny crop plant of said parent plant, wherein said progeny crop plant which comprises said exogenous polynucleotide has said increased yield, said increased growth rate, said increased biomass, said increased vigor, said increased oil content, said increased seed yield, said increased fiber yield, said increased fiber quality, said increased fiber length, said increased photosynthetic capacity, said increased nitrogen use efficiency, and/or said increased abiotic stress, thereby growing the crop.

According to an aspect of some embodiments of the present invention there is provided a method of producing seeds of a crop comprising:

(a) selecting parent plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polypeptide selected from the group consisting of set forth in SEQ ID NOs: 713-716, 718-734, 737-741, 743-744, 746-765, 767-784, 786-788, 790-795, 797, 810-811, 813-876, 878-889, 891-929, 931-1021, 1029-1064, 1067-1074, 1076-1080, 1082-1088, 1091-1092, 1094-1153, 9283-9526, 9536, 9550-9772, 9825, 9832, 9843-9881, 9899, 9908, 9925-9988, 9990-10284, 10290-11275, 11278-11279, 11282-11284, 11289-11295, 11297-11299, 11301, 11303-11305, 11308-11312, 11314, 11384, 11386, 11394, 11400, 11407, 11416-11417, 11421, 11425-11426, 11429, 11433, 11439-11441, 11443-11444, 11446-11447, 11449-11450, 11453-11455, 11457, 11460, 11468-11469, 11471, 11475, 11482, 11485, 11488, 11494-11496, 11500-11503, 11505-11506, 11510-11513, 11516-11525, 11530, 11551, 11555, 11559, 11561, 11570-11571, 11582, 11589, 11605, 11612, 11695, 11697, 11699-13027, 13057, 13066, 13091-13092, 13104, 13109, 13116, 13119-13180, 13188, 13192-13327, 13329-13352, 13355-13929, 13941-13942, 13946-14913, 14989-15034, 15037-15049, 15051-15072, 15074-15221, 15229-15252, 15254-15272, 15281-15409, 15425, 15428-15434, and 15455-15722 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress as compared to a non-transformed plant of the same species which is grown under the same growth conditions, (b) growing a seed producing plant from said parent plant resultant of step (a), wherein said seed producing plant which comprises said exogenous polynucleotide having said increased yield, said increased growth rate, said increased biomass, said increased vigor, said increased oil content, said increased seed yield, said increased fiber yield, said increased fiber quality, said increased fiber length, said increased photosynthetic capacity, said increased nitrogen use efficiency, and/or said increased abiotic stress, and (c) producing seeds from said seed producing plant resultant of step (b), thereby producing seeds of the crop.

According to an aspect of some embodiments of the present invention there is provided a method of growing a crop comprising:

(a) selecting a parent plant transformed with an exogenous polynucleotide comprising a nucleic acid sequence encoding the polypeptide selected from the group consisting of set forth in SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress tolerance as compared to a non-transformed plant of the same species which is grown under the same growth conditions, and (b) growing progeny crop plant of said parent plant, wherein said progeny crop plant which comprises said exogenous polynucleotide has said increased yield, said increased growth rate, said increased biomass, said increased vigor, said increased oil content, said increased seed yield, said increased fiber yield, said increased fiber quality, said increased fiber length, said increased photosynthetic capacity, said increased nitrogen use efficiency, and/or said increased abiotic stress, thereby growing the crop.

According to an aspect of some embodiments of the present invention there is provided a method of producing seeds of a crop comprising:

(a) selecting parent plant transformed with an exogenous polynucleotide comprising a nucleic acid sequence encoding the polypeptide selected from the group consisting of set forth in SEQ ID NOs: 713-735, 737-741, 743-765, 767-795, 797, 809-1021, 1029-1064, 1067-1080, 1082-1092, 1094-1153, 9276-9281, 9283-9532, 9534-9541, 9543-9545, 9548-9774, 9776, 9778-9785, 9788-9791, 9793-9801, 9803, 9806-9807, 9809-9820, 9822-9823, 9825-9838, 9840-9841, 9843-9881, 9889-9890, 9893-9894, 9897-9899, 9901, 9904, 9906, 9908-9910, 9912-10285, 10287-11276, 11278-11319, 11321, 11323, 11328-11330, 11333-11336, 11339-11342, 11344-11355, 11357, 11359-11362, 11364-11366, 11369-13113, 13115-13944, 13946-14913, 14915, 14917-14918, 14920-14921, 14923-14924, 14927-14933, 14937, 14939-14940, 14942, 14944-14949, 14951, 14953, 14955-14958, 14960-14962, 14964-14971, 14973, 14976, 14978-14979, 14989-15221, 15225-15272, 15275-15410, 15412-15420, 15422-15423, 15425-15426, 15428-15434, 15436, 15440-15441, 15443-15444, 15446, 15448-15449, and 15451-15726 for at least one trait selected from the group consisting of: increased yield, increased growth rate, increased biomass, increased vigor, increased oil content, increased seed yield, increased fiber yield, increased fiber quality, increased fiber length, increased photosynthetic capacity, increased nitrogen use efficiency, and increased abiotic stress as compared to a non-transformed plant of the same species which is grown under the same growth conditions, (b) growing a seed producing plant from said parent plant resultant of step (a), wherein said seed producing plant which comprises said exogenous polynucleotide having said increased yield, said increased growth rate, said increased biomass, said increased vigor, said increased oil content, said increased seed yield, said increased fiber yield, said increased fiber quality, said increased fiber length, said increased photosynthetic capacity, said increased nitrogen use efficiency, and/or said increased abiotic stress, and (c) producing seeds from said seed producing plant resultant of step (b), thereby producing seeds of the crop.

According to some embodiments of the invention the exogenous polynucleotide is selected from the group consisting of SEQ ID NOs: 4-86, 88, 100-312, 320-389, 391, 395-475, 477, 489-696, 704-709, 1157-4245, 4247-8375, 8387-8683, and 8686-9275.

According to a specific embodiment of the invention, the exogenous polynucleotide is not an homologue of the polynucleotide selected from the group consisting of: SEQ ID NOs: 3560, 3569, 3606, 3608, 8329, 8331, 8351, 8360, 8688, 8939, 8947 and 9275.

According to a specific embodiment of the invention, the exogenous polynucleotide does not encode a homologue of the polypeptide selected from the group consisting of: SEQ ID NOs: 11323, 11330, 11364, 11366, 14937, 14939, 14958, 14967, 15226, 15446, 15454, and 15726.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

Formula I
$RWC=[(FW-DW)/(TW-DW)]\times 100$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner Normal conditions are considered for example, incubations at 22° C.

under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

It should be noted that an increase in rosette parameters such as rosette area, rosette diameter and/or rosette growth rate in a plant model such as *Arabidopsis* predicts an increase in canopy coverage and/or plot coverage in a target plant such as *Brassica* sp., soy, corn, wheat, Barley, oat, cotton, rice, tomato, sugar beet, and vegetables such as lettuce.

Evaluation of growth rate can be done by measuring plant biomass produced, rosette area, leaf size or root length per time (can be measured in $cm^2$ per day of leaf area).

Relative growth area can be calculated using Formula II.

Formula II

Relative growth rate area=Regression coefficient of area along time course

Thus, the relative growth area rate is in units of area units (e.g., $mm^2$/day or $cm^2$/day) and the relative length growth rate is in units of length units (e.g., cm/day or mm/day).

For example, RGR can be determined for plant height (Formula III), SPAD (Formula IV), Number of tillers (Formula V), root length (Formula VI), vegetative growth (Formula VII), leaf number (Formula VIII), rosette area (Formula IX), rosette diameter (Formula X), plot coverage (Formula XI), leaf blade area (Formula XII), and leaf area (Formula XIII).

Formula III: Relative growth rate of Plant height=Regression coefficient of Plant height along time course (measured in cm/day).

Formula IV: Relative growth rate of SPAD=Regression coefficient of SPAD measurements along time course.

Formula V: Relative growth rate of Number of tillers=Regression coefficient of Number of tillers along time course (measured in units of "number of tillers/day").

Formula VI: Relative growth rate of root length=Regression coefficient of root length along time course (measured in cm per day).

Vegetative growth rate analysis—was calculated according to Formula VII below.

Formula VII: Relative growth rate of vegetative growth=Regression coefficient of vegetative dry weight along time course (measured in grams per day).

Formula VIII: Relative growth rate of leaf number=Regression coefficient of leaf number along time course (measured in number per day).

Formula IX: Relative growth rate of rosette area=Regression coefficient of rosette area along time course (measured in $cm^2$ per day).

Formula X: Relative growth rate of rosette diameter=Regression coefficient of rosette diameter along time course (measured in cm per day).

Formula XI: Relative growth rate of plot coverage=Regression coefficient of plot (measured in $cm^2$ per day).

Formula XII: Relative growth rate of leaf blade area=Regression coefficient of leaf area along time course (measured in $cm^2$ per day).

Formula XIII: Relative growth rate of leaf area=Regression coefficient of leaf area along time course (measured in $cm^2$ per day).

Formula XIV: 1000 Seed Weight=number of seed in sample/sample weight×1000.

The Harvest Index can be calculated using Formulas XV, XVI, XVII, XVIII and LXV below.

Formula XV: Harvest Index (seed)=Average seed yield per plant/Average dry weight.

Formula XVI: Harvest Index (*Sorghum*)=Average grain dry weight per Head/(Average vegetative dry weight per Head+Average Head dry weight).

Formula XVII: Harvest Index (Maize)=Average grain weight per plant/(Average vegetative dry weight per plant plus Average grain weight per plant).

Harvest Index (for barley)—The harvest index is calculated using Formula XVIII.

Formula XVIII: Harvest Index (for barley and wheat) =Average spike dry weight per plant/(Average vegetative dry weight per plant+Average spike dry weight per plant).

Following is a non-limited list of additional parameters which can be detected in order to show the effect of the transgene on the desired plant's traits:

Formula XIX: Grain circularity=4×3.14 (grain area/perimeter$^2$)

Formula XX: Internode volume=3.14×(d/2)$^2$×1

Formula XXI: Total dry matter (kg)=Normalized head weight per plant+vegetative dry weight.

Formula XXII: Root/Shoot Ratio=total weight of the root at harvest/total weight of the vegetative portion above ground at harvest. (=RBiH/BiH)

Formula XXIII: Ratio of the number of pods per node on main stem at pod set=Total number of pods on main stem/Total number of nodes on main stem.

Formula XXIV: Ratio of total number of seeds in main stem to number of seeds on lateral branches=Total number of seeds on main stem at pod set/Total number of seeds on lateral branches at pod set.

Formula XXV: Petiole Relative Area=(Petiole area)/Rosette area (measured in %). Formula XXVI: % reproductive tiller percentage=Number of Reproductive tillers/number of tillers)×100.

Formula XXVII: Spikes Index=Average Spikes weight per plant/(Average vegetative dry weight per plant plus Average Spikes weight per plant).

Formula XXVIII:

Relative growth rate of root coverage=Regression coefficient of root coverage along time course.

Formula XXIX:

Seed Oil yield=Seed yield per plant (gr.)*Oil % in seed.

Formula XXX: shoot/root Ratio=total weight of the vegetative portion above ground at harvest/total weight of the root at harvest.

Formula XXXI: Spikelets Index=Average Spikelets weight per plant/(Average vegetative dry weight per plant plus Average Spikelets weight per plant).

Formula XXXII: % Canopy coverage=(1−(PAR_DOWN/PAR_UP))×100 measured using AccuPAR Ceptometer Model LP-80.

Formula XXXIII: leaf mass fraction=Leaf area/shoot FW.

Formula XXXIV: Relative growth rate based on dry weight=Regression coefficient of dry weight along time course.

Formula XXXV: Dry matter partitioning (ratio)—At the end of the growing period 6 plants heads as well as the rest of the plot heads were collected, threshed and grains were weighted to obtain grains yield per plot. Dry matter partitioning was calculated by dividing grains yield per plot to vegetative dry weight per plot.

Formula XXXVI: 1000 grain weight filling rate (gr/day)—The rate of grain filling was calculated by dividing 1000 grain weight by grain fill duration.

Formula XXXVII: Specific leaf area ($cm^2$/gr)—Leaves were scanned to obtain leaf area per plant, and then were dried in an oven to obtain the leaves dry weight. Specific leaf area was calculated by dividing the leaf area by leaf dry weight.

Formula XXXVIII: Vegetative dry weight per plant at flowering/water until flowering (gr/lit)—Calculated by dividing vegetative dry weight (excluding roots and reproductive organs) per plant at flowering by the water used for irrigation up to flowering Formula XXXIX: Yield filling rate (gr/day)—The rate of grain filling was calculated by dividing grains Yield by grain fill duration.

Formula XXXX: Yield per dunam/water until tan (kg/lit)—Calculated by dividing Grains yield per dunam by water used for irrigation until tan.

Formula XXXXI: Yield per plant/water until tan (gr/lit)—Calculated by dividing Grains yield per plant by water used for irrigation until tan Formula XXXXII: Yield per dunam/water until maturity (gr/lit)—Calculated by dividing grains yield per dunam by the water used for irrigation up to maturity. "Lit"=Liter.

Formula XXXXIII: Vegetative dry weight per plant/water until maturity (gr/lit): Calculated by dividing vegetative dry weight per plant (excluding roots and reproductive organs) at harvest by the water used for irrigation up to maturity.

Formula XXXXIV: Total dry matter per plant/water until maturity (gr/lit): Calculated by dividing total dry matter at harvest (vegetative and reproductive, excluding roots) per plant by the water used for irrigation up to maturity.

Formula XXXXV: Total dry matter per plant/water until flowering (gr/lit): Calculated by dividing total dry matter at flowering (vegetative and reproductive, excluding roots) per plant by the water used for irrigation up to flowering.

Formula XXXXVI: Heads index (ratio): Average heads weight/(Average vegetative dry weight per plant plus Average heads weight per plant).

Formula XXXXVII: Yield/SPAD (kg/SPAD units)—Calculated by dividing grains yield by average SPAD measurements per plot.

Formula XXXXVIII: Stem water content (percentage)—stems were collected and fresh weight (FW) was weighted. Then the stems were oven dry and dry weight (DW) was recorded. Stems dry weight was divided by stems fresh weight, subtracted from 1 and multiplied by 100.

Formula XXXXIX: Leaf water content (percentage)—Leaves were collected and fresh weight (FW) was weighted. Then the leaves were oven dry and dry weight (DW) was recorded. Leaves dry weight was divided by leaves fresh weight, subtracted from 1 and multiplied by 100.

Formula L: stem volume ($cm^3$)—The average stem volume was calculated by multiplying the average stem length by $(3.14*((\text{mean lower and upper stem width})/2)^2)$.

Formula LI: NUE—is the ratio between total grain yield per total nitrogen (applied+content) in soil.

Formula LII: NUpE—Is the ratio between total plant N content per total N (applied+content) in soil.

Formula LIII: Total NUtE—Is the ratio between total dry matter per N content of total dry matter.

Formula LIV: Stem density—is the ratio between internode dry weight and internode volume.

Formula LV: Grain NUtE—Is the ratio between grain yield per N content of total dry matter Formula LVI: N harvest index (Ratio)—Is the ratio between nitrogen content in grain per plant and the nitrogen of whole plant at harvest.

Formula LVII: Biomass production efficiency—is the ratio between plant biomass and total shoot N.

Formula LVIII: Harvest index (plot) (ratio)—Average seed yield per plot/Average dry weight per plot.

Formula LIX: Relative growth rate of petiole relative area—Regression coefficient of petiole relative area along time course (measured in $cm^2$ per day).

Formula LX: Yield per spike filling rate (gr/day)—spike filling rate was calculated by dividing grains yield per spike to grain fill duration.

Formula LXI: Yield per micro plots filling rate (gr/day)—micro plots filling rate was calculated by dividing grains yield per micro plots to grain fill duration.

Formula LXII: Grains yield per hectare [ton/ha]—all spikes per plot were harvested threshed and grains were weighted after sun dry. The resulting value was divided by the number of square meters and multiplied by 10,000 (10,000 square meters=1 hectare).

Formula LXIII: Total dry matter (for Maize)=Normalized ear weight per plant+vegetative dry weight.

$$\text{Agronomical } NUE = \frac{\text{Yield per plant (Kg.)}^{X\ Nitrogen\ Fertilization} - \text{Yield per plant (Kg.)}^{0\%\ Nitrogen\ Fertilization}}{Fertilizer^X} \quad \text{Formula LXIV}$$

Formula LXV: Harvest Index (*brachypodium*)=Average grain weight/average dry (vegetative+spikelet) weight per plant.

Formula LXVI: Harvest Index for *Sorghum** (* when the plants were not dried)=FW (fresh weight) Heads/(FW Heads+FW Plants)

Grain protein concentration—Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material.

Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each micro-array expression information tissue type has received an expression Set ID.

Correlation analysis—was performed for selected genes according to some embodiments of the invention, in which the characterized parameters (measured parameters according to the correlation IDs) were used as "X axis" for correlation with the tissue transcriptome, which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) and the phenotypic characteristic (e g, improved yield, growth rate, nitrogen use efficiency, abiotic stress tolerance and the like).

Example 1

Identifying Genes which Improve Yield and Agronomical Important Traits in Plants The present inventors have identified polynucleotides which expression thereof in plants can increase yield, fiber yield, fiber quality, growth rate, vigor, biomass, growth rate, oil content, abiotic stress tolerance (ABST), fertilizer use efficiency (FUE) such as nitrogen use efficiency (NUE), and water use efficiency (WUE) of a plant, as follows.

All nucleotide sequence datasets used here were originated from publicly available databases or from performing sequencing using the Solexa technology (e.g. Barley and Sorghum). Sequence data from 100 different plant species was introduced into a single, comprehensive database. Other information on gene expression, protein annotation, enzymes and pathways were also incorporated.

Major databases used include:

Genomes

Arabidopsis genome [TAIR genome version 6 (arabidopsis (dot) org/)];

Rice genome [IRGSP build 4.0 (rgp (dot) dna (dot) affrc (dot) go (dot) jp/IRGSP/)];

Poplar [*Populus trichocarpa* release 1.1 from JGI (assembly release v1.0) (genome (dot) jgi-psf (dot) org/)];

Brachypodium [JGI 4× assembly, brachpodium (dot) org)];

Soybean [DOE-JGI SCP, version GlymaO (phytozome (dot) net/)];

Grape [French-Italian Public Consortium for Grapevine Genome Characterization grapevine genome (genoscope (dot) cns (dot) fr/)];

Castobean [TIGR/J Craig Venter Institute 4× assembly [msc (dot) jcvi (dot) org/r communis];

Sorghum [DOE-JGI SCP, version Sbi1 [phytozome (dot) net/)];

Partially assembled genome of Maize [maizesequence (dot) org/];

Expressed EST and mRNA sequences were extracted from the following databases:

GenBank ncbi (dot) nlm (dot) nih (dot) gov/dbEST;
RefSeq (ncbi (dot) nlm (dot) nih (dot) gov/RefSeq/);
TAIR (arabidopsis (dot) org/);
Protein and Pathway Databases
Uniprot [uniprot (dot) org/];
AraCyc [arabidopsis (dot) org/biocyc/index (dot) jsp];
ENZYME [expasy (dot) org/enzyme/];
Microarray Datasets were Downloaded from:
GEO (ncbi(dot)nlm(dot)nih(dot)gov/geo/);
TAIR (arabidopsis(dot)org/);
Proprietary microarray data (WO2008/122980);
QTL and SNPs Information
Gramene [gramene (dot) org/qtl/];
Panzea [panzea (dot) org/index (dot) html];

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (arabidopsis, rice, castorbean, grape, brachypodium, poplar, soybean, sorghum) the genomic LEADS version (GANG) was employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [blast (dot) ncbi (dot) nlm (dot) nih (dot) gov/Blast (dot) cgi] against all plant UniProt [uniprot (dot) org/] sequences was performed. Open reading frames of each putative transcript were analyzed and longest ORF with higher number of homologues was selected as predicted protein of the transcript. The predicted proteins were analyzed by InterPro [ebi (dot) ac (dot) uk/interpro/].

Blast against proteins from AraCyc and ENZYME databases was used to map the predicted transcripts to AraCyc pathways.

Predicted proteins from different species were compared using blast algorithm [ncbi (dot) nlm (dot) nih (dot) gov/ Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant &

Animal Genomes XVII Conference, San Diego, Calif. Transcriptomeic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [icugi (dot) org/] confirmed the accuracy of the sequencing and assembly. Expression patterns of selected genes fitted well their qRT-PCR data.

The genes listed in Table 1 below were identified to have a major impact on plant yield, fiber yield, fiber quality, growth rate, photosynthetic capacity, vigor, biomass, growth rate, oil content, abiotic stress tolerance, nitrogen use efficiency, water use efficiency and/or fertilizer use efficiency when expression thereof is increased in plants. The identified genes, their curated polynucleotide and polypeptide sequences, their updated sequences according to Genbank database and the sequences of the cloned genes and proteins are summarized in Table 1, hereinbelow.

TABLE 1

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LGP1 | arabidopsis\|10v1\|AT1G32060 | 4 | 713 |
| LGP3 | arabidopsis\|10v1\|AT1G63680 | 5 | 714 |
| LGP6 | arabidopsis\|10v1\|AT2G25080 | 6 | 715 |
| LGP8 | arabidopsis\|10v1\|AT3G13720 | 7 | 716 |
| LGP9 | arabidopsis\|10v1\|AT3G17810 | 8 | 717 |
| LGP10 | arabidopsis\|10v1\|AT3G20330 | 9 | 718 |
| LGP12 | arabidopsis\|10v1\|AT3G54660 | 10 | 719 |
| LGP18 | arabidopsis\|10v1\|AT5G57030 | 11 | 720 |
| LGP19 | b_juncea\|10v2\|E6ANDIZ01AHMLF | 12 | 721 |
| LGP20 | barley\|10v2\|AV833857 | 13 | 722 |
| LGP21 | barley\|10v2\|BG367409 | 14 | 723 |
| LGP22 | barley\|10v2\|BI960336 | 15 | 724 |
| LGP24 | lettuce\|10v1\|AF321538 | 16 | 725 |
| LGP25 | maize\|10v1\|AI622096 | 17 | 726 |
| LGP27 | maize\|10v1\|BG360609 | 18 | 727 |
| LGP32 | tomato\|11v1\|AF030292 | 19 | 728 |
| LGP34 | tomato\|11v1\|BG131753 | 20 | 729 |
| LGP35 | tomato\|11v1\|R27545 | 21 | 730 |
| LGP38 | arabidopsis\|10v1\|AT2G15400 | 22 | 731 |
| LGP39 | arabidopsis\|10v1\|AT2G15430 | 23 | 732 |
| LGP41 | sunflower\|12v1\|CD855665 | 24 | 733 |
| LGP42 | tomato\|11v1\|BG128831 | 25 | 734 |
| LGP43 | canola\|11v1\|EG019929 | 26 | 735 |
| LGP44 | arabidopsis\|10v1\|AT5G37310 | 27 | 736 |
| LGP45 | b_juncea\|10v2\|E6ANDIZ01A3IC5 | 28 | 737 |
| LGP46 | arabidopsis\|10v1\|AT5G58140 | 29 | 738 |
| LGP47 | cotton\|11v1\|CO074926XX1 | 30 | 739 |
| LGP48 | canola\|11v1\|EG020435 | 31 | 740 |
| LGP49 | canola\|11v1\|EE457807 | 32 | 741 |
| LGP52 | sorghum\|12v1\|SB05G024560 | 33 | 742 |
| LGP53 | arabidopsis\|10v1\|AT5G45620 | 34 | 743 |
| LGP54 | canola\|11v1\|AY518886 | 35 | 744 |
| LGP58 | cotton\|11v1\|BQ405024 | 36 | 745 |
| LGP59 | arabidopsis\|10v1\|AT3G06430 | 37 | 746 |
| LGP60 | pigeonpea\|11v1\|SRR054580X101438 | 38 | 747 |
| LGP61 | sesame\|12v1\|SESI12V1412795 | 39 | 748 |
| LGP62 | cephalotaxus\|11v1\|SRR064395X102206 | 40 | 749 |
| LGP63 | rice\|11v1\|BI305215 | 41 | 750 |
| LGP64 | flaveria\|11v1\|SRR149229.109105 | 42 | 751 |
| LGP65 | cotton\|11v1\|CO084001 | 43 | 752 |
| LGP66 | physcomitrella\|\|10v1\|BJ172182 | 44 | 753 |
| LGP67 | canola\|11v1\|DW997362 | 45 | 754 |
| LGP68 | rice\|11v1\|AB042521 | 46 | 755 |
| LGP69 | canola\|11v1\|EV020542 | 47 | 756 |
| LGP71 | bean\|12v1\|CA896692 | 48 | 757 |
| LGP72 | maize\|10v1\|AI967029 | 49 | 758 |
| LGP73 | maize\|10v1\|AW054577 | 50 | 759 |
| LGP74 | maize\|10v1\|BM075120 | 51 | 760 |
| LGP75 | maize\|10v1\|ZMU12233 | 52 | 761 |
| LGP76 | rice\|11v1\|AU056832 | 53 | 762 |
| LGP77 | rice\|11v1\|BE040832 | 54 | 763 |
| LGP78 | soybean\|11v1\|GLYMA04G40990 | 55 | 764 |
| LGP79 | soybean\|11v1\|GLYMA18G17600 | 56 | 765 |
| LGP80 | maize\|10v1\|BM500498 | 57 | 766 |
| LGP81 | soybean\|11v1\|GLYMA09G02440 | 58 | 767 |
| LGP82 | maize\|10v1\|AI964481 | 59 | 768 |
| LGP83 | barley\|12v1\|BE412944 | 60 | 769 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LGP84 | bean\|12v2\|CA900203 | 61 | 770 |
| LGP85 | bean\|12v2\|FE697169 | 62 | 771 |
| LGP86 | maize\|10v1\|AA979831 | 63 | 772 |
| LGP87 | maize\|10v1\|AI461460 | 64 | 773 |
| LGP88 | maize\|10v1\|AI612489 | 65 | 774 |
| LGP89 | maize\|10v1\|AI783343 | 66 | 775 |
| LGP90 | maize\|10v1\|AI855400 | 67 | 776 |
| LGP91 | maize\|10v1\|AI943931 | 68 | 777 |
| LGP92 | maize\|10v1\|AW018130 | 69 | 778 |
| LGP93 | maize\|10v1\|AW400247 | 70 | 779 |
| LGP94 | maize\|10v1\|BE186218 | 71 | 780 |
| LGP95 | maize\|10v1\|BE511836 | 72 | 781 |
| LGP96 | *medicago*\|12v1\|AI083076 | 73 | 782 |
| LGP97 | *medicago*\|12v1\|AW687978 | 74 | 783 |
| LGP98 | *medicago*\|12v1\|BE249345 | 75 | 784 |
| LGP99 | rice\|11v1\|AI978381 | 76 | 785 |
| LGP100 | rice\|11v1\|AU100980 | 77 | 786 |
| LGP101 | rice\|11v1\|BM038323 | 78 | 787 |
| LGP102 | *sorghum*\|12v1\|SB01G004630 | 79 | 788 |
| LGP103 | *sorghum*\|12v1\|SB04G021670 | 80 | 789 |
| LGP104 | soybean\|11v1\|GLYMA05G04590 | 81 | 790 |
| LGP105 | soybean\|12v1\|GLYMA11G31810 | 82 | 791 |
| LGP106 | soybean\|13v2\|BU577083 | 83 | 792 |
| LGP107 | tomato\|11v1\|AW221249 | 84 | 793 |
| LGP108 | wheat\|12v3\|AL826289 | 85 | 794 |
| LGP109 | soybean\|13v2\|GLYMA16G02770T2 | 86 | 795 |
| LYD237 | *arabidopsis*\|10v1\|AT5G42190 | 88 | 797 |
| MGP14 | *arabidopsis*\|10v1\|AT5G42190 | 88 | 797 |
| LYD694 | b_juncea\|12v1\|E6ANDIZ01A6E3M | 100 | 809 |
| LYD695 | b_juncea\|12v1\|E6ANDIZ01A8U9K | 101 | 810 |
| LYD696 | b_juncea\|12v1\|E6ANDIZ01DJK4B | 102 | 811 |
| LYD698 | b_rapa\|11v\|CD812301 | 103 | 812 |
| LYD699 | b_rapa\|11v\|CD815849 | 104 | 813 |
| LYD700 | b_rapa\|11v\|CD829408 | 105 | 814 |
| LYD701 | bean\|12v1\|CA913107 | 106 | 815 |
| LYD702 | bean\|12v2\|AB020052 | 107 | 816 |
| LYD703 | bean\|12v2\|CA896596 | 108 | 817 |
| LYD704 | bean\|12v2\|CA896633 | 109 | 818 |
| LYD705 | bean\|12v2\|CA896897 | 110 | 819 |
| LYD706 | bean\|12v2\|CA896947 | 111 | 820 |
| LYD707 | bean\|12v2\|CA897026 | 112 | 821 |
| LYD708 | bean\|12v2\|CA897554 | 113 | 822 |
| LYD710 | bean\|12v2\|CA898557 | 114 | 823 |
| LYD711 | bean\|12v2\|CA898580 | 115 | 824 |
| LYD713 | bean\|12v2\|CA898845 | 116 | 825 |
| LYD714 | bean\|12v2\|CA898855 | 117 | 826 |
| LYD715 | bean\|12v2\|CA899048 | 118 | 827 |
| LYD717 | bean\|12v2\|CA899256 | 119 | 828 |
| LYD718 | bean\|12v2\|CA899264 | 120 | 829 |
| LYD719 | bean\|12v2\|CA899770 | 121 | 830 |
| LYD720 | bean\|12v2\|CA899773 | 122 | 831 |
| LYD721 | bean\|12v2\|CA900278 | 123 | 832 |
| LYD722 | bean\|12v2\|CA900376 | 124 | 833 |
| LYD723 | bean\|12v2\|CA900579 | 125 | 834 |
| LYD725 | bean\|12v2\|CA900816 | 126 | 835 |
| LYD726 | bean\|12v2\|CA901228 | 127 | 836 |
| LYD727 | bean\|12v2\|CA902441 | 128 | 837 |
| LYD729 | bean\|12v2\|CA902538 | 129 | 838 |
| LYD730 | bean\|12v2\|CA905289 | 130 | 839 |
| LYD731 | bean\|12v2\|CA905720 | 131 | 840 |
| LYD733 | bean\|12v2\|CA906136 | 132 | 841 |
| LYD735 | bean\|12v2\|CA906321 | 133 | 842 |
| LYD736 | bean\|12v2\|CA906920 | 134 | 843 |
| LYD737 | bean\|12v2\|CA908547 | 135 | 844 |
| LYD738 | bean\|12v2\|CA909218 | 136 | 845 |
| LYD739 | bean\|12v2\|CA909651 | 137 | 846 |
| LYD740 | bean\|12v2\|CA910570 | 138 | 847 |
| LYD741 | bean\|12v2\|CA910581 | 139 | 848 |
| LYD742 | bean\|12v2\|CA910778 | 140 | 849 |
| LYD744 | bean\|12v2\|CA911083 | 141 | 850 |
| LYD745 | bean\|12v2\|CA911177 | 142 | 851 |
| LYD746 | bean\|12v2\|CA911180 | 143 | 852 |
| LYD747 | bean\|12v2\|CA911414 | 144 | 853 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LYD748 | bean\|12v2\|CA911651 | 145 | 854 |
| LYD749 | bean\|12v2\|CA911692 | 146 | 855 |
| LYD750 | bean\|12v2\|CA911987 | 147 | 856 |
| LYD751 | bean\|12v2\|CA911994 | 148 | 857 |
| LYD752 | bean\|12v2\|CA912567 | 149 | 858 |
| LYD753 | bean\|12v2\|CA912688 | 150 | 859 |
| LYD754 | bean\|12v2\|CA912714 | 151 | 860 |
| LYD755 | bean\|12v2\|CA913041 | 152 | 861 |
| LYD756 | bean\|12v2\|CA913114 | 153 | 862 |
| LYD757 | bean\|12v2\|CA913188 | 154 | 863 |
| LYD758 | bean\|12v2\|CA913400 | 155 | 864 |
| LYD760 | bean\|12v2\|CA913671 | 156 | 865 |
| LYD761 | bean\|12v2\|CA913893 | 157 | 866 |
| LYD762 | bean\|12v2\|CA915895 | 158 | 867 |
| LYD763 | bean\|12v2\|CA915968 | 159 | 868 |
| LYD764 | bean\|12v2\|CA916036 | 160 | 869 |
| LYD765 | bean\|12v2\|CA916308 | 161 | 870 |
| LYD767 | bean\|12v2\|CA916492 | 162 | 871 |
| LYD768 | bean\|12v2\|CA916620 | 163 | 872 |
| LYD769 | bean\|12v2\|CB280523 | 164 | 873 |
| LYD771 | bean\|12v2\|CB539357 | 165 | 874 |
| LYD772 | bean\|12v2\|CB539439 | 166 | 875 |
| LYD773 | bean\|12v2\|CB539539 | 167 | 876 |
| LYD774 | bean\|12v2\|CB539605 | 168 | 877 |
| LYD776 | bean\|12v2\|CB540092 | 169 | 878 |
| LYD777 | bean\|12v2\|CB540540 | 170 | 879 |
| LYD778 | bean\|12v2\|CB540751 | 171 | 880 |
| LYD779 | bean\|12v2\|CB540835 | 172 | 881 |
| LYD780 | bean\|12v2\|CB540856 | 173 | 882 |
| LYD781 | bean\|12v2\|CB541126 | 174 | 883 |
| LYD782 | bean\|12v2\|CB541134 | 175 | 884 |
| LYD783 | bean\|12v2\|CB541623 | 176 | 885 |
| LYD784 | bean\|12v2\|CB542381 | 177 | 886 |
| LYD785 | bean\|12v2\|CB542514 | 178 | 887 |
| LYD786 | bean\|12v2\|CB543395 | 179 | 888 |
| LYD788 | bean\|12v2\|EG562919 | 180 | 889 |
| LYD789 | bean\|12v2\|EX303656 | 181 | 890 |
| LYD790 | bean\|12v2\|EX304540 | 182 | 891 |
| LYD791 | bean\|12v2\|EX304854 | 183 | 892 |
| LYD792 | bean\|12v2\|EX304918 | 184 | 893 |
| LYD793 | bean\|12v2\|EX305451 | 185 | 894 |
| LYD794 | bean\|12v2\|FE677973 | 186 | 895 |
| LYD795 | bean\|12v2\|FE683224 | 187 | 896 |
| LYD796 | bean\|12v2\|FE684083 | 188 | 897 |
| LYD797 | bean\|12v2\|FE686354 | 189 | 898 |
| LYD798 | bean\|12v2\|FE696773 | 190 | 899 |
| LYD799 | bean\|12v2\|FE707538 | 191 | 900 |
| LYD800 | bean\|12v2\|FE708889 | 192 | 901 |
| LYD801 | bean\|12v2\|FE897943 | 193 | 902 |
| LYD802 | bean\|12v2\|FE898020 | 194 | 903 |
| LYD803 | bean\|12v2\|FE898128 | 195 | 904 |
| LYD804 | bean\|12v2\|FE898192 | 196 | 905 |
| LYD806 | bean\|12v2\|FE898946 | 197 | 906 |
| LYD807 | bean\|12v2\|FE898965 | 198 | 907 |
| LYD809 | bean\|12v2\|FE899199 | 199 | 908 |
| LYD810 | bean\|12v2\|FE899532 | 200 | 909 |
| LYD811 | bean\|12v2\|FE899588 | 201 | 910 |
| LYD812 | bean\|12v2\|FG228526 | 202 | 911 |
| LYD813 | bean\|12v2\|FG228626 | 203 | 912 |
| LYD814 | bean\|12v2\|FG230712 | 204 | 913 |
| LYD815 | bean\|12v2\|FG231267 | 205 | 914 |
| LYD816 | bean\|12v2\|FG231286 | 206 | 915 |
| LYD817 | bean\|12v2\|HO778627 | 207 | 916 |
| LYD818 | bean\|12v2\|HO781301 | 208 | 917 |
| LYD819 | bean\|12v2\|HO783841 | 209 | 918 |
| LYD821 | bean\|12v2\|HO790120 | 210 | 919 |
| LYD822 | bean\|12v2\|HO792571 | 211 | 920 |
| LYD823 | bean\|12v2\|HO793451 | 212 | 921 |
| LYD824 | bean\|12v2\|HO799789 | 213 | 922 |
| LYD825 | bean\|12v2\|HO806735 | 214 | 923 |
| LYD826 | bean\|12v2\|HO807062 | 215 | 924 |
| LYD827 | bean\|12v2\|PVJGI_V1_2012PHVUL_011G043200_1_PACID_27151804 | 216 | 925 |
| LYD828 | bean\|13v1\|CA914375 | 217 | 926 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LYD829 | bean\|13v1\|CB544235 | 218 | 927 |
| LYD830 | bean\|13v1\|FE690778 | 219 | 928 |
| LYD831 | canola\|11v1\|CN730435 | 220 | 929 |
| LYD833 | canola\|11v1\|EE424371 | 221 | 930 |
| LYD834 | canola\|11v1\|EE482584 | 222 | 931 |
| LYD835 | cotton\|11v1\|AI055088 | 223 | 932 |
| LYD836 | cotton\|11v1\|AI729950 | 224 | 933 |
| LYD837 | cotton\|11v1\|AY779339XX1 | 225 | 934 |
| LYD838 | cotton\|11v1\|BE052016XX1 | 226 | 935 |
| LYD839 | cotton\|11v1\|BE055237 | 227 | 936 |
| LYD840 | cotton\|11v1\|BG444757 | 228 | 937 |
| LYD841 | cotton\|11v1\|BM359931 | 229 | 938 |
| LYD842 | cotton\|11v1\|CB350435XX2 | 230 | 939 |
| LYD843 | cotton\|11v1\|CD485677 | 231 | 940 |
| LYD844 | cotton\|11v1\|CO075283 | 232 | 941 |
| LYD845 | cotton\|11v1\|CO085527XX2 | 233 | 942 |
| LYD846 | cotton\|11v1\|CO089064 | 234 | 943 |
| LYD847 | cotton\|11v1\|CO112877XX1 | 235 | 944 |
| LYD848 | cotton\|11v1\|CO121493XX1 | 236 | 945 |
| LYD849 | cotton\|11v1\|CO493081 | 237 | 946 |
| LYD850 | cotton\|11v1\|DW500116 | 238 | 947 |
| LYD851 | medicago\|\|12v1\|AL386155 | 239 | 948 |
| LYD852 | medicago\|\|12v1\|AW256362 | 240 | 949 |
| LYD853 | medicago\|\|12v1\|AW683324 | 241 | 950 |
| LYD854 | medicago\|\|12v1\|AW696146 | 242 | 951 |
| LYD855 | medicago\|\|12v1\|BE316923 | 243 | 952 |
| LYD856 | medicago\|\|12v1\|BF643539 | 244 | 953 |
| LYD857 | medicago\|\|12v1\|BF644247 | 245 | 954 |
| LYD858 | rice\|11v1\|AA754378 | 246 | 955 |
| LYD859 | rice\|13v2\|BE228731 | 247 | 956 |
| LYD860 | soybean\|11v1\|GLYMA13G44040 | 248 | 957 |
| LYD861 | soybean\|11v1\|GLYMA15G01270 | 249 | 958 |
| LYD863 | soybean\|12v1\|GLYMA01G38410 | 250 | 959 |
| LYD864 | soybean\|12v1\|GLYMA05G25960 | 251 | 960 |
| LYD865 | soybean\|12v1\|GLYMA06G46850 | 252 | 961 |
| LYD866 | soybean\|12v1\|GLYMA08G11220 | 253 | 962 |
| LYD867 | soybean\|12v1\|GLYMA10G07340 | 254 | 963 |
| LYD868 | soybean\|12v1\|GLYMA10G36220 | 255 | 964 |
| LYD869 | soybean\|12v1\|GLYMA10G36230 | 256 | 965 |
| LYD870 | soybean\|12v1\|GLYMA11G26980 | 257 | 966 |
| LYD871 | soybean\|12v1\|GLYMA11G37390T2 | 258 | 967 |
| LYD872 | soybean\|12v1\|GLYMA12G36480 | 259 | 968 |
| LYD873 | soybean\|12v1\|GLYMA14G09990 | 260 | 969 |
| LYD874 | soybean\|12v1\|GLYMA14G37920 | 261 | 970 |
| LYD876 | soybean\|12v1\|GLYMA17G07450 | 262 | 971 |
| LYD877 | soybean\|12v1\|GLYMA17G12750T4 | 263 | 972 |
| LYD878 | soybean\|12v1\|GLYMA17G13780 | 264 | 973 |
| LYD879 | soybean\|12v1\|GLYMA18G01820 | 265 | 974 |
| LYD880 | soybean\|12v1\|GLYMA18G01830 | 266 | 975 |
| LYD881 | soybean\|12v1\|GLYMA18G48300 | 267 | 976 |
| LYD882 | soybean\|12v1\|GLYMA18G52810 | 268 | 977 |
| LYD883 | soybean\|13v2\|GLYMA01G44970 | 269 | 978 |
| LYD884 | soybean\|13v2\|GLYMA02G40770 | 270 | 979 |
| LYD886 | soybean\|13v2\|GLYMA11G20080 | 271 | 980 |
| LYD887 | soybean\|13v2\|GLYMA12G07990 | 272 | 981 |
| LYD888 | soybean\|13v2\|GLYMA13G21490 | 273 | 982 |
| LYD890 | soybean\|13v2\|GLYMA17G35060 | 274 | 983 |
| LYD891 | soybean\|13v2\|GLYMA19G40580 | 275 | 984 |
| LYD892 | tomato\|11v1\|AF096246 | 276 | 985 |
| LYD893 | tomato\|11v1\|AI486717 | 277 | 986 |
| LYD894 | tomato\|11v1\|AI490031 | 278 | 987 |
| LYD895 | tomato\|11v1\|AI637290 | 279 | 988 |
| LYD896 | tomato\|11v1\|AI771350 | 280 | 989 |
| LYD897 | tomato\|11v1\|AI773083 | 281 | 990 |
| LYD898 | tomato\|11v1\|AI773883 | 282 | 991 |
| LYD899 | tomato\|11v1\|AI896477 | 283 | 992 |
| LYD900 | tomato\|11v1\|AW091881 | 284 | 993 |
| LYD901 | tomato\|11v1\|AW217431 | 285 | 994 |
| LYD902 | tomato\|11v1\|AW399640 | 286 | 995 |
| LYD903 | tomato\|11v1\|AW624231 | 287 | 996 |
| LYD904 | tomato\|11v1\|BG123561 | 288 | 997 |
| LYD905 | tomato\|11v1\|BG123981 | 289 | 998 |
| LYD906 | tomato\|11v1\|BG125291 | 290 | 999 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LYD907 | tomato\|11v1\|BG125405 | 291 | 1000 |
| LYD908 | tomato\|11v1\|BG127430 | 292 | 1001 |
| LYD909 | tomato\|11v1\|BG128668 | 293 | 1002 |
| LYD910 | tomato\|11v1\|BG129449 | 294 | 1003 |
| LYD911 | tomato\|11v1\|BG131325 | 295 | 1004 |
| LYD912 | tomato\|11v1\|BG132078 | 296 | 1005 |
| LYD913 | tomato\|11v1\|BG132886 | 297 | 1006 |
| LYD914 | tomato\|11v1\|BG628916 | 298 | 1007 |
| LYD915 | tomato\|13v1\|AI483969 | 299 | 1008 |
| LYD917 | tomato\|13v1\|AI774553 | 300 | 1009 |
| LYD918 | tomato\|13v1\|AI776834 | 301 | 1010 |
| LYD919 | tomato\|13v1\|AW160097 | 302 | 1011 |
| LYD920 | tomato\|13v1\|AW616349 | 303 | 1012 |
| LYD921 | tomato\|13v1\|BG128290 | 304 | 1013 |
| LYD922 | tomato\|13v1\|BG133370 | 305 | 1014 |
| LYD923 | tomato\|13v1\|BG627938 | 306 | 1015 |
| LYD924 | tomato\|13v1\|BG735361 | 307 | 1016 |
| LYD925 | tomato\|13v1\|LEACS6 | 308 | 1017 |
| LYD926 | bean\|12v2\|CA899181 | 309 | 1018 |
| LYD929 | bean\|12v2\|CA910968 | 310 | 1019 |
| LYD930 | bean\|12v2\|CB542591 | 311 | 1020 |
| LYD869_H1 | soybean\|13v2\|GLYMA20G31360 | 312 | 1021 |
| MGP1 | cotton\|11v1\|CO100059XX2 | 320 | 1029 |
| MGP2 | *arabidopsis*\|10v1\|AT1G75950 | 321 | 1030 |
| MGP4 | soybean\|12v1\|GLYMA04G37510 | 322 | 1031 |
| MGP5 | *medicago*\|12v1\|AL374833 | 323 | 1032 |
| MGP6 | *brachypodium*\|12v1\|BRADI5G22260 | 324 | 1033 |
| MGP7 | *sorghum*\|12v1\|SB03G041200 | 325 | 1034 |
| MGP9 | switchgrass\|12v1\|FL691989 | 326 | 1035 |
| LGP85 | bean\|12v1\|FE697169 | 327 | 771 |
| LGP91 | maize\|10v1\|AI943901 | 328 | 1036 |
| LGP92 | maize\|10v1\|AW018130 | 329 | 778 |
| LGP93 | maize\|10v1\|AW400247 | 330 | 779 |
| LGP104 | soybean\|11v1\|GLYMA05G04590 | 331 | 1037 |
| LGP108 | wheat\|12v3\|AL826289 | 332 | 794 |
| LYD695 | b_juncea\|12v1\|E6ANDIZ01A8U9K | 333 | 1038 |
| LYD696 | b_juncea\|12v1\|E6ANDIZ01DJK4B | 334 | 1039 |
| LYD699 | b_rapa\|11v1\|CD815849 | 335 | 1040 |
| LYD703 | bean\|12v2\|CA896596 | 336 | 817 |
| LYD706 | bean\|12v2\|CA896947 | 337 | 820 |
| LYD707 | bean\|12v2\|CA897026 | 338 | 821 |
| LYD715 | bean\|12v2\|CA899048 | 339 | 827 |
| LYD717 | bean\|12v2\|CA899256 | 340 | 828 |
| LYD725 | bean\|12v2\|CA900816 | 341 | 1041 |
| LYD736 | bean\|12v2\|CA906920 | 342 | 1042 |
| LYD737 | bean\|12v2\|CA908547 | 343 | 844 |
| LYD741 | bean\|12v2\|CA910581 | 344 | 1043 |
| LYD751 | bean\|12v2\|CA911994 | 345 | 857 |
| LYD756 | bean\|12v2\|CA913114 | 346 | 862 |
| LYD765 | bean\|12v2\|CA916308 | 347 | 870 |
| LYD771 | bean\|12v2\|CB539357 | 348 | 1044 |
| LYD773 | bean\|12v2\|CB539539 | 349 | 1045 |
| LYD782 | bean\|12v2\|CB541134 | 350 | 884 |
| LYD790 | bean\|12v2\|EX304540 | 351 | 891 |
| LYD794 | bean\|12v2\|FE677973 | 352 | 1046 |
| LYD795 | bean\|12v2\|FE683224 | 353 | 896 |
| LYD796 | bean\|12v2\|FE684083 | 354 | 1047 |
| LYD798 | bean\|12v2\|FE696773 | 355 | 899 |
| LYD799 | bean\|12v2\|FE707538 | 356 | 900 |
| LYD800 | bean\|12v2\|FE708889 | 357 | 901 |
| LYD801 | bean\|12v2\|FE897943 | 358 | 902 |
| LYD803 | bean\|12v2\|FE898128 | 359 | 904 |
| LYD804 | bean\|12v2\|FE898192 | 360 | 905 |
| LYD817 | bean\|12v2\|HO778627 | 361 | 916 |
| LYD819 | bean\|12v2\|HO783841 | 362 | 918 |
| LYD822 | bean\|12v2\|HO792571 | 363 | 1048 |
| LYD823 | bean\|12v2\|HO793451 | 364 | 1049 |
| LYD827 | bean\|12v2\|PVJGI_V1_2012PHVUL_011G043200_1_PACID_27151804 | 365 | 925 |
| LYD828 | bean\|13v1\|CA914375 | 366 | 1050 |
| LYD830 | bean\|13v1\|FE690778 | 367 | 1051 |
| LYD834 | canola\|11v1\|EE482584 | 368 | 1052 |
| LYD835 | cotton\|11v1\|AI055088 | 369 | 932 |
| LYD841 | cotton\|11v1\|BM359931 | 370 | 1053 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LYD849 | cotton\|11v1\|CO493081 | 371 | 946 |
| LYD850 | cotton\|11v1\|DW500116 | 372 | 947 |
| LYD853 | medicago\|12v1\|AW683324 | 373 | 950 |
| LYD857 | medicago\|12v1\|BF644247 | 374 | 1054 |
| LYD867 | soybean\|12v1\|GLYMA10G07340 | 375 | 963 |
| LYD868 | soybean\|12v1\|GLYMA10G36220 | 376 | 964 |
| LYD892 | tomato\|11v1\|AF096246 | 377 | 1055 |
| LYD899 | tomato\|11v1\|AI896477 | 378 | 1056 |
| LYD901 | tomato\|11v1\|AW217431 | 379 | 1057 |
| LYD904 | tomato\|11v1\|BG123561 | 380 | 1058 |
| LYD906 | tomato\|11v1\|BG125291 | 381 | 1059 |
| LYD907 | tomato\|11v1\|BG125405 | 382 | 1060 |
| LYD908 | tomato\|11v1\|BG127430 | 383 | 1061 |
| LYD910 | tomato\|11v1\|BG129449 | 384 | 1062 |
| LYD914 | tomato\|11v1\|BG628916 | 385 | 1063 |
| LYD915 | tomato\|11v1\|TOBBCSO | 386 | 1008 |
| LYD918 | tomato\|13v1\|AI776834 | 387 | 1010 |
| LYD921 | tomato\|13v1\|BG128290 | 388 | 1013 |
| LYD925 | tomato\|13v1\|LEACS6 | 389 | 1064 |
| MGP7 | sorghum\|12v1\|SB03G041200 | 391 | 1034 |
| LGP1 | arabidopsis\|10v1\|AT1G32060 | 395 | 713 |
| LGP3 | arabidopsis\|10v1\|AT1G63680 | 396 | 714 |
| LGP6 | arabidopsis\|10v1\|AT2G25080 | 397 | 715 |
| LGP8 | arabidopsis\|10v1\|AT3G13720 | 398 | 716 |
| LGP9 | arabidopsis\|10v1\|AT3G17810 | 399 | 717 |
| LGP10 | arabidopsis\|10v1\|AT3G20330 | 400 | 718 |
| LGP12 | arabidopsis\|10v1\|AT3G54660 | 401 | 719 |
| LGP18 | arabidopsis\|10v1\|AT5G57030 | 402 | 720 |
| LGP19 | b_juncea\|10v2\|E6ANDIZ01AHMLF | 403 | 1067 |
| LGP20 | barley\|10v2\|AV833857 | 404 | 1068 |
| LGP21 | barley\|10v2\|BG367409 | 405 | 723 |
| LGP22 | barley\|10v2\|BI960336 | 406 | 724 |
| LGP24 | lettuce\|10v1\|AF321538 | 407 | 725 |
| LGP25 | maize\|10v1\|AI622096 | 408 | 1069 |
| LGP27 | maize\|10v1\|BG360609 | 409 | 1070 |
| LGP32 | tomato\|11v1\|AF030292 | 410 | 728 |
| LGP34 | tomato\|11v1\|BG131753 | 411 | 729 |
| LGP35 | tomato\|11v1\|R27545 | 412 | 1071 |
| LGP38 | arabidopsis\|10v1\|AT2G15400 | 413 | 731 |
| LGP39 | arabidopsis\|10v1\|AT2G15430 | 414 | 732 |
| LGP41 | sunflower\|12v1\|CD855665 | 415 | 733 |
| LGP42 | tomato\|11v1\|BG128831 | 416 | 1072 |
| LGP43 | canola\|11v1\|EG019929 | 417 | 735 |
| LGP44 | arabidopsis\|10v1\|AT5G37310 | 418 | 736 |
| LGP45 | b_juncea\|10v2\|E6ANDIZ01A3IC5 | 419 | 737 |
| LGP46 | arabidopsis\|10v1\|AT5G58140 | 420 | 738 |
| LGP47 | cotton\|11v1\|CO074926XX1 | 421 | 1073 |
| LGP48 | canola\|11v1\|EG020435 | 422 | 1074 |
| LGP49 | canola\|11v1\|EE457807 | 423 | 741 |
| LGP52 | sorghum\|12v1\|SB05G024560 | 424 | 742 |
| LGP53 | arabidopsis\|10v1\|AT5G45620 | 425 | 743 |
| LGP54 | canola\|11v1\|AY518886 | 426 | 744 |
| LGP58 | cotton\|11v1\|BQ405024 | 427 | 1075 |
| LGP59 | arabidopsis\|10v1\|AT3G06430 | 428 | 746 |
| LGP60 | pigeonpea\|11v1\|SRR054580X101438 | 429 | 747 |
| LGP61 | sesame\|12v1\|SESI12V1412795 | 430 | 748 |
| LGP62 | cephalotaxus\|11v1\|SRR064395X102206 | 431 | 749 |
| LGP63 | rice\|11v1\|BI305215 | 432 | 750 |
| LGP64 | flaveria\|11v1\|SRR149229.109105 | 433 | 751 |
| LGP65 | cotton\|11v1\|CO084001 | 434 | 752 |
| LGP66 | physcomitrella\|10v1\|BJ172182 | 435 | 1076 |
| LGP67 | canola\|11v1\|DW997362 | 436 | 1077 |
| LGP68 | rice\|11v1\|AB042521 | 437 | 755 |
| LGP69 | canola\|11v1\|EV020542 | 438 | 1078 |
| LGP71 | bean\|12v1\|CA896692 | 439 | 757 |
| LGP72 | maize\|10v1\|AI967029 | 440 | 1079 |
| LGP73 | maize\|10v1\|AW054577 | 441 | 759 |
| LGP74 | maize\|10v1\|BM075120 | 442 | 760 |
| LGP75 | maize\|10v1\|ZMU12233 | 443 | 761 |
| LGP76 | rice\|11v1\|AU056832 | 444 | 762 |
| LGP77 | rice\|11v1\|BE040832 | 445 | 763 |
| LGP78 | soybean\|11v1\|GLYMA04G40990 | 446 | 764 |
| LGP79 | soybean\|11v1\|GLYMA18G17600 | 447 | 1080 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
| --- | --- | --- | --- |
| LGP80 | maize\|10v1\|BM500498 | 448 | 1081 |
| LGP81 | soybean\|11v1\|GLYMA09G02440 | 449 | 767 |
| LGP82 | maize\|10v1\|AI964481 | 450 | 768 |
| LGP83 | barley\|12v1\|BE412944 | 451 | 769 |
| LGP84 | bean\|12v2\|CA900203 | 452 | 1082 |
| LGP85 | bean\|12v2\|FE697169 | 453 | 1083 |
| LGP86 | maize\|10v1\|AA979831 | 454 | 772 |
| LGP87 | maize\|10v1\|AI461460 | 455 | 773 |
| LGP88 | maize\|11v1\|AI612489 | 456 | 1084 |
| LGP89 | maize\|10v1\|AI783343 | 457 | 1085 |
| LGP90 | maize\|10v1\|AI855400 | 458 | 1086 |
| LGP91 | maize\|10v1\|AI943931 | 459 | 1087 |
| LGP94 | maize\|10v1\|BE186218 | 460 | 780 |
| LGP95 | maize\|10v1\|BE511836 | 461 | 781 |
| LGP96 | *medicago*\|12v1\|AI083076 | 462 | 1088 |
| LGP97 | *medicago*\|12v1\|AW687978 | 463 | 783 |
| LGP98 | *medicago*\|12v1\|BE249345 | 464 | 784 |
| LGP99 | rice\|11v1\|AI978381 | 465 | 1089 |
| LGP100 | rice\|11v1\|AU100980 | 466 | 786 |
| LGP101 | rice\|11v1\|BM038323 | 467 | 787 |
| LGP102 | *sorghum*\|12v1\|SB01G004630 | 468 | 788 |
| LGP103 | *sorghum*\|12v1\|SB04G021670 | 469 | 1090 |
| LGP104 | soybean\|11v1\|GLYMA05G04590 | 470 | 790 |
| LGP105 | soybean\|12v1\|GLYMA11G31810 | 471 | 791 |
| LGP106 | soybean\|13v2\|BU577083 | 472 | 792 |
| LGP107 | tomato\|11v1\|AW221249 | 473 | 793 |
| LGP108 | wheat\|12v3\|AL826289 | 474 | 1091 |
| LGP109 | soybean\|13v2\|GLYMA16G02770T2 | 475 | 1092 |
| LYD237 | *arabidopsis*\|10v1\|AT5G42190 | 477 | 797 |
| MGP14 | *arabidopsis*\|10v1\|AT5G42190 | 477 | 797 |
| LYD694 | b_juncea\|12v1\|E6ANDIZ01A6E3M | 489 | 809 |
| LYD695 | b_juncea\|12v1\|E6ANDIZ01A8U9K | 490 | 810 |
| LYD696 | b_juncea\|12v1\|E6ANDIZ01DJK4B | 491 | 1094 |
| LYD698 | b_rapa\|11v1\|CD812301 | 492 | 812 |
| LYD699 | b_rapa\|11v1\|CD815849 | 493 | 813 |
| LYD700 | b_rapa\|11v1\|CD829408 | 494 | 814 |
| LYD701 | bean\|12v1\|CA913107 | 495 | 815 |
| LYD702 | bean\|12v2\|AB020052 | 496 | 816 |
| LYD703 | bean\|12v2\|CA896596 | 497 | 817 |
| LYD704 | bean\|12v2\|CA896633 | 498 | 818 |
| LYD705 | bean\|12v2\|CA896897 | 499 | 819 |
| LYD706 | bean\|12v2\|CA896947 | 500 | 1095 |
| LYD707 | bean\|12v2\|CA897026 | 501 | 821 |
| LYD708 | bean\|12v2\|CA897554 | 502 | 822 |
| LYD710 | bean\|12v2\|CA898557 | 503 | 823 |
| LYD711 | bean\|12v2\|CA898580 | 504 | 1096 |
| LYD713 | bean\|12v2\|CA898845 | 505 | 825 |
| LYD714 | bean\|12v2\|CA898855 | 506 | 826 |
| LYD715 | bean\|12v2\|CA899048 | 507 | 827 |
| LYD717 | bean\|12v2\|CA899256 | 508 | 828 |
| LYD718 | bean\|12v2\|CA899264 | 509 | 1097 |
| LYD719 | bean\|12v2\|CA899770 | 510 | 830 |
| LYD720 | bean\|12v2\|CA899773 | 511 | 831 |
| LYD721 | bean\|12v2\|CA900278 | 512 | 1098 |
| LYD722 | bean\|12v2\|CA900376 | 513 | 1099 |
| LYD723 | bean\|12v2\|CA900579 | 514 | 834 |
| LYD725 | bean\|12v2\|CA900816 | 515 | 1100 |
| LYD726 | bean\|12v2\|CA901228 | 516 | 836 |
| LYD727 | bean\|12v2\|CA902441 | 517 | 837 |
| LYD729 | bean\|12v2\|CA902538 | 518 | 838 |
| LYD730 | bean\|12v2\|CA905289 | 519 | 839 |
| LYD731 | bean\|12v2\|CA905720 | 520 | 840 |
| LYD733 | bean\|12v2\|CA906136 | 521 | 841 |
| LYD735 | bean\|12v2\|CA906321 | 522 | 842 |
| LYD737 | bean\|12v2\|CA908547 | 523 | 844 |
| LYD738 | bean\|12v2\|CA909218 | 524 | 1101 |
| LYD739 | bean\|12v2\|CA909651 | 525 | 846 |
| LYD740 | bean\|12v2\|CA910570 | 526 | 847 |
| LYD741 | bean\|12v2\|CA910581 | 527 | 848 |
| LYD742 | bean\|12v2\|CA910778 | 528 | 1102 |
| LYD744 | bean\|12v2\|CA911083 | 529 | 1103 |
| LYD745 | bean\|12v2\|CA911177 | 530 | 851 |
| LYD746 | bean\|12v2\|CA911180 | 531 | 852 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LYD747 | bean\|12v2\|CA911414 | 532 | 853 |
| LYD748 | bean\|12v2\|CA911651 | 533 | 1104 |
| LYD749 | bean\|12v2\|CA911692 | 534 | 855 |
| LYD750 | bean\|12v2\|CA911987 | 535 | 856 |
| LYD751 | bean\|12v2\|CA911994 | 536 | 857 |
| LYD752 | bean\|12v2\|CA912567 | 537 | 858 |
| LYD753 | bean\|12v2\|CA912688 | 538 | 1105 |
| LYD754 | bean\|12v2\|CA912714 | 539 | 860 |
| LYD755 | bean\|12v2\|CA913041 | 540 | 861 |
| LYD756 | bean\|12v2\|CA913114 | 541 | 862 |
| LYD757 | bean\|12v2\|CA913188 | 542 | 863 |
| LYD758 | bean\|12v2\|CA913400 | 543 | 1106 |
| LYD760 | bean\|12v2\|CA913671 | 544 | 1107 |
| LYD761 | bean\|12v2\|CA913893 | 545 | 866 |
| LYD762 | bean\|12v2\|CA915895 | 546 | 867 |
| LYD763 | bean\|12v2\|CA915968 | 547 | 1108 |
| LYD764 | bean\|12v2\|CA916036 | 548 | 1109 |
| LYD765 | bean\|12v2\|CA916308 | 549 | 1110 |
| LYD767 | bean\|12v2\|CA916492 | 550 | 871 |
| LYD768 | bean\|12v2\|CA916620 | 551 | 1111 |
| LYD769 | bean\|12v2\|CB280523 | 552 | 873 |
| LYD771 | bean\|12v2\|CB539357 | 553 | 1112 |
| LYD772 | bean\|12v2\|CB539439 | 554 | 1113 |
| LYD773 | bean\|12v2\|CB539539 | 555 | 876 |
| LYD774 | bean\|12v2\|CB539605 | 556 | 877 |
| LYD776 | bean\|12v2\|CB540092 | 557 | 878 |
| LYD777 | bean\|12v2\|CB540540 | 558 | 879 |
| LYD778 | bean\|12v2\|CB540751 | 559 | 1114 |
| LYD779 | bean\|12v2\|CB540835 | 560 | 1115 |
| LYD780 | bean\|12v2\|CB540856 | 561 | 882 |
| LYD781 | bean\|12v2\|CB541126 | 562 | 1116 |
| LYD782 | bean\|12v2\|CB541134 | 563 | 1117 |
| LYD783 | bean\|12v2\|CB541623 | 564 | 885 |
| LYD784 | bean\|12v2\|CB542381 | 565 | 886 |
| LYD785 | bean\|12v2\|CB542514 | 566 | 887 |
| LYD786 | bean\|12v2\|CB543395 | 567 | 888 |
| LYD788 | bean\|12v2\|EG562919 | 568 | 889 |
| LYD789 | bean\|12v2\|EX303656 | 569 | 890 |
| LYD790 | bean\|12v2\|EX304540 | 570 | 1118 |
| LYD791 | bean\|12v2\|EX304854 | 571 | 892 |
| LYD792 | bean\|12v2\|EX304918 | 572 | 1119 |
| LYD793 | bean\|12v2\|EX305451 | 573 | 1120 |
| LYD794 | bean\|12v2\|FE677973 | 574 | 895 |
| LYD795 | bean\|12v2\|FE683224 | 575 | 896 |
| LYD796 | bean\|12v2\|FE684083 | 576 | 897 |
| LYD798 | bean\|12v2\|FE696773 | 577 | 1121 |
| LYD799 | bean\|12v2\|FE707538 | 578 | 1122 |
| LYD800 | bean\|12v2\|FE708889 | 579 | 901 |
| LYD801 | bean\|12v2\|FE897943 | 580 | 902 |
| LYD802 | bean\|12v2\|FE898020 | 581 | 903 |
| LYD803 | bean\|12v2\|FE898128 | 582 | 904 |
| LYD804 | bean\|12v2\|FE898192 | 583 | 905 |
| LYD806 | bean\|12v2\|FE898946 | 584 | 1123 |
| LYD807 | bean\|12v2\|FE898965 | 585 | 1124 |
| LYD809 | bean\|12v2\|FE899199 | 586 | 908 |
| LYD810 | bean\|12v2\|FE899532 | 587 | 1125 |
| LYD811 | bean\|12v2\|FE899588 | 588 | 1126 |
| LYD812 | bean\|12v2\|FG228526 | 589 | 911 |
| LYD813 | bean\|12v2\|FG228626 | 590 | 1127 |
| LYD814 | bean\|12v2\|FG230712 | 591 | 1128 |
| LYD815 | bean\|12v2\|FG231267 | 592 | 914 |
| LYD816 | bean\|12v2\|FG231286 | 593 | 1129 |
| LYD817 | bean\|12v2\|HO778627 | 594 | 916 |
| LYD818 | bean\|12v2\|HO781301 | 595 | 1130 |
| LYD819 | bean\|12v2\|HO783841 | 596 | 918 |
| LYD821 | bean\|12v2\|HO790120 | 597 | 919 |
| LYD823 | bean\|12v2\|HO793451 | 598 | 921 |
| LYD824 | bean\|12v2\|HO799789 | 599 | 922 |
| LYD825 | bean\|12v2\|HO806735 | 600 | 923 |
| LYD826 | bean\|12v2\|HO807062 | 601 | 924 |
| LYD828 | bean\|13v1\|CA914375 | 602 | 1131 |
| LYD829 | bean\|13v1\|CB544235 | 603 | 1132 |
| LYD830 | bean\|13v1\|FE690778 | 604 | 928 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LYD831 | canola\|11v1\|CN730435 | 605 | 929 |
| LYD833 | canola\|11v1\|EE424371 | 606 | 930 |
| LYD834 | canola\|11v1\|EE482584 | 607 | 1133 |
| LYD835 | cotton\|11v1\|AI055088 | 608 | 932 |
| LYD836 | cotton\|11v1\|AI729950 | 609 | 933 |
| LYD837 | cotton\|11v1\|AY779339XX1 | 610 | 934 |
| LYD838 | cotton\|11v1\|BE052016XX1 | 611 | 935 |
| LYD839 | cotton\|11v1\|BE055237 | 612 | 936 |
| LYD840 | cotton\|11v1\|BG444757 | 613 | 937 |
| LYD841 | cotton\|11v1\|BM359931 | 614 | 1134 |
| LYD842 | cotton\|11v1\|CB350435XX2 | 615 | 939 |
| LYD843 | cotton\|11v1\|CD485677 | 616 | 940 |
| LYD844 | cotton\|11v1\|CO075283 | 617 | 1135 |
| LYD845 | cotton\|11v1\|CO085527XX2 | 618 | 1136 |
| LYD846 | cotton\|11v1\|CO089064 | 619 | 1137 |
| LYD847 | cotton\|11v1\|CO112877XX1 | 620 | 1138 |
| LYD848 | cotton\|11v1\|CO121493XX1 | 621 | 945 |
| LYD849 | cotton\|11v1\|CO493081 | 622 | 1139 |
| LYD850 | cotton\|11v1\|DW500116 | 623 | 1140 |
| LYD851 | medicago\|\|12v1\|AL386155 | 624 | 948 |
| LYD852 | medicago\|\|12v1\|AW256362 | 625 | 1141 |
| LYD853 | medicago\|\|12v1\|AW683324 | 626 | 950 |
| LYD854 | medicago\|\|12v1\|AW696146 | 627 | 951 |
| LYD855 | medicago\|\|12v1\|BE316923 | 628 | 952 |
| LYD856 | medicago\|\|12v1\|BF643539 | 629 | 1142 |
| LYD857 | medicago\|\|12v1\|BF644247 | 630 | 954 |
| LYD858 | rice\|11v1\|AA754378 | 631 | 955 |
| LYD859 | rice\|13v2\|BE228731 | 632 | 956 |
| LYD860 | soybean\|11v1\|GLYMA13G44040 | 633 | 957 |
| LYD861 | soybean\|11v1\|GLYMA15G01270 | 634 | 958 |
| LYD863 | soybean\|12v1\|GLYMA01G38410 | 635 | 959 |
| LYD864 | soybean\|12v1\|GLYMA05G25960 | 636 | 960 |
| LYD865 | soybean\|12v1\|GLYMA06G46850 | 637 | 1143 |
| LYD866 | soybean\|12v1\|GLYMA08G11220 | 638 | 962 |
| LYD867 | soybean\|12v1\|GLYMA10G07340 | 639 | 963 |
| LYD868 | soybean\|12v1\|GLYMA10G36220 | 640 | 1144 |
| LYD870 | soybean\|12v1\|GLYMA11G26980 | 641 | 966 |
| LYD871 | soybean\|12v1\|GLYMA11G37390T2 | 642 | 967 |
| LYD872 | soybean\|12v1\|GLYMA12G36480 | 643 | 968 |
| LYD873 | soybean\|12v1\|GLYMA14G09990 | 644 | 969 |
| LYD874 | soybean\|12v1\|GLYMA14G37920 | 645 | 970 |
| LYD876 | soybean\|12v1\|GLYMA17G07450 | 646 | 971 |
| LYD877 | soybean\|12v1\|GLYMA17G12750T4 | 647 | 972 |
| LYD878 | soybean\|12v1\|GLYMA17G13780 | 648 | 973 |
| LYD879 | soybean\|12v1\|GLYMA18G01820 | 649 | 974 |
| LYD880 | soybean\|12v1\|GLYMA18G01830 | 650 | 975 |
| LYD881 | soybean\|12v1\|GLYMA18G48300 | 651 | 1145 |
| LYD882 | soybean\|12v1\|GLYMA18G52810 | 652 | 977 |
| LYD883 | soybean\|13v2\|GLYMA01G44970 | 653 | 978 |
| LYD884 | soybean\|13v2\|GLYMA02G40770 | 654 | 979 |
| LYD886 | soybean\|13v2\|GLYMA11G20080 | 655 | 980 |
| LYD887 | soybean\|13v2\|GLYMA12G07990 | 656 | 981 |
| LYD888 | soybean\|13v2\|GLYMA13G21490 | 657 | 982 |
| LYD890 | soybean\|13v2\|GLYMA17G35060 | 658 | 983 |
| LYD891 | soybean\|13v2\|GLYMA19G40580 | 659 | 1146 |
| LYD892 | tomato\|11v1\|AF096246 | 660 | 985 |
| LYD893 | tomato\|11v1\|AI486717 | 661 | 986 |
| LYD894 | tomato\|11v1\|AI490031 | 662 | 987 |
| LYD895 | tomato\|11v1\|AI637290 | 663 | 988 |
| LYD896 | tomato\|11v1\|AI771350 | 664 | 989 |
| LYD897 | tomato\|11v1\|AI773083 | 665 | 990 |
| LYD898 | tomato\|11v1\|AI773883 | 666 | 991 |
| LYD899 | tomato\|11v1\|AI896477 | 667 | 1147 |
| LYD900 | tomato\|11v1\|AW091881 | 668 | 1148 |
| LYD901 | tomato\|11v1\|AW217431 | 669 | 994 |
| LYD902 | tomato\|11v1\|AW399640 | 670 | 995 |
| LYD903 | tomato\|11v1\|AW624231 | 671 | 996 |
| LYD904 | tomato\|11v1\|BG123561 | 672 | 1149 |
| LYD905 | tomato\|11v1\|BG123981 | 673 | 998 |
| LYD906 | tomato\|11v1\|BG125291 | 674 | 999 |
| LYD907 | tomato\|11v1\|BG125405 | 675 | 1000 |
| LYD908 | tomato\|11v1\|BG127430 | 676 | 1150 |
| LYD909 | tomato\|11v1\|BG128668 | 677 | 1002 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| LYD910 | tomato\|11v1\|BG129449 | 678 | 1003 |
| LYD911 | tomato\|11v1\|BG131325 | 679 | 1151 |
| LYD912 | tomato\|11v1\|BG132078 | 680 | 1005 |
| LYD913 | tomato\|11v1\|BG132886 | 681 | 1006 |
| LYD914 | tomato\|11v1\|BG628916 | 682 | 1007 |
| LYD915 | tomato\|13v1\|AI483969 | 683 | 1008 |
| LYD917 | tomato\|13v1\|AI774553 | 684 | 1009 |
| LYD918 | tomato\|13v1\|AI776834 | 685 | 1010 |
| LYD919 | tomato\|13v1\|AW160097 | 686 | 1011 |
| LYD920 | tomato\|13v1\|AW616349 | 687 | 1012 |
| LYD921 | tomato\|13v1\|BG128290 | 688 | 1152 |
| LYD922 | tomato\|13v1\|BG133370 | 689 | 1014 |
| LYD923 | tomato\|13v1\|BG627938 | 690 | 1153 |
| LYD924 | tomato\|13v1\|BG735361 | 691 | 1016 |
| LYD925 | tomato\|13v1\|LEACS6 | 692 | 1017 |
| LYD926 | bean\|12v2\|CA899181 | 693 | 1018 |
| LYD929 | bean\|12v2\|CA910968 | 694 | 1019 |
| LYD930 | bean\|12v2\|CB542591 | 695 | 1020 |
| LYD869_H1 | soybean\|13v2\|GLYMA20G31360 | 696 | 1021 |
| MGP1 | cotton\|11v1\|CO100059XX2 | 704 | 1029 |
| MGP2 | arabidopsis\|10v1\|AT1G75950 | 705 | 1030 |
| MGP4 | soybean\|12v1\|GLYMA04G37510 | 706 | 1031 |
| MGP5 | medicago\|12v1\|AL374833 | 707 | 1032 |
| MGP7 | sorghum\|12v1\|SB03G041200 | 708 | 1034 |
| MGP9 | switchgrass\|12v1\|FL691989 | 709 | 1035 |
| | rice\|13v2\|BE041040_P1 | 1157 | 9276 |
| | cacao\|13v1\|CU618772_T1 | 1158 | 9277 |
| | sorghum\|13v2\|CD225902_P1 | 1159 | 9278 |
| | foxtail_millet\|13v2\|SRR350548X111147_P1 | 1160 | 9279 |
| | brachypodium\|13v2\|BRADI2G04690_P1 | 1161 | 9280 |
| | rice\|13v2\|CB621206_P1 | 1162 | 9281 |
| | rice\|13v2\|AU225333_P1 | 1163 | 9282 |
| | maize\|13v2\|BQ703954_P1 | 3502 | 11276 |
| | maize\|13v2\|BE056872_P1 | 3503 | 11277 |
| | chickpea\|13v2\|SRR133522.237740_P1 | 3551 | 11316 |
| | chickpea\|13v2\|SRR133517.100334_P1 | 3552 | 11317 |
| | chickpea\|13v2\|SRR133517.103317_P1 | 3553 | 11318 |
| | rice\|13v2\|BI305582_P1 | 3554 | 11319 |
| | soybean\|12v1\|GLYMA09G33700T2 | 3555 | 11320 |
| | soybean\|13v2\|GLYMA09G33700T2_P1 | 3556 | 11320 |
| | bean\|13v1\|SRR001335X371744_T1 | 3557 | 11321 |
| | bean\|12v2\|FE683652 | 3558 | 11322 |
| | bean\|13v1\|FE683652_P1 | 3559 | 11322 |
| | soybean\|13v2\|GLYMA05G31510_T1 | 3560 | 11323 |
| | medicago\|\|13v1\|AW776098_P1 | 3561 | 11324 |
| | soybean\|12v1\|GLYMA18G19050 | 3562 | 11325 |
| | soybean\|13v2\|GLYMA18G19050_T1 | 3563 | 11325 |
| | bean\|12v2\|CK901542 | 3564 | 11326 |
| | bean\|13v1\|CK901542_T1 | 3565 | 11326 |
| | chickpea\|13v2\|SRR133517.106923_T1 | 3566 | 11327 |
| | peanut\|13v1\|SRR042418X140974_T1 | 3567 | 11328 |
| | medicago\|\|13v1\|BE317701_T1 | 3568 | 11329 |
| | peanut\|13v1\|SRR042415X30056_T1 | 3569 | 11330 |
| | soybean\|13v2\|GLYMA12G01600_P1 | 3570 | 11331 |
| | bean\|13v1\|CB280685_P1 | 3571 | 11332 |
| | peanut\|13v1\|EL966966_P1 | 3572 | 11333 |
| | lupin\|\|13v4\|SRR520490.227669_P1 | 3573 | 11334 |
| | lupin\|\|13v4\|SRR520490.212153_P1 | 3574 | 11335 |
| | medicago\|\|13v1\|AW256804_P1 | 3575 | 11336 |
| | soybean\|13v2\|GLYMA19G01910_P1 | 3576 | 11337 |
| | bean\|13v1\|SRR001334X123668_P1 | 3577 | 11338 |
| | nicotiana_benthamiana\|12v1\|FG136526_P1 | 3578 | 11339 |
| | nicotiana_benthamiana\|12v1\|AJ719147_P1 | 3579 | 11340 |
| | nicotiana_benthamiana\|12v1\|BP748471_P1 | 3580 | 11341 |
| | nicotiana_benthamiana\|12v1\|EB424861_P1 | 3581 | 11342 |
| | nicotiana_benthamiana\|12v1\|FG173504_P1 | 3582 | 11342 |
| | monkeyflower\|12v1\|DV211803_P1 | 3583 | 11343 |
| | echinacea\|13v1\|EPURP13V11254457_P1 | 3584 | 11344 |
| | triphysaria\|13v1\|EY004301_T1 | 3585 | 11345 |
| | arabidopsis_lyrata\|13v1\|T21894_P1 | 3586 | 11346 |
| | arabidopsis_lyrata\|13v1\|F15307_P1 | 3587 | 11347 |
| | arabidopsis\|13v2\|AT1G64190_P1 | 3588 | 11348 |
| | thellungiella_halophilum\|13v1\|BY804243_P1 | 3589 | 11349 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| | peanut\|13v1\|ES490969_P1 | 3590 | 11350 |
| | arabidopsis\|13v2\|AT5G41670_P1 | 3591 | 11351 |
| | ginseng\|13v1\|SRR547977.149183_T1 | 3592 | 11352 |
| | cacao\|13v1\|CU508968_P1 | 3593 | 11353 |
| | ginseng\|13v1\|SRR547977.32701_P1 | 3594 | 11354 |
| | ginseng\|13v1\|HS077265_P1 | 3595 | 11355 |
| | soybean\|13v2\|GLYMA08G02410_P1 | 3596 | 11356 |
| | grape\|13v1\|GFXAM458581X1_P1 | 3597 | 11357 |
| | soybean\|13v2\|GLYMA05G37170_P1 | 3598 | 11358 |
| | soybean\|12v1\|GLYMA05G37170 | 3599 | 11358 |
| | soybean\|13v2\|GLYMA05G37150_P1 | 3600 | 11358 |
| | medicago\|\|13v1\|AL384701_P1 | 3601 | 11359 |
| | thellungiella_halophilum\|13v1\|SRR487818.122950_P1 | 3602 | 11360 |
| | prunus_mume\|13v1\|CB819193 | 3603 | 11361 |
| | poplar\|13v1\|BU829466_P1 | 3604 | 11362 |
| | chickpea\|13v2\|GR912447_P1 | 3605 | 11363 |
| | ginseng\|13v1\|SRR547977.11969_T1 | 3606 | 11364 |
| | lupin\|\|13v4\|SRR520491.1010389_P1 | 3607 | 11365 |
| | quinoa\|13v2\|SRR315568X203600_T1 | 3608 | 11366 |
| | poplar\|13v1\|AI165699_P1 | 3609 | 11367 |
| | bean\|12v2\|CA900025 | 3610 | 11368 |
| | bean\|13v1\|CA900025_P1 | 3611 | 11369 |
| | bean\|13v1\|EX303864_T1 | 3612 | 11370 |
| | sorghum\|13v2\|AW679501_P1 | 8306 | 14914 |
| | cenchrus\|\|13v1\|EB654709_P1 | 8307 | 14915 |
| | cenchrus\|\|13v1\|EB655983_P1 | 8308 | 14916 |
| | foxtail_millet\|13v2\|SRR350548X154353_P1 | 8309 | 14917 |
| | switchgrass\|12v1\|FL975806 | 8310 | 14918 |
| | rice\|13v2\|AA751715_P1 | 8311 | 14919 |
| | maize\|13v2\|AW506667_P1 | 8312 | 14920 |
| | foxtail_millet\|13v2\|SRR350548X103395_P1 | 8313 | 14921 |
| | maize\|13v2\|AW067342_P1 | 8314 | 14922 |
| | switchgrass\|12v1\|DN147336 | 8315 | 14923 |
| | switchgrass\|12v1\|DN140971 | 8316 | 14924 |
| | brachypodium\|13v2\|BRADI1G26530_P1 | 8317 | 14925 |
| | rice\|13v2\|BI809972_P1 | 8318 | 14926 |
| | switchgrass\|12v1\|DN141934 | 8319 | 14927 |
| | sorghum\|13v2\|CB926713_P1 | 8320 | 14928 |
| | rice\|13v2\|CA766993_P1 | 8321 | 14929 |
| | brachypodium\|13v2\|BRADI4G11300_T1 | 8322 | 14930 |
| | maize\|13v2\|CF004751_P1 | 8323 | 14931 |
| | foxtail_millet\|13v2\|SRR350548X193552_P1 | 8324 | 14932 |
| | lolium\|\|13v1\|ERR246396S102853_T1 | 8325 | 14933 |
| | foxtail_millet\|13v2\|SRR350548X158458_P1 | 8326 | 14934 |
| | maize\|13v2\|AI677471_P1 | 8327 | 14935 |
| | rice\|13v2\|AF150113_P1 | 8328 | 14936 |
| | sorghum\|13v2\|AW745516_P1 | 8329 | 14937 |
| | switchgrass\|12v1\|FE607135 | 8330 | 14938 |
| | foxtail_millet\|13v2\|SRR350548X11557_P1 | 8331 | 14939 |
| | lolium\|\|13v1\|ES699040_P1 | 8332 | 14940 |
| | brachypodium\|13v2\|BRADI4G04290_P1 | 8333 | 14941 |
| | cenchrus\|\|13v1\|SRR124128X153623D1_11 | 8334 | 14942 |
| | echinacea\|\|13v1\|EPURP13V12373706_P1 | 8335 | 14943 |
| | triphysaria\|\|13v1\|EY128870_P1 | 8336 | 14944 |
| | olea\|\|13v1\|SRR014463X19237D1_P1 | 8337 | 14945 |
| | basilicum\|\|13v1\|B10LEAF318589_P1 | 8338 | 14946 |
| | cenchrus\|\|13v1\|SRR124128X217742D1_P1 | 8339 | 14947 |
| | olea\|\|13v1\|SRR592583X111364D1_P1 | 8340 | 14948 |
| | cenchrus\|\|13v1\|SRR124128X154700D1_P1 | 8341 | 14949 |
| | monkeyflower\|12v1\|GO955392_P1 | 8342 | 14950 |
| | nicotiana_benthamiana\|12v1\|FS384845_P1 | 8343 | 14951 |
| | grape\|13v1\|GSVIVT01024961001_P1 | 8344 | 14952 |
| | quinoa\|13v2\|SRR315569X210009_P1 | 8345 | 14953 |
| | monkeyflower\|12v1\|DV209890_P1 | 8346 | 14954 |
| | ginseng\|13v1\|SRR547984.455348_P1 | 8347 | 14955 |
| | quinoa\|13v2\|CQUI13V11038342_P1 | 8348 | 14956 |
| | quinoa\|13v2\|SRR315570X375187_P1 | 8349 | 14956 |
| | grape\|13v1\|GSVIVT01034172001_P1 | 8350 | 14957 |
| | prunus_mume\|13v1\|DY647652 | 8351 | 14958 |
| | zostera\|\|12v1\|SRR057351X103123D1 | 8352 | 14959 |
| | ginseng\|13v1\|PG13V1394312_P1 | 8353 | 14960 |
| | ginseng\|13v1\|SRR547977.21750_P1 | 8354 | 14961 |
| | ginseng\|13v1\|SRR547977.484054_P1 | 8355 | 14962 |

TABLE 1-continued

Identified genes for increasing yield, growth rate, vigor, biomass, growth rate, oil content, fiber yield, fiber quality, photosynthetic capacity, abiotic stress tolerance, nitrogen use efficiency, water use efficiency and fertilizer use efficiency of a plant

| Gene Name | Organism and Cluster tag | Polyn SEQ ID NO: | Polyp. SEQ ID NO: |
|---|---|---|---|
| | nicotiana\|_benthamiana\|12v1\|EB431713_P1 | 8356 | 14963 |
| | nicotiana\|_benthamiana\|12v1\|BP746194_P1 | 8357 | 14964 |
| | ginseng\|13v1\|SRR547977.449157_P1 | 8358 | 14965 |
| | prunus_mume\|13v1\|CV044615 | 8359 | 14966 |
| | centaurea\|\|11v1\|EH768661_T1 | 8360 | 14967 |
| | fescue\|\|13v1\|HO060678_P1 | 8361 | 14968 |
| | ginseng\|13v1\|JK984156_P1 | 8362 | 14969 |
| | tomato\|13v1\|BG125134_P1 | 8363 | 14970 |
| | echinacea\|\|13v1\|EPURP13V12056964_P1 | 8364 | 14971 |
| | centaurea\|\|11v1\|EH742119_P1 | 8365 | 14972 |
| | lupin\|\|13v4\|SRR520491.1026789_P1 | 8366 | 14973 |
| | centaurea\|\|11v1\|EH721004_P1 | 8367 | 14972 |
| | soybean\|12v1\|GLYMA11G14830 | 8368 | 14974 |
| | soybean\|13v2\|GLYMA11G14830_P1 | 8369 | 14974 |
| | soybean\|12v1\|GLYMA12G06770 | 8370 | 14975 |
| | soybean\|13v2\|GLYMA12G06770_P1 | 8371 | 14975 |
| | lupin\|\|13v4\|SRR520491.101225_P1 | 8372 | 14976 |
| | chickpea\|13v2\|GR403089_P1 | 8373 | 14977 |
| | silicum\|13v1\|B10LEAF296739_P1 | 8374 | 14978 |
| | switchgrass\|12v1\|FL891053 | 8375 | 14979 |
| | maize\|13v2\|AI973393_P1 | 8686 | 15224 |
| | foxtail_millet\|13v2\|SRR350548X144392_P1 | 8687 | 15225 |
| | sorghum\|13v2\|BG947008_T1 | 8688 | 15226 |
| | brachypodium\|13v2\|BRADI3G53290_P1 | 8689 | 15227 |
| | cenchrus\|\|13v1\|EB662826_P1 | 8690 | 15228 |
| | sorghum\|13v2\|AW284830_P1 | 8928 | 15435 |
| | foxtail_millet\|13v2\|SRR350548X142459_P1 | 8929 | 15436 |
| | rice\|13v2\|U37978_P1 | 8930 | 15437 |
| | brachypodium\|13v2\|BRADI2G04130_P1 | 8931 | 15438 |
| | fescue\|\|13v1\|DT698307_P1 | 8932 | 15439 |
| | lolium\|\|13v1\|SRR029314X10387_P1 | 8933 | 15440 |
| | rice\|13v2\|AB060277_P1 | 8934 | 15441 |
| | sorghum\|13v2\|CD203908_P1 | 8935 | 15442 |
| | foxtail_millet\|13v2\|SRR350548X101163_P1 | 8936 | 15443 |
| | maize\|13v2\|AI783320_P1 | 8937 | 15444 |
| | brachypodium\|13v2\|BRADI2G34470_P1 | 8938 | 15445 |
| | cenchrus\|\|13v1\|EB654978_T1 | 8939 | 15446 |
| | cacao\|13v1\|CU505404_P1 | 8940 | 15447 |
| | grape\|13v1\|GSVIVT01024573001_P1 | 8941 | 15448 |
| | ginseng\|13v1\|SRR547977.146009_P1 | 8942 | 15449 |
| | grape\|13v1\|GSVIVT01032677001_P1 | 8943 | 15450 |
| | ginseng\|13v1\|JK984772_P1 | 8944 | 15451 |
| | ginseng\|13v1\|SRR547977.113440_P1 | 8945 | 15452 |
| | gossypium\|_raimondii\|\|13v1\|BE054298_P1 | 8946 | 15453 |
| | ginseng\|13v1\|SRR547986.158503_T1 | 8947 | 15454 |
| | sorghum\|13v2\|BM325215_P1 | 9272 | 15723 |
| | switchgrass\|12v1\|FL714538 | 9273 | 15724 |
| | foxtail_millet\|13v2\|SRR350548X111433_P1 | 9274 | 15725 |
| | sorghum\|13v2\|BM323764_P1 | 9275 | 15726 |

Table 1: Provided are the identified genes, their annotation, organism and polynucleotide and polypeptide sequence identifiers. "polyn." = polynucleotide; "polyp." = polypeptide.

Example 2

Identification of Homologous (E.G., Orthologous) Sequences that Increase Yield, Fiber Yield, Fiber Quality, Growth Rate, Biomass, Oil Content, Vigor, ABST, and/or NUE of a Plant The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes affecting plant yield, fiber yield, fiber quality, oil yield, oil content, seed yield, growth rate, vigor, biomass, abiotic stress tolerance, and fertilizer use efficiency (FUE) and/or nitrogen use efficiency of a plant, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level—identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem (dot) ucl (dot) ac (dot) uk/bsm/dbbrowser/protocol/prodomqry (dot) html), PIR (pir (dot) Georgetown (dot) edu/) or Pfam (sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST software with the Blastp and tBlastn algorithms as filters for the first stage, and the needle (EMBOSS package) or Frame+algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "−F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the blastp filter):
EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tblastn filter):
GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options described hereinabove.

The query polypeptide sequences were the sequences listed in Table 1 above, and the identified orthologous and homologous sequences having at least 80% global sequence identity to said sequences are provided in Table 2, below.

These homologous genes are expected to increase plant yield, seed yield, oil yield, oil content, growth rate, photosynthetic capacity, fiber yield, fiber quality, biomass, vigor, ABST and/or NUE of a plant.

Lengthy table referenced here

US10006042-20180626-T00001

Please refer to the end of the specification for access instructions.

The output of the functional genomics approach described herein is a set of genes highly predicted to improve yield and/or other agronomic important traits such as growth rate, vigor, oil content, fiber yield and/or quality, biomass, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 3

Production of Barley Transcriptome and High Throughput Correlation Analysis Using 44K Barley Oligonucleotide Micro-Array In order to produce a high throughput correlation analysis, the present inventors utilized a Barley oligonucleotide micro-array, produced by Agilent Technologies [chem. (dot) agilent (dot) com/Scripts/PDS (dot) asp?1Page=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Four tissues at different developmental stages [meristem, flower, booting spike, stem], representing different plant characteristics were sampled and RNA was extracted as described hereinabove under "GENERAL EXPERIMENTAL AND BIOINFORMATICS METHODS".

For convenience, each micro-array expression information tissue type has received a Set ID as summarized in Table 3 below.

TABLE 3

Barley transcriptome expression sets

| Expression Set | Set ID |
|---|---|
| Booting spike at flowering stage under normal conditions | 1 |
| Flowering spike at flowering stage under normal conditions | 2 |
| Meristem at flowering stage under normal conditions | 3 |
| Stem at flowering stage under normal conditions | 4 |

Table 3: Provided are the identification (ID) letters of each of the Barley expression sets.

Barley yield components and vigor related parameters assessment—13 Barley accessions in 4 repetitive blocks (named A, B, C, and D), each containing 4 plants per plot were grown at net house under normal conditions as recommended for commercial growth [normal growth conditions included irrigation given 2-3 times a week, and fertilization given in the first 1.5 months of the growth period]; under low Nitrogen (80% percent less Nitrogen); or under drought stress (cycles of drought and re-irrigating were conducted throughout the whole experiment, overall 40% less water were given in the drought treatment). Plants were phenotyped on a daily basis following the standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

TABLE 4

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/A (Absence) | Absence (1) or Presence (2) |
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |

TABLE 4-continued

Barley standard descriptors

| Trait | Parameter | Range | Description |
|---|---|---|---|
| Vegetative dry weight | Gram | | Oven-dried for 48 hours at 70° C. |
| Spikes dry weight | Gram | | Oven-dried for 48 hours at 30° C. |

Table 4

At the end of the experiment (50% of the spikes were dry) all spikes from plots within blocks A-D were collected, and the following measurements were performed:

(i) Grains per spike—The total number of grains from 5 spikes that were manually threshed was counted. The average grain per spike was calculated by dividing the total grain number by the number of spikes.

(ii) Grain average size (cm)—The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

(iii) Grain average weight (mgr)—The total grains from 5 spikes that were manually threshed were counted and weight. The average weight was calculated by dividing the total weight by the total grain number.

(iv) Grain yield per spike (gr) (=seed yield of 5 spikes)—The total grains from 5 spikes that were manually threshed were weight. The grain yield was calculated by dividing the total weight by the spike number.

(v) Spike length analysis—The five chosen spikes per plant were measured using measuring tape excluding the awns.

(vi) Spike number analysis—The spikes per plant were counted.

Additional parameters were measured as follows:

Growth habit scoring—At growth stage 10 (booting), each of the plants was scored for its growth habit nature. The scale that was used was "1" for prostate nature till "9" for erect.

Hairiness of basal leaves—At growth stage 5 (leaf sheath strongly erect; end of tillering), each of the plants was scored for its hairiness nature of the leaf before the last. The scale that was used was "1" for prostate nature till "9" for erect.

Plant height—At harvest stage (50% of spikes were dry), each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At growth stage 10 (booting), each of the plants was scored for its stem color. The scale that was used was "1" for green till "5" for full purple.

Vegetative dry weight and spike yield—At the end of the experiment (50% of the spikes were dry) all spikes and vegetative material from plots within blocks A-D were collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

TABLE 5

Barley correlated parameters (vectors)

| Correlated parameter with | Correlation ID |
|---|---|
| Grain weight [milligrams] | 1 |
| Grains size [mm$^2$] | 2 |
| Grains per spike [numbers] | 3 |
| Growth habit [scores 1-9] | 4 |
| Hairiness of basal leaves [scoring 1-2] | 5 |
| Plant height (cm) | 6 |
| Seed yield of 5 spikes [gr/spike] | 7 |
| Spike length [cm] | 8 |
| Spikes per plant [numbers] | 9 |
| Stem pigmentation [scoring 1-5] | 10 |
| Vegetative dry weight [gram] | 11 |
| Days to flowering [days] | 12 |

Table 5. Provided are the Barley correlated parameters (vectors).

Experimental Results 13 different Barley accessions were grown and characterized for 12 parameters as described above. The average for each of the measured parameter was calculated using the JMP software and values are summarized in Tables 6 and 7 below. Subsequent correlation analysis between the various transcriptome expression sets (Table 3) and the average parameters was conducted. Follow, results were integrated to the database (Table 8 below).

TABLE 6

Measured parameters of correlation Ids in Barley accessions

| Ecotype/Treatment | Line-1 | Line-2 | Line-3 | Line-4 | Line-5 | Line-6 | Line-7 |
|---|---|---|---|---|---|---|---|
| 1 | 35.05 | 28.06 | 28.76 | 17.87 | 41.22 | 29.73 | 25.22 |
| 2 | 0.27 | 0.23 | 0.24 | 0.17 | 0.29 | 0.28 | 0.22 |
| 3 | 20.23 | 17.98 | 17.27 | 17.73 | 14.47 | 16.78 | 12.12 |
| 4 | 2.60 | 2.00 | 1.92 | 3.17 | 4.33 | 2.69 | 3.60 |
| 5 | 1.53 | 1.33 | 1.69 | 1.08 | 1.42 | 1.69 | 1.30 |
| 6 | 134.27 | 130.50 | 138.77 | 114.58 | 127.75 | 129.38 | 103.89 |
| 7 | 3.56 | 2.54 | 2.58 | 1.57 | 3.03 | 2.52 | 1.55 |

TABLE 6-continued

Measured parameters of correlation Ids in Barley accessions

| Ecotype/Treatment | Line-1 | Line-2 | Line-3 | Line-4 | Line-5 | Line-6 | Line-7 |
|---|---|---|---|---|---|---|---|
| 8  | 12.04 | 10.93 | 11.83 | 9.90  | 11.68 | 11.53 | 8.86  |
| 9  | 48.85 | 48.27 | 37.42 | 61.92 | 33.27 | 41.69 | 40.00 |
| 10 | 1.13  | 2.50  | 1.69  | 1.75  | 2.33  | 2.31  | 1.70  |
| 11 | 78.87 | 66.14 | 68.49 | 53.39 | 68.30 | 74.17 | 35.35 |
| 12 | 62.40 | 64.08 | 65.15 | 58.92 | 63.00 | 70.54 | 52.80 |

Table 6. Provided are the values of each of the parameters measured in Barley accessions (1-7) according to the correlation identifications (see Table 5).

TABLE 7

Barley accessions, additional measured parameters

| Ecotype/Treatment | Line-8 | Line-9 | Line-10 | Line-11 | Line-12 | Line-13 |
|---|---|---|---|---|---|---|
| 1  | 34.99  | 20.58  | 27.50  | 37.13  | 29.56  | 19.58  |
| 2  | 0.28   | 0.19   | 0.22   | 0.27   | 0.27   | 0.18   |
| 3  | 14.07  | 21.54  | 12.10  | 13.40  | 15.28  | 17.07  |
| 4  | 3.50   | 3.00   | 3.67   | 2.47   | 3.50   | 3.00   |
| 5  | 1.19   | 1.00   | 1.17   | 1.60   | 1.08   | 1.17   |
| 6  | 121.63 | 126.80 | 99.83  | 121.40 | 118.42 | 117.17 |
| 7  | 2.62   | 2.30   | 1.68   | 2.68   | 2.35   | 1.67   |
| 8  | 11.22  | 11.11  | 8.58   | 10.18  | 10.51  | 9.80   |
| 9  | 40.63  | 62.00  | 49.33  | 50.60  | 43.09  | 51.40  |
| 10 | 2.19   | 2.30   | 1.83   | 3.07   | 1.58   | 2.17   |
| 11 | 58.33  | 62.23  | 38.32  | 68.31  | 56.15  | 42.68  |
| 12 | 60.88  | 58.10  | 53.00  | 60.40  | 64.58  | 56.00  |

Table 7. Provided are the values of each of the parameters measured in Barley accessions (8-13) according to the correlation identifications (see Table 5).

TABLE 8

Correlation between the expression level of the selected polynucleotides of the invention and their homologues in specific tissues or developmental stages and the phenotypic performance across Barley accessions

| Gene Name | R | P value | Exp. set | Corr. Set ID | Gene Name | R | P value | Exp. set | Corr. Set ID |
|---|---|---|---|---|---|---|---|---|---|
| LGP22 | 0.82 | 3.46E-03 | 2 | 4 | MGP3 | 0.74 | 8.95E-03 | 1 | 2 |
| MGP3  | 0.71 | 1.42E-02 | 1 | 1 | MGP3 | 0.78 | 5.01E-03 | 3 | 2 |

Table 8. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Tables 5, 6 and 7 Exp. Set = expression set specified in Table 3.

Example 4

Production of Barley Transcriptome and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [chem. (dot) agilent (dot) com/Scripts/PDS (dot) asp?1Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed Barley tissues—six tissues at different developmental stages [leaf, meristem, root tip, adventitious root, booting spike and stem], representing different plant characteristics, were sampled and RNA was extracted as described above. Each micro-array expression information tissue type has received a Set ID as summarized in Tables 9-11 below.

TABLE 9

Barley transcriptome expression sets (set 1)

| Expression Set | Set ID |
|---|---|
| Root at vegetative stage under low N conditions | 1 |
| Root at vegetative stage under normal conditions | 2 |
| leaf at vegetative stage under low N conditions | 3 |
| leaf at vegetative stage under normal conditions | 4 |
| root tip at vegetative stage under low N conditions | 5 |
| root tip at vegetative stage under normal conditions | 6 |

Table 9. Provided are the expression sets IDs at the vegetative stage.

TABLE 10

Barley transcriptome expression sets under normal and low nitrogen conditions (set 2)

| Expression Set | Set ID |
|---|---|
| Booting spike under low nitrogen conditions | 1 |
| Booting spike under normal conditions | 2 |
| Leaf under low nitrogen conditions | 3 |
| Leaf under normal conditions | 4 |

TABLE 10-continued

Barley transcriptome expression sets under normal and low nitrogen conditions (set 2)

| Expression Set | Set ID |
|---|---|
| Stem under low nitrogen conditions | 5 |
| Stem under normal conditions | 6 |

Table 10. Provided are the barley transcriptome expression sets under normal and low nitrogen conditions at the reproductive stage.

TABLE 11

Barley transcriptome expression sets under drought and recovery conditions

| Expression Set | Set ID |
|---|---|
| booting spike at reproductive stage under drought conditions | 1 |
| leaf at reproductive stage under drought conditions | 2 |
| leaf at vegetative stage under drought conditions | 3 |
| meristems at vegetative stage under drought conditions | 4 |
| root tip at vegetative stage under drought conditions | 5 |
| root tip at vegetative stage under recovery drought | 6 |

Table 11. Provided are the expression sets IDs at the reproductive and vegetative stages.

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting as recommended for commercial growth under normal conditions [normal growth conditions included irrigation 2-3 times a week and fertilization given in the first 1.5 months of the growth period]; under low Nitrogen (80% percent less Nitrogen); or under drought stress (cycles of drought and re-irrigating were conducted throughout the whole experiment, overall 40% less water as compared to normal conditions were given in the drought treatment). Plants were phenotyped on a daily basis following the standard descriptor of barley (Tables 12 and 13, below). Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Grains number—The total number of grains from all spikes that were manually threshed was counted. Number of grains per plot was counted.

Grain weight (gr.)—At the end of the experiment all spikes of the pots were collected. The total grains from all spikes that were manually threshed were weighted. The grain yield was calculated by per plot.

Spike length and width analysis—At the end of the experiment the length and width of five chosen spikes per plant were measured using measuring tape excluding the awns.

Spike number analysis—The spikes per plant or per plot were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Root dry weight=total weight of the root portion underground after drying at 70° C. in oven for 48 hours at harvest.

Root/Shoot Ratio—The Root/Shoot Ratio was performed using Formula XXII above.

Total No of tillers—all tillers were counted per plot at two time points at the Vegetative growth (30 days after sowing) and at harvest.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root fresh weight (FW), root length and for counting the number of lateral roots formed.

Shoot FW—weights of 3 plants per plot were recorded at different time-points.

Relative water content—Fresh weight (FW) of three leaves from three plants each from different seed IDs was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to Formula I above.

Harvest Index (for barley)—The harvest index was performed using Formula XVIII above.

Relative growth rate: the relative growth rate (RGR) of Plant Height (Formula III), SPAD (Formula IV) and number of tillers (Formula V) were calculated according to the indicated Formulas described above.

TABLE 12

Barley correlated parameters (vectors) under low nitrogen and normal conditions (set 1)

| Correlated parameter with | Correlation ID |
|---|---|
| Lateral Roots (number) - Normal | 1 |
| Leaf Area (mm$^2$) - Normal | 2 |
| Leaf Number - TP4 - Low N | 3 |
| Max Length (mm) - Normal | 4 |
| Max Width (mm) - Normal | 5 |
| Max Length (mm) - TP4 - Low N | 6 |
| Max Width (mm) - TP4 - Low N | 7 |
| No of lateral roots - Low N - TP2 | 8 |
| Num Leaves - Normal | 9 |
| Num Seeds - Normal | 10 |
| Num Spikes per plot - Normal | 11 |
| Num Tillers per plant - Normal | 12 |
| Plant Height (cm) - TP1 - Normal | 13 |
| Plant Height (cm) - TP2 - Normal | 14 |
| Plant Height (cm) - Low N - TP1 | 15 |
| Plant Height (cm) - Low N - TP2 | 16 |
| Root FW (g) - Normal | 17 |
| Root Length (cm) - Normal | 18 |
| Root FW (g) - Low N - TP2 | 19 |

TABLE 12-continued

Barley correlated parameters (vectors) under low nitrogen and normal conditions (set 1)

| Correlated parameter with | Correlation ID |
|---|---|
| Root length (cm) - Low N - TP2 | 20 |
| SPAD - Normal | 21 |
| SPAD - Low N - TP2 | 22 |
| Seed Yield (gr) - Normal | 23 |
| Seed Number (per plot) - Low N | 24 |
| Seed Yield (gr) - Low N | 25 |
| Shoot FW (g) - Normal | 26 |
| Spike Length (cm) - Normal | 27 |
| Spike Width (cm) - Normal | 28 |
| Spike weight per plot (g) - Normal | 29 |
| Spike Length (cm) - Low N | 30 |
| Spike Width (cm) - Low N | 31 |
| Spike total weight (per plot) - Low N | 32 |
| Total Tillers per plot (number) - Normal | 33 |
| Total Leaf Area (mm$^2$) - TP4 - Low N | 34 |
| Total No of Spikes per plot - Low N | 35 |
| Total No of tillers per plot - Low N | 36 |
| shoot FW (gr) - Low N - TP2 | 37 |

Table 12. Provided are the barley correlated parameters. TP = time point; DW = dry weight; FW = fresh weight; Low N = Low Nitrogen.

TABLE 13

Barley correlated parameters (vectors) for maintenance of performance under normal conditions (set 2)

| Correlated parameter with | Correlation ID |
|---|---|
| Grain Perimeter (mm) | 1 |
| Grain area (cm$^2$) | 2 |
| Grain length (mm) | 3 |
| Grain width (mm) | 4 |
| Grains DW/Shoots DW (ratio) | 5 |
| Grains per plot (number) | 6 |
| Grains weight per plant (gr) | 7 |
| Grains weight per plot (gr) | 8 |
| Plant Height (cm) | 9 |
| Roots DW (gr) | 10 |
| Row number (number) | 11 |
| Spikes FW (Harvest) (gr) | 12 |
| Spikes num (number) | 13 |
| Tillering (Harvest) (number) | 14 |
| Vegetative DW (Harvest) (gr) | 15 |
| percent of reproductive tillers (%) | 16 |
| shoot/root ratio (ratio) | 17 |

Table 13. Provided are the barley correlated parameters. ""DW" = dry weight; "ratio" - maintenance of phenotypic performance under drought in comparison to normal conditions.

TABLE 14

Barley correlated parameters (vectors) under drought conditions

| Correlated parameter with | Correlation ID |
|---|---|
| Chlorophyll levels | 1 |
| Dry weight harvest (gr.) | 2 |
| Dry weight vegetative growth (gr.) | 3 |
| Fresh weight (gr.) | 4 |
| Grain number | 5 |
| Grain weight (gr.) | 6 |
| Harvest index | 7 |
| Heading date | 8 |
| Height Relative growth rate | 9 |
| Number of tillers Relative growth rate | 10 |
| Plant height T1 (cm) | 11 |
| Plant height T2 (cm) | 12 |
| RBiH/BiH (root/shoot ratio, Formula XXII hereinabove) | 13 |
| Relative water content | 14 |

TABLE 14-continued

Barley correlated parameters (vectors) under drought conditions

| Correlated parameter with | Correlation ID |
|---|---|
| Root dry weight (gr.) | 15 |
| Root fresh weight (gr.) | 16 |
| Root length (cm) | 17 |
| SPAD Relative growth rate | 18 |
| Spike length (cm) | 19 |
| Spike number per plant | 20 |
| Spike weight per plant (gr.) | 21 |
| Spike width (cm) | 22 |
| Tillers number T1 (number) | 23 |
| Tillers number T2 (number) | 24 |
| Lateral root number (number) | 25 |

Table 14. Provided are the barley correlated parameters. "TP" = time point; "DW" = dry weight; "FW" = fresh weight; "Low N" = Low Nitrogen; "Normal" = regular growth conditions. "Max" = maximum.

TABLE 15

Barley correlated parameters (vectors) for maintenance of performance under drought conditions

| Correlated parameter with | Correlation ID |
|---|---|
| Chlorophyll levels ratio | 1 |
| Dry weight at harvest ratio | 2 |
| Dry weight_vegetative growth ratio | 3 |
| Fresh weight ratio | 4 |
| Grain number ratio | 5 |
| Grain weight ratio | 6 |
| Harvest index ratio | 7 |
| Heading date ratio | 8 |
| Plant height ratio | 9 |
| Root/shoot ratio | 10 |
| Relative water content ratio | 11 |
| Root dry weight ratio | 12 |
| Root fresh weight ratio | 13 |
| Root length ratio | 14 |
| Spike length ratio | 15 |
| Spike number ratio | 16 |
| Spike weight per plant ratio | 17 |
| Spike width ratio | 18 |
| Tillers number ratio | 19 |
| lateral root number ratio | 20 |

Table 15. Provided are the barley correlated parameters. ""DW" = dry weight; "ratio" - maintenance of phenotypic performance under drought in comparison to normal conditions.

Experimental Results 15 different Barley accessions were grown and characterized for different parameters as described above. The average for each of the measured parameter was calculated using the JMP software and values are summarized in Tables 16-24 below. Subsequent correlation analysis between the various transcriptome sets and the average parameters was conducted (Tables 25-28). Follow, results were integrated to the database.

TABLE 16

Measured parameters of correlation IDs in Barley accessions (set 1)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 3 | 8.00 | 8.00 | 7.50 | 8.50 | 10.00 | 11.50 | 8.60 | 6.33 | 7.50 | 10.00 |
| 6 | 102.90 | 107.78 | 111.57 | 142.42 | 152.38 | 149.33 | 124.08 | 95.00 | 124.12 | 135.17 |
| 7 | 5.25 | 5.17 | 5.12 | 5.30 | 5.20 | 5.33 | 5.32 | 5.10 | 5.15 | 5.10 |
| 8 | 5.00 | 6.00 | 4.33 | 6.00 | 6.33 | 6.00 | 6.67 | 4.67 | 5.67 | 7.33 |
| 15 | 41.00 | 82.00 | 61.40 | 59.40 | 65.80 | 47.80 | 53.80 | 56.40 | 81.80 | 44.60 |
| 16 | 16.33 | 18.83 | 17.33 | 26.00 | 22.50 | 18.17 | 19.67 | 19.83 | 19.17 | 19.17 |
| 19 | 0.38 | 0.23 | 0.12 | 0.40 | 0.88 | 0.50 | 0.43 | 0.32 | 0.30 | 0.55 |
| 20 | 24.67 | 21.67 | 22.00 | 21.67 | 22.17 | 23.00 | 30.50 | 22.83 | 23.83 | 24.50 |
| 22 | 24.03 | 23.30 | 26.47 | 23.90 | 26.63 | 23.20 | 25.43 | 24.23 | 25.03 | 26.07 |
| 24 | 230.20 | 164.60 | 88.25 | 133.60 | 106.00 | 222.60 | 219.20 | 143.45 | 201.80 | 125.00 |
| 25 | 9.76 | 7.31 | 3.30 | 5.06 | 6.02 | 9.74 | 7.35 | 5.80 | 7.83 | 6.29 |
| 30 | 15.19 | 19.61 | 16.30 | 19.32 | 90.22 | 16.44 | 20.44 | 18.84 | 18.77 | 16.65 |
| 31 | 7.95 | 8.13 | 9.43 | 4.94 | 9.60 | 7.16 | 7.06 | 8.51 | 10.01 | 9.40 |
| 32 | 13.74 | 13.44 | 9.15 | 11.64 | 11.34 | 15.06 | 12.18 | 10.95 | 12.18 | 10.62 |
| 34 | 39.40 | 46.27 | 51.51 | 57.07 | 67.78 | 64.15 | 52.42 | 46.15 | 68.02 | 57.91 |
| 35 | 12.20 | 9.00 | 11.60 | 25.00 | 7.80 | 14.50 | 15.00 | 7.00 | 5.40 | 8.40 |
| 36 | 16.20 | 14.60 | 16.00 | 20.75 | 12.50 | 18.80 | 21.20 | 11.00 | 6.75 | 14.00 |
| 37 | 0.43 | 0.43 | 0.33 | 0.58 | 0.78 | 0.53 | 0.45 | 0.43 | 0.50 | 0.62 |
| 1 | 7.00 | 8.67 | 8.33 | 9.67 | 10.70 | 9.67 | 9.67 | 8.67 | 10.00 | 9.67 |
| 2 | 294.00 | 199.00 | 273.00 | 276.00 | 313.00 | 309.00 | 259.00 | 291.00 | 299.00 | 296.00 |
| 4 | 502.00 | 348.00 | 499.00 | 594.00 | 535.00 | 551.00 | 479.00 | 399.00 | 384.00 | 470.00 |
| 5 | 5.77 | 5.45 | 5.80 | 6.03 | 4.63 | 5.33 | 5.83 | 5.43 | 5.75 | 6.03 |
| 9 | 24.20 | 18.20 | 22.70 | 25.50 | 23.20 | 28.30 | 22.20 | 19.00 | 17.30 | 22.00 |
| 10 | 1090.00 | 510.00 | 242.00 | 582.00 | 621.00 | 1070.00 | 903.00 | 950.00 | 984.00 | 768.00 |
| 11 | 41.50 | 32.00 | 36.00 | 71.40 | 34.20 | 45.60 | 49.80 | 28.00 | 19.30 | 38.00 |
| 12 | 2.00 | 2.00 | 1.00 | 2.33 | 2.33 | 3.33 | 2.33 | 1.33 | 1.33 | 1.67 |
| 13 | 39.20 | 37.00 | 36.80 | 49.80 | 46.80 | 34.80 | 43.20 | 35.70 | 46.20 | 40.20 |
| 14 | 64.70 | 84.00 | 67.40 | 82.00 | 72.00 | 56.60 | 65.80 | 62.80 | 91.60 | 66.20 |
| 17 | 0.27 | 0.27 | 0.25 | 0.35 | 0.62 | 0.27 | 0.35 | 0.32 | 0.23 | 0.27 |
| 18 | 21.30 | 15.00 | 21.80 | 20.30 | 27.20 | 16.00 | 24.00 | 13.50 | 21.50 | 15.20 |
| 21 | 39.10 | 41.40 | 35.20 | 33.70 | 34.20 | 42.80 | 37.00 | 36.90 | 35.00 | 36.80 |
| 23 | 46.40 | 19.80 | 10.80 | 22.60 | 30.30 | 54.10 | 37.00 | 42.00 | 35.40 | 38.30 |
| 26 | 2.17 | 1.90 | 1.25 | 3.00 | 15.60 | 3.02 | 2.58 | 1.75 | 2.18 | 1.82 |
| 27 | 16.50 | 19.20 | 18.30 | 20.40 | 17.20 | 19.10 | 20.30 | 21.70 | 16.50 | 16.10 |
| 28 | 9.54 | 9.05 | 8.25 | 6.55 | 10.50 | 8.83 | 7.38 | 10.40 | 10.20 | 10.30 |
| 29 | 69.40 | 39.40 | 34.90 | 50.30 | 60.80 | 79.10 | 62.70 | 60.00 | 55.90 | 59.70 |
| 33 | 46.70 | 41.60 | 40.00 | 48.80 | 34.60 | 48.60 | 49.20 | 29.00 | 27.50 | 38.80 |

Table 16

TABLE 17

Measured parameters of correlation IDs in Barley accessions under normal conditions (set 2)

| Ecotype/Treatment | Line-1 | Line-2 | Line-3 | Line-4 | Line-5 | Line-6 | Line-7 | Line-8 |
|---|---|---|---|---|---|---|---|---|
| 1 | 2.24 | 2.24 | 2.18 | 2.05 | 2.08 | 2.03 | 2.25 | 1.88 |
| 2 | 0.25 | 0.24 | 0.24 | 0.23 | 0.24 | 0.25 | 0.24 | 0.22 |
| 3 | 0.89 | 0.87 | 0.86 | 0.80 | 0.82 | 0.78 | 0.90 | 0.72 |
| 4 | 0.35 | 0.35 | 0.35 | 0.37 | 0.37 | 0.41 | 0.35 | 0.39 |
| 5 | 0.40 | 0.16 | 1.01 | 0.79 | 0.41 | 0.99 | 0.66 | 0.61 |
| 6 | 683.40 | 510.50 | 1093.50 | 767.60 | 621.00 | 1069.00 | 987.75 | 903.20 |
| 7 | 6.65 | 3.96 | 9.27 | 7.65 | 6.06 | 10.83 | 7.94 | 7.40 |
| 8 | 33.24 | 19.81 | 46.37 | 38.25 | 30.30 | 54.13 | 39.69 | 36.98 |
| 9 | 76.40 | 84.00 | 64.67 | 66.20 | 72.00 | 56.60 | 68.00 | 65.80 |
| 10 | 118.30 | 150.68 | 86.28 | 85.19 | 120.31 | 90.70 | 40.58 | 90.51 |
| 11 | 6.00 | 6.00 | 6.00 | 6.00 | 6.00 | 2.80 | 6.00 | 2.00 |
| 12 | 69.84 | 39.86 | 69.40 | 59.72 | 60.83 | 79.12 | 63.50 | 62.74 |
| 13 | 38.60 | 32.00 | 41.50 | 38.00 | 34.20 | 45.60 | 30.00 | 49.80 |
| 14 | 44.25 | 41.60 | 46.67 | 38.80 | 34.60 | 48.60 | 32.40 | 55.20 |
| 15 | 89.20 | 99.65 | 45.79 | 49.39 | 74.32 | 55.11 | 47.29 | 60.32 |
| 16 | 82.30 | 77.75 | 86.69 | 94.23 | 89.74 | 93.73 | 89.49 | 90.27 |
| 17 | 1.48 | 0.64 | 0.84 | 0.82 | 1.15 | 0.69 | 1.26 | 0.72 |

Table 17. Provided are the values of each of the parameters (as described above) measured in Barley accessions (line) under normal growth conditions. Growth conditions are specified in the experimental procedure section.

TABLE 18

Additional measured parameters of correlation IDs in Barley accessions under normal conditions (set 2)

| Ecotype/Treatment | Line-9 | Line-10 | Line-11 | Line-12 | Line-13 | Line-14 | Line-15 |
|---|---|---|---|---|---|---|---|
| 1 | 2.09 | 2.03 | 2.02 | 1.98 | 1.69 | 1.98 | 1.89 |
| 2 | 0.23 | 0.22 | 0.23 | 0.21 | 0.18 | 0.19 | 0.17 |
| 3 | 0.82 | 0.79 | 0.80 | 0.80 | 0.65 | 0.82 | 0.77 |
| 4 | 0.36 | 0.36 | 0.37 | 0.34 | 0.35 | 0.29 | 0.29 |
| 5 | 0.28 | 1.04 | 0.12 | 0.86 | 0.58 | 0.05 | 0.08 |
| 6 | 581.80 | 904.40 | 242.40 | 928.40 | 984.20 | 157.67 | 263.25 |
| 7 | 4.52 | 8.41 | 2.00 | 8.05 | 7.07 | 0.75 | 1.14 |
| 8 | 22.58 | 39.68 | 10.84 | 40.26 | 35.37 | 3.73 | 5.68 |
| 9 | 82.00 | 62.80 | 67.40 | 76.20 | 91.60 | 44.00 | 52.75 |
| 10 | 92.59 | 63.95 | 286.63 | 95.79 | 34.04 | 121.27 | 206.75 |
| 11 | 2.00 | 5.20 | 6.00 | 6.00 | 6.00 | 4.67 | 4.00 |
| 12 | 50.30 | 59.95 | 34.92 | 60.08 | 55.88 | 16.93 | 21.70 |
| 13 | 71.40 | 28.00 | 36.00 | 27.60 | 23.60 | 54.67 | 48.00 |
| 14 | 50.60 | 29.00 | 40.00 | 28.50 | 27.50 | 26.00 | |
| 15 | 88.01 | 38.89 | 97.71 | 48.33 | 62.52 | 57.97 | 72.78 |
| 16 | 91.21 | 92.50 | 91.73 | 85.31 | | | |
| 17 | 1.17 | 0.71 | 0.38 | 0.51 | 2.16 | 0.67 | 0.39 |

Table 18. Provided are the values of each of the parameters (as described above) measured in Barley accessions (line) under normal growth conditions. Growth conditions are specified in the experimental procedure section.

TABLE 19

Measured parameters of correlation IDs in Barley accessions under low nitrogen conditions (set 2)

| Ecotype/Treatment | Line-1 | Line-2 | Line-3 | Line-4 | Line-5 | Line-6 | Line-7 | Line-8 |
|---|---|---|---|---|---|---|---|---|
| 1 | 2.28 | 2.33 | 2.28 | 2.08 | 2.13 | 1.96 | 2.09 | 1.88 |
| 2 | 0.25 | 0.25 | 0.25 | 0.24 | 0.25 | 0.23 | 0.23 | 0.21 |
| 3 | 0.90 | 0.92 | 0.93 | 0.82 | 0.86 | 0.76 | 0.83 | 0.73 |
| 4 | 0.35 | 0.35 | 0.35 | 0.36 | 0.37 | 0.38 | 0.35 | 0.36 |
| 5 | 0.39 | 0.42 | 1.25 | 0.69 | 0.43 | 0.87 | 0.77 | 0.53 |
| 6 | 153.20 | 164.60 | 230.20 | 125.00 | 100.00 | 222.60 | 159.40 | 219.20 |
| 7 | 1.34 | 1.46 | 1.95 | 1.26 | 1.13 | 1.95 | 1.28 | 1.47 |
| 8 | 6.68 | 7.31 | 9.76 | 6.29 | 5.67 | 9.74 | 6.40 | 7.35 |
| 9 | 75.20 | 82.00 | 41.00 | 44.60 | 65.80 | 47.80 | 60.60 | 53.80 |
| 10 | 39.91 | 26.24 | 17.31 | 32.91 | 33.87 | 83.84 | 29.65 | 37.21 |
| 11 | 6.00 | 6.00 | 6.00 | 6.00 | 6.00 | 2.00 | 6.00 | 2.00 |
| 12 | 11.40 | 13.44 | 13.74 | 10.62 | 11.34 | 15.06 | 11.64 | 12.18 |
| 13 | 10.80 | 9.00 | 12.20 | 8.40 | 7.80 | 14.50 | 8.40 | 15.00 |
| 14 | 16.00 | 14.60 | 16.20 | 14.00 | 12.50 | 18.80 | 11.60 | 21.20 |
| 15 | 17.42 | 17.76 | 8.25 | 7.28 | 13.25 | 11.32 | 8.95 | 14.18 |
| 16 | 68.68 | 61.85 | 76.94 | 59.63 | 65.63 | 79.84 | 73.85 | 71.01 |
| 17 | 0.69 | 1.08 | 0.77 | 0.38 | 0.83 | 0.42 | 0.28 | 0.57 |

Table 19. Provided are the values of each of the parameters (as described above) measured in Barley accessions (line) under low N growth conditions. Growth conditions are specified in the experimental procedure section.

TABLE 20

Additional measured parameters of correlation IDs in Barley accessions under low nitrogen conditions (set 2)

| Ecotype/Treatment | Line-9 | Line-10 | Line-11 | Line-12 | Line-13 | Line-14 | Line-15 |
|---|---|---|---|---|---|---|---|
| 1 | 2.19 | 1.88 | 2.03 | 2.11 | 1.77 | 2.00 | 1.90 |
| 2 | 0.23 | 0.20 | 0.22 | 0.23 | 0.19 | 0.19 | 0.17 |
| 3 | 0.86 | 0.73 | 0.81 | 0.85 | 0.68 | 0.81 | 0.79 |
| 4 | 0.35 | 0.35 | 0.35 | 0.35 | 0.36 | 0.29 | 0.27 |
| 5 | 0.34 | 0.87 | 0.15 | 0.58 | 0.76 | 0.05 | 0.07 |
| 6 | 133.60 | 134.40 | 88.25 | 174.25 | 201.80 | 86.67 | 61.60 |
| 7 | 0.98 | 1.16 | 0.92 | 1.33 | 1.57 | 0.29 | 0.22 |
| 8 | 5.06 | 5.43 | 4.62 | 6.67 | 7.83 | 1.44 | 1.12 |
| 9 | 59.40 | 56.40 | 61.40 | 65.60 | 81.80 | 69.00 | 57.40 |
| 10 | 44.38 | 14.46 | 41.54 | 23.75 | 20.87 | 49.69 | 54.02 |
| 11 | 2.00 | 5.20 | 6.00 | 6.00 | 6.00 | 2.00 | 2.00 |
| 12 | 11.64 | 8.76 | 9.15 | 12.42 | 12.18 | 5.68 | 5.04 |
| 13 | 25.00 | 7.00 | 11.60 | 7.60 | 5.40 | 16.40 | 12.00 |
| 14 | 23.50 | 11.00 | 16.00 | 10.75 | 6.75 | 35.00 | |
| 15 | 15.68 | 6.42 | 55.92 | 11.54 | 10.88 | 58.92 | 17.05 |
| 16 | 95.83 | 64.87 | 68.75 | 74.24 | 81.40 | 37.14 | |
| 17 | 0.60 | 0.55 | 2.88 | 1.36 | 0.89 | 2.49 | 0.40 |

Table 20. Provided are the values of each of the parameters (as described above) measured in Barley accessions (line) under low N growth conditions. Growth conditions are specified in the experimental procedure section.

TABLE 21

Measured parameters of correlation IDs in Barley accessions (1-8) under drought and recovery conditions

| Ecotype/Treatment | Line-1 | Line-2 | Line-3 | Line-4 | Line-5 | Line-6 | Line-7 | Line-8 |
|---|---|---|---|---|---|---|---|---|
| 1 | 41.33 | 33.57 | 36.57 | 40.50 | 45.07 | 39.73 | 38.33 | 36.17 |
| 2 | 6.15 | 5.05 | 3.20 | 3.28 | 4.76 | 3.55 | 4.52 | 3.38 |
| 3 | 0.21 | 0.21 | | | | 0.17 | | |
| 4 | 1.90 | 1.52 | 1.17 | 1.95 | 1.90 | 1.22 | 1.75 | 1.58 |
| 5 | 170.00 | 267.50 | 111.00 | 205.33 | 153.60 | 252.50 | 288.40 | 274.50 |
| 6 | 5.55 | 9.80 | 3.55 | 7.20 | 5.28 | 7.75 | 9.92 | 10.25 |
| 7 | 0.47 | 0.66 | 0.53 | 0.69 | 0.53 | 0.69 | 0.69 | 0.75 |
| 8 | 75.00 | 71.00 | 65.00 | | 66.75 | 90.00 | 90.00 | |
| 9 | 0.27 | 0.86 | 0.73 | 0.88 | 0.40 | 0.94 | 0.70 | 0.71 |
| 10 | 0.07 | 0.10 | 0.06 | 0.07 | 0.16 | 0.06 | 0.10 | 0.05 |
| 11 | 33.33 | 27.00 | 31.33 | 34.17 | 31.33 | 30.33 | 28.67 | 38.67 |
| 12 | 46.00 | 52.80 | 35.00 | 38.00 | 45.20 | 48.00 | 37.67 | 41.20 |
| 13 | 0.01 | 0.01 | 0.01 | 0.01 | 0.03 | 0.02 | 0.01 | 0.01 |
| 14 | 80.60 | 53.40 | 55.87 | | 43.21 | 69.78 | 45.49 | 76.51 |
| 15 | 77.52 | 60.19 | 27.13 | 18.62 | 117.42 | 70.72 | 37.34 | 25.56 |
| 16 | 2.07 | 1.48 | 1.12 | 1.87 | 1.67 | 1.68 | 1.62 | 0.85 |
| 17 | 21.67 | 20.33 | 22.00 | 24.00 | 20.67 | 18.33 | 21.00 | 20.33 |
| 18 | 0.09 | −0.12 | 0.00 | 0.01 | 0.04 | −0.07 | 0.01 | 0.00 |
| 19 | 16.70 | 16.85 | 13.27 | 13.55 | 14.19 | 15.64 | 15.66 | 17.49 |
| 20 | 4.20 | 4.36 | 7.60 | 8.44 | 4.92 | 3.43 | 6.90 | 5.80 |
| 21 | 17.72 | 24.24 | 18.20 | 18.00 | 19.50 | 15.00 | 23.40 | 28.16 |
| 22 | 8.64 | 9.07 | 7.82 | 7.32 | 8.74 | 7.62 | 6.98 | 8.05 |
| 23 | 2.00 | 2.00 | 1.67 | 1.67 | 2.00 | 1.67 | 2.33 | 1.00 |
| 24 | 11.68 | 9.04 | 10.92 | 10.16 | 10.32 | 8.78 | 13.00 | 7.44 |
| 25 | 8.33 | 8.67 | 7.33 | 7.67 | 6.67 | 6.67 | 7.67 | 6.67 |

Table 21.

TABLE 22

Measured parameters of correlation IDs in Barley accessions under drought and recovery conditions additional lines (9-15)

| Ecotype/Treatment | Line-9 | Line-10 | Line-11 | Line-12 | Line-13 | Line-14 | Line-15 |
|---|---|---|---|---|---|---|---|
| 1 | 42.13 | 31.77 | 33.47 | 42.37 | 42.27 | 36.77 | 40.63 |
| 2 | 5.67 | 3.31 | 2.65 | 5.12 | 6.86 | 3.11 | 3.74 |
| 3 | 0.25 | | | 0.13 | 0.19 | 0.22 | |
| 4 | 1.88 | 1.73 | 1.00 | 0.90 | 0.90 | 1.43 | 0.83 |
| 5 | 348.50 | 358.00 | 521.39 | 71.50 | 160.13 | 376.67 | 105.00 |
| 6 | 8.50 | 14.03 | 17.52 | 2.05 | 5.38 | 11.00 | 2.56 |
| 7 | 0.60 | 0.81 | 0.87 | 0.29 | 0.44 | 0.78 | 0.41 |
| 8 | 90.00 | | | 90.00 | 81.60 | 90.00 | |
| 9 | 0.77 | 0.80 | 0.92 | 0.39 | 0.88 | −0.13 | 0.20 |
| 10 | 0.10 | 0.06 | 0.06 | 0.18 | 0.15 | 0.02 | 0.44 |
| 11 | 33.67 | 28.43 | 27.50 | 25.00 | 27.00 | 31.00 | 22.33 |
| 12 | 40.80 | 49.86 | 43.00 | 47.40 | 64.80 | 52.60 | 32.00 |
| 13 | 0.01 | 0.01 | 0.02 | 0.02 | 0.01 | 0.01 | 0.03 |
| 14 | 87.41 | | | 58.32 | 80.58 | 73.09 | |
| 15 | 66.18 | 22.13 | 41.12 | 116.95 | 84.10 | 37.46 | 98.86 |
| 16 | 1.45 | 1.38 | 0.82 | 0.58 | 0.63 | 1.07 | 0.70 |
| 17 | 21.67 | 19.67 | 16.67 | 17.00 | 15.17 | 27.00 | 15.00 |
| 18 | −0.06 | 0.04 | 0.05 | 0.00 | −0.07 | 0.03 | −0.06 |
| 19 | 16.00 | 18.31 | 17.42 | 14.23 | 14.81 | 16.54 | 12.72 |
| 20 | 8.55 | 9.67 | 5.42 | 3.05 | 4.07 | 3.72 | 3.21 |
| 21 | 21.96 | 33.03 | 34.80 | 11.73 | 18.78 | 21.00 | 9.88 |
| 22 | 6.06 | 6.73 | 9.55 | 7.84 | 7.81 | 8.35 | 5.47 |
| 23 | 2.33 | 3.00 | 1.00 | 1.00 | 1.00 | 1.00 | 1.00 |
| 24 | 13.92 | 11.00 | 6.78 | 8.45 | 9.15 | 5.12 | 16.13 |
| 25 | 6.00 | 8.67 | 7.67 | 6.33 | 7.00 | 7.00 | 6.67 |

Table 22.

TABLE 23

Measured parameters of correlation IDs in Barley accessions for maintenance of performance under drought conditions

| Ecotype/Treatment | Line-1 | Line-2 | Line-3 | Line-4 | Line-5 | Line-6 | Line-7 | Line-8 |
|---|---|---|---|---|---|---|---|---|
| 1 | 0.98 | 0.72 | 1.3 | 1.06 | 1.03 | 0.95 | 0.82 | 0.93 |
| 2 | 0.61 | 0.45 | 0.59 | 0.67 | 0.41 | 0.54 | 0.75 | 0.65 |
| 3 | 0.93 | 0.71 | 0 | 0 | 0 | 0.65 | 0 | 0.92 |
| 4 | 0.6 | 0.5 | 0.47 | 0.68 | 0.46 | 0.47 | 0.58 | 0.62 |
| 5 | 0.12 | 0.22 | 0.11 | 0.19 | 0.17 | 0.21 | 0.22 | 0.24 |
| 6 | 0.08 | 0.17 | 0.06 | 0.14 | 0.15 | 0.14 | 0.15 | 0.2 |
| 7 | 0.54 | 0.79 | 0.58 | 0.75 | 0.7 | 0.77 | 0.75 | 0.83 |
| 8 | 0 | 1.12 | 1.3 | 0 | 1 | 1.06 | 1.37 | 1.22 |
| 9 | 0.51 | 0.61 | 0.67 | 0.72 | 0.61 | 0.59 | 0.7 | 0.63 |
| 9 | 0.51 | 0.61 | 0.67 | 0.72 | 0.61 | 0.59 | 0.7 | 0.63 |

TABLE 23-continued

Measured parameters of correlation IDs in Barley accessions for maintenance of performance under drought conditions

| Ecotype/ Treatment | Line-1 | Line-2 | Line-3 | Line-4 | Line-5 | Line-6 | Line-7 | Line-8 |
|---|---|---|---|---|---|---|---|---|
| 10 | 1.55 | 0.97 | 1.12 | 0.56 | 1.72 | 1.97 | 0.67 | 0.96 |
| 11 | 0.78 | 0.58 | 0.9 | 0 | 0.65 | 0.56 | 0.78 | 0.83 |
| 12 | 0.94 | 0.44 | 0.66 | 0.37 | 0.71 | 1.06 | 0.5 | 0.62 |
| 13 | 1.1 | 1 | 1.02 | 1.67 | 0.8 | 0.81 | 1.13 | 0.34 |
| 14 | 0.66 | 0.74 | 1.16 | 0.78 | 0.76 | 0.76 | 0.68 | 0.77 |
| 15 | 0.83 | 0.82 | 0.86 | 0.77 | 0.78 | 0.94 | 0.83 | 0.89 |
| 16 | 0.73 | 0.96 | 1.11 | 1.3 | 0.83 | 0.62 | 0.87 | 1.12 |
| 17 | 0.16 | 0.23 | 0.19 | 0.23 | 0.25 | 0.18 | 0.23 | 0.34 |
| 18 | 0.75 | 0.77 | 0.68 | 0.67 | 0.87 | 0.66 | 0.75 | 0.74 |
| 19 | 1.87 | 1.57 | 1.72 | 1.8 | 1.6 | 1.61 | 1.63 | 1.59 |
| 19 | 1.87 | 1.57 | 1.72 | 1.8 | 1.6 | 1.61 | 1.63 | 1.59 |
| 20 | 1.09 | 0.74 | 0.79 | 0.88 | 0.71 | 0.65 | 0.85 | 0.77 |

Table 23. Provided are the values of each of the parameters (as described above) measured in Barley accessions (line) for maintenance of performance under drought (calculated as % of change under drought vs normal growth conditions). Growth conditions are specified in the experimental procedure section.

20

TABLE 24

Additional measured parameters of correlation IDs in Barley accessions for maintenance of performance under drought conditions

| Ecotype/ Treatment | Line-9 | Line-10 | Line-11 | Line-12 | Line-13 | Line-14 | Line-15 |
|---|---|---|---|---|---|---|---|
| 1 | 0.93 | 0.8 | 0.94 | 0.96 | 1.01 | 0.93 | 1.03 |
| 2 | 0.77 | 0.8 | 0.68 | 0.42 | 0.65 | 0.52 | 0.46 |
| 3 | 1.01 | 0 | 0 | 0.94 | 0 | 0.7 | 0 |
| 4 | 0.74 | | 0.81 | 0.72 | 0.37 | 0.4 | |
| 5 | 0.25 | 0.58 | 0.43 | 0.1 | 0.1 | 0.28 | 0.43 |
| 6 | 0.14 | 0.47 | 0.32 | 0.07 | 0.07 | 0.2 | 0.32 |
| 7 | 0.67 | 0.92 | 0.93 | 0.41 | 0.5 | 0.87 | 0.82 |
| 8 | 0 | | | 1.2 | 1 | | |
| 9 | 0.66 | 0.87 | 0.86 | 0.64 | 0.79 | 0.56 | 0.51 |
| 9 | 0.66 | 0.87 | 0.86 | 0.64 | 0.79 | 0.56 | 0.51 |
| 10 | 1.14 | 1.08 | 1.38 | 1.84 | 1.31 | 2.06 | 1.46 |
| 11 | 0.5 | | 0 | 0 | 0.78 | 0.55 | |
| 12 | 0.88 | 0.87 | 0.94 | 0.77 | 0.85 | 1.06 | 0.68 |
| 13 | 0.85 | 0.58 | 0.07 | 1.06 | 0.3 | 0.44 | 0.93 |
| 14 | 1.12 | 0.56 | 0.42 | 0.82 | 0.43 | 0.71 | 0.8 |
| 15 | 0.78 | 0.94 | 0.88 | 0.77 | 0.86 | 0.97 | 0.78 |
| 16 | 1.09 | 1.09 | 0.92 | 0.49 | 0.65 | 0.99 | 0.52 |
| 17 | 0.22 | 0.68 | 0.55 | 0.18 | 0.18 | 0.27 | 0.25 |
| 18 | 0.74 | 0.86 | 0.85 | 0.79 | 0.72 | 0.72 | 0.88 |
| 19 | 1.75 | 1.33 | 1.62 | 1.33 | 1.4 | 1.22 | 1.96 |
| 19 | 1.75 | 1.33 | 1.62 | 1.33 | 1.4 | 1.22 | 1.96 |
| 20 | 0.58 | 0.96 | 0.88 | 0.95 | 0.78 | 0.66 | 0.87 |

Table 24. Provided are the values of each of the parameters (as described above) measured in Barley accessions (line) for maintenance of performance under drought (calculated as % of change under drought vs normal growth conditions). Growth conditions are specified in the experimental procedure section.

50

TABLE 25

Correlation between the expression level of selected genes of some embodiments of the invention in various tissues and the phenotypic performance under low nitrogen, normal or drought stress conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LGP20 | 0.74 | 1.42E−02 | 5 | 30 | LGP20 | 0.90 | 4.15E−04 | 5 | 19 |
| LGP20 | 0.74 | 1.43E−02 | 5 | 3 | LGP20 | 0.76 | 1.00E−02 | 5 | 37 |
| LGP20 | 0.71 | 2.05E−02 | 5 | 6 | LGP21 | 0.81 | 1.49E−02 | 6 | 17 |
| LGP21 | 0.85 | 7.00E−03 | 4 | 21 | LGP21 | 0.76 | 1.74E−02 | 2 | 18 |
| LGP21 | 0.92 | 4.54E−04 | 2 | 26 | LGP21 | 0.85 | 3.81E−03 | 2 | 17 |
| LGP21 | 0.82 | 7.25E−03 | 3 | 19 | LGP21 | 0.86 | 3.15E−03 | 3 | 3 |
| LGP21 | 0.86 | 2.94E−03 | 3 | 37 | LGP21 | 0.76 | 1.73E−02 | 3 | 6 |
| LGP22 | 0.74 | 3.60E−02 | 6 | 33 | LGP22 | 0.78 | 2.17E−02 | 6 | 12 |

TABLE 25-continued

Correlation between the expression level of selected genes of some embodiments of the invention in various tissues and the phenotypic performance under low nitrogen, normal or drought stress conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LGP22 | 0.72 | 1.85E−02 | 5 | 32 | LGP22 | 0.75 | 2.00E−02 | 2 | 26 |
| LGP83 | 0.75 | 2.11E−02 | 3 | 32 | MGP3 | 0.80 | 1.80E−02 | 6 | 21 |
| MGP3 | 0.78 | 2.14E−02 | 6 | 12 | MGP3 | 0.72 | 2.86E−02 | 3 | 7 |
| MGP3 | 0.72 | 2.81E−02 | 3 | 35 | | | | | |

Table 25. Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal, low nitrogen and drought conditions across barley varieties. P = p value.

TABLE 26

Correlation between the expression level of selected genes of some embodiments of the invention in various tissues and the phenotypic performance under low nitrogen and normal growth conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LGP22 | 0.75 | 1.32E−02 | 5 | 15 | MGP3 | 0.70 | 2.33E−02 | 2 | 11 |
| MGP3 | 0.73 | 1.65E−02 | 3 | 9 | MGP3 | 0.81 | 4.46E−03 | 6 | 11 |
| MGP3 | 0.86 | 1.29E−03 | 5 | 17 | MGP3 | 0.71 | 2.02E−02 | 4 | 5 |
| MGP3 | 0.79 | 6.70E−03 | 4 | 11 | MGP3 | 0.92 | 1.99E−04 | 1 | 17 |

Table 26. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient; "P" = p value.

TABLE 27

Correlation between the expression level of selected genes of some embodiments of the invention in various tissues and the phenotypic performance under drought stress conditions across Barley accessions

| Gene Name | R | P value | Exp. set | Corr. Set ID | Gene Name | R | P value | Exp. set | Corr. Set ID |
|---|---|---|---|---|---|---|---|---|---|
| LGP20 | 0.73 | 9.89E−02 | 1 | 11 | LGP20 | 0.78 | 2.31E−02 | 3 | 20 |
| LGP20 | 0.75 | 3.21E−02 | 5 | 23 | LGP20 | 0.83 | 4.21E−02 | 5 | 8 |
| LGP20 | 0.86 | 2.70E−03 | 4 | 20 | LGP20 | 0.82 | 6.90E−03 | 4 | 23 |
| LGP21 | 0.80 | 5.74E−02 | 1 | 10 | LGP21 | 0.72 | 1.04E−01 | 1 | 9 |
| LGP21 | 0.73 | 6.35E−02 | 2 | 25 | LGP21 | 0.77 | 1.44E−02 | 4 | 20 |
| LGP21 | 0.74 | 2.36E−02 | 4 | 18 | LGP22 | 0.73 | 1.03E−01 | 1 | 19 |
| LGP22 | 0.83 | 1.12E−02 | 3 | 22 | LGP22 | 0.75 | 3.54E−02 | 5 | 23 |
| LGP22 | 0.80 | 9.95E−03 | 4 | 20 | LGP22 | 0.75 | 2.08E−02 | 4 | 23 |
| LGP22 | 0.71 | 3.20E−02 | 4 | 24 | LGP83 | 0.73 | 1.03E−01 | 1 | 22 |
| LGP83 | 0.75 | 8.58E−02 | 1 | 18 | LGP83 | 0.71 | 4.89E−02 | 3 | 13 |
| LGP83 | 0.71 | 7.35E−02 | 2 | 17 | LGP83 | 0.83 | 1.96E−02 | 2 | 11 |
| LGP83 | 0.79 | 2.01E−02 | 5 | 19 | MGP3 | 0.77 | 7.54E−02 | 1 | 7 |
| MGP3 | 0.82 | 4.43E−02 | 1 | 12 | MGP3 | 0.85 | 3.21E−02 | 1 | 25 |
| MGP3 | 0.74 | 9.14E−02 | 1 | 6 | MGP3 | 0.74 | 9.23E−02 | 1 | 21 |
| MGP3 | 0.83 | 1.04E−02 | 3 | 20 | MGP3 | 0.85 | 7.17E−03 | 3 | 12 |
| MGP3 | 0.80 | 9.31E−03 | 6 | 19 | MGP3 | 0.80 | 1.02E−02 | 6 | 2 |
| MGP3 | 0.74 | 2.38E−02 | 6 | 15 | MGP3 | 0.78 | 3.89E−02 | 2 | 22 |
| MGP3 | 0.78 | 3.67E−02 | 2 | 5 | MGP3 | 0.73 | 6.49E−02 | 2 | 6 |
| MGP3 | 0.92 | 3.74E−03 | 2 | 13 | MGP3 | 0.74 | 3.60E−02 | 5 | 12 |
| MGP3 | 0.81 | 1.51E−02 | 5 | 15 | | | | | |

Table 27. Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal, low nitrogen and drought conditions across barley varieties. P = p value.

TABLE 28

Correlation between the expression level of selected genes of some embodiments of the invention in various tissues and the phenotypic performance of maintenance of performance under drought conditions across Barley accessions

| Gene Name | R | P value | Exp. set | Corr. Set ID | Gene Name | R | P value | Exp. set | Corr. Set ID |
|---|---|---|---|---|---|---|---|---|---|
| LGP20 | 0.78 | 6.53E−02 | 1 | 3 | LGP20 | 0.75 | 3.11E−02 | 5 | 6 |
| LGP20 | 0.75 | 3.38E−02 | 5 | 5 | LGP20 | 0.78 | 1.23E−02 | 4 | 2 |
| LGP21 | 0.91 | 1.06E−02 | 1 | 16 | LGP21 | 0.72 | 6.86E−02 | 2 | 20 |
| LGP21 | 0.79 | 1.21E−02 | 4 | 2 | LGP22 | 0.82 | 7.19E−03 | 4 | 2 |
| LGP83 | 0.71 | 3.19E−02 | 6 | 16 | LGP83 | 0.83 | 8.43E−03 | 2 | 16 |
| LGP83 | 0.76 | 2.94E−02 | 5 | 18 | MGP3 | 0.92 | 1.86E−02 | 1 | 6 |
| MGP3 | 0.91 | 1.10E−02 | 1 | 17 | MGP3 | 0.89 | 1.58E−02 | 1 | 15 |
| MGP3 | 0.79 | 6.40E−02 | 1 | 20 | MGP3 | 0.90 | 1.58E−02 | 1 | 5 |
| MGP3 | 0.96 | 2.23E−03 | 1 | 9 | MGP3 | 0.76 | 7.71E−02 | 1 | 18 |
| MGP3 | 0.80 | 5.49E−02 | 1 | 7 | MGP3 | 0.71 | 5.03E−02 | 3 | 16 |
| MGP3 | 0.77 | 2.60E−02 | 3 | 17 | MGP3 | 0.84 | 1.90E−02 | 3 | 8 |
| MGP3 | 0.73 | 2.60E−02 | 6 | 18 | MGP3 | 0.71 | 3.16E−02 | 6 | 3 |
| MGP3 | 0.75 | 5.16E−02 | 2 | 10 | MGP3 | 0.89 | 1.80E−02 | 5 | 8 |
| MGP3 | 0.75 | 5.24E−02 | 5 | 11 | | | | | |

Table 28. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient; "P" = p value.

Example 5

Production of Barley Transcriptome and High Throughput Correlation Analysis Using 60K Barley Oligonucleotide Micro-Array In order to produce a high throughput correlation analysis, the present inventors utilized a Barley oligonucleotide micro-array, produced by Agilent Technologies [chem. (dot) agilent (dot) com/Scripts/PDS (dot) asp?1Page=50879]. The array oligonucleotide represents about 33,777 Barley genes and transcripts. In order to define correlations between the levels of RNA expression and yield or vigor related parameters, various plant characteristics of 55 different Barley accessions were analyzed. Same accessions were subjected to RNA expression analysis. The correlation between the RNA levels and the characterized parameters was analyzed using Pearson correlation test [davidmlane (dot) com/hyperstat/A34739 (dot) html].

Experimental Procedures

Four tissues at different developmental stages [leaf, flag leaf, spike and peduncle], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 29 below.

TABLE 29

Barley transcriptome expression sets

| Expression Set | Set ID |
|---|---|
| Flag leaf at booting stage under normal conditions | 1 |
| Spike at grain filling stage under normal conditions | 2 |
| Spike at booting stage under normal conditions | 3 |
| stem at booting stage under normal conditions | 4 |

Table 29: Provided are the identification (ID) letters of each of the Barley expression sets.

Barley yield components and vigor related parameters assessment—55 Barley accessions in 5 repetitive blocks (named A, B, C, D and E), each containing 48 plants per plot were grown in field. Plants were phenotyped on a daily basis. Harvest was conducted while 50% of the spikes were dry to avoid spontaneous release of the seeds. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

At the end of the experiment (50% of the spikes were dry) all spikes from plots within blocks A-E were collected, and the following measurements were performed:

% reproductive tiller percentage—The percentage of reproductive tillers at flowering calculated using Formula XXVI above.

1000 grain weight (gr)—At the end of the experiment all grains from all plots were collected and weighted and the weight of 1000 were calculated.

Avr. (average) seedling dry weight (gr)—Weight of seedling after drying/number of plants.

Avr. shoot dry weight (gr)—Weight of Shoot at flowering stage after drying/number of plants.

Avr. spike weight (g)—Calculate spikes dry weight after drying at 70° C. in oven for 48 hours, at harvest/num of spikes.

Spike weight—The biomass and spikes weight of each plot was separated, measured and divided by the number of plants.

Dry weight—total weight of the vegetative portion above ground (excluding roots) after drying at 70° C. in oven for 48 hours at two time points at the Vegetative growth (30 days after sowing) and at harvest.

Vegetative dry weight (g)—Total weight of the vegetative portion above ground (excluding roots) after drying at 70° C. in oven for 48 hours. The biomass weight of each plot was measured and divided by the number of plants.

Field spike length (cm)—Measure spike length without the Awns at harvest.

Grain Area (cm$^2$)—A sample of ~200 grains was weighted, photographed and images were processed using the below described image processing system. The grain area was measured from those images and was divided by the number of grains.

Grain Length and Grain width (cm)—A sample of ~200 grains was weighted, photographed and images were processed using the below described image processing system. The sum of grain lengths and width (longest axis) was measured from those images and was divided by the number of grains.

Grain Perimeter (cm)—A sample of ~200 grains was weighted, photographed and images were processed using the below described image processing system. The sum of grain perimeter was measured from those images and was divided by the number of grains.

Grains per spike—The total number of grains from 5 spikes that were manually threshed was counted. The average grain per spike was calculated by dividing the total grain number by the number of spikes.

Grain yield per plant (gr)—The total grains from 5 spikes that were manually threshed was weighted. The grain yield was calculated by dividing the total weight by the plants number.

Grain yield per spike (gr)—The total grains from 5 spikes that were manually threshed was weighted. The grain yield was calculated by dividing the total weight by the spike number.

Growth habit scoring—At growth stage 10 (booting), each of the plants was scored for its growth habit nature. The scale that was used was "1" for prostate nature till "9" for erect.

Harvest Index (for barley)—The harvest index was calculated using Formula XVIII above.

Number of days to anthesis—Calculated as the number of days from sowing till 50% of the plot reach anthesis.

Number of days to maturity—Calculated as the number of days from sowing till 50% of the plot reach maturity.

Plant height—At harvest stage (50% of spikes were dry), each of the plants was measured for its height using measuring tape. Height was measured from ground level to top of the longest spike excluding awns.

Reproductive period—Calculated number of days from booting to maturity.

Reproductive tillers number—Number of Reproductive tillers with flag leaf at flowering.

Relative Growth Rate (RGR) of vegetative dry weight was performed using Formula VII above.

Spike area (cm$^2$)—At the end of the growing period 5 'spikes' were, photographed and images were processed using the below described image processing system. The 'spike' area was measured from those images and was divided by the number of 'spikes'.

Spike length and width analysis—At the end of the experiment the length and width of five chosen spikes per plant were measured using measuring tape excluding the awns.

Spike max width—Measured by imaging the max width of 10-15 spikes randomly distributed within a pre-defined 0.5 m$^2$ of a plot. Measurements were carried out at the middle of the spike.

Spikes Index—The Spikes index was calculated using Formula XXVII above.

Spike number analysis—The spikes per plant were counted at harvest.

No. of tillering—tillers were counted per plant at heading stage (mean per plot).

Total dry mater per plant—Calculated as Vegetative portion above ground plus all the spikes dry weight per plant.

TABLE 30

Barley correlated parameters (vectors)

| Correlated parameter with | Correlation ID |
|---|---|
| % reproductive tiller percentage (%) | 1 |
| 1000 grain weight (gr) | 2 |
| Avr spike dry weight per plant (H) (g) | 3 |
| Avr vegetative dry weight per plant (H) (g) | 4 |
| Avr shoot dry weight (F) (gr) | 5 |
| Avr spike weight (H) (g) | 6 |
| Grain Perimeter (cm) | 7 |
| Grain Area (cm$^2$) | 8 |
| Grain Length (cm) | 9 |
| Grain width (cm) | 10 |
| Grains per spike (number) | 11 |
| Grain yield per plant (gr) | 12 |
| Grain yield per spike (gr) | 13 |
| Growth habit (scores 1-9) | 14 |
| Harvest Index (value) | 15 |
| Number days to anthesis (days) | 16 |
| Number days to maturity (days) | 17 |
| Plant height (cm) | 18 |
| RGR | 19 |
| Reproductive period (days) | 20 |
| Reproductive tillers number (F) (number) | 21 |
| Spike area (cm$^2$) | 22 |
| Spike length (cm) | 23 |
| Spike width (cm) | 24 |
| Spike max width (cm) | 25 |
| Spike index (cm) | 26 |
| Spikes per plant (numbers) | 27 |
| Tillering (Heading) (number) | 28 |
| Total dry matter per plant (kg) | 29 |
| Avr seedling dry weight (gr) | 30 |
| Field spike length (cm) | 31 |

Table 30. Provided are the Barley correlated parameters (vectors).

Experimental Results 55 different Barley accessions were grown and characterized for 31 parameters as described above. Among the 55 lines and ecotypes, 27 are *Hordeum spontaneum* and 19 are *Hordeum vulgare*. The average for each of the measured parameters was calculated using the JMP software and values are summarized in Tables 31 and 32 below. Subsequent correlation analysis between the various transcriptome expression sets (Table 29) and the average parameters was conducted. Correlations were calculated across all 55 lines and ecotypes. For phenotypic data of all 55 lines and ecotypes see Tables 31-38. For correlation data of all 55 lines and ecotypes see Table 46. For phenotypic data of *Hordeum spontaneum* lines and ecotypes see Tables 39-42. For correlation data of *Hordeum spontaneum* lines and ecotypes see Table 47. For phenotypic data of *Hordeum vulgare* lines and ecotypes see Tables 43-45. For correlation data of *Hordeum vulgare* lines and ecotypes see Table 48.

TABLE 31

Measured parameters of correlation IDs in Barley accessions (1-7)

| Ecotype/Treatment | Line-1 | Line-2 | Line-3 | Line-4 | Line-5 | Line-6 | Line-7 |
|---|---|---|---|---|---|---|---|
| 1 | 4.31 | 18.25 | 9.16 | 40.15 | 33.22 | NA | 7.86 |
| 2 | 50.11 | 49.98 | 31.77 | 52.43 | 47.22 | 49.33 | 53.02 |
| 3 | 80.88 | 60.47 | 36.42 | 69.45 | 61.03 | 63.22 | 88.26 |
| 4 | 46.33 | 85.03 | 82.74 | 127.37 | 79.51 | 82.95 | 68.92 |
| 5 | 11.34 | 52.57 | 48.28 | 126.89 | 60.56 | NA | 31.40 |
| 6 | 3.33 | 1.56 | 2.37 | 3.11 | 3.18 | 2.85 | 3.37 |
| 7 | 2.62 | 2.41 | 2.31 | 2.67 | 2.62 | 2.59 | 2.59 |
| 8 | 0.30 | 0.28 | 0.24 | 0.30 | 0.29 | 0.29 | 0.30 |
| 9 | 1.09 | 0.97 | 0.92 | 1.07 | 1.09 | 1.07 | 1.05 |
| 10 | 0.40 | 0.41 | 0.35 | 0.41 | 0.39 | 0.39 | 0.41 |
| 11 | 56.51 | 21.05 | 45.16 | 44.35 | 47.12 | 43.51 | 55.88 |
| 12 | 64.98 | 37.47 | NA | 51.69 | 49.15 | 46.44 | NA |
| 13 | 2.91 | 1.02 | 1.37 | 2.33 | 2.23 | 2.14 | 2.85 |
| 14 | 4.20 | 1.00 | 1.40 | 2.60 | 2.60 | 1.00 | 2.60 |
| 15 | 0.51 | 0.25 | NA | 0.26 | 0.35 | 0.32 | NA |
| 16 | 90.80 | 124.40 | 122.00 | NA | 122.00 | NA | 102.60 |
| 17 | 148.00 | 170.00 | 157.00 | 170.00 | 167.40 | 170.00 | 158.80 |
| 18 | 83.97 | 79.87 | 99.04 | 122.46 | 108.03 | 87.00 | 97.03 |
| 19 | 2.45 | 3.96 | 3.91 | 4.75 | 4.12 | NA | 3.24 |
| 20 | 57.20 | 45.60 | 35.00 | NA | 48.00 | NA | 56.20 |
| 21 | 1.00 | 9.20 | 5.00 | 19.20 | 14.63 | NA | 2.80 |
| 22 | 9.90 | 7.82 | 9.68 | 11.07 | 10.17 | 9.98 | 9.94 |
| 23 | 9.49 | 10.26 | 7.88 | 7.97 | 8.42 | 8.12 | 7.61 |
| 24 | 1.23 | 0.87 | 1.44 | 1.68 | 1.47 | 1.51 | 1.57 |
| 25 | 1.41 | 1.05 | 1.59 | 1.79 | 1.60 | 1.61 | 1.70 |
| 26 | 0.64 | 0.42 | 0.30 | 0.35 | 0.44 | 0.43 | 0.56 |
| 27 | 45.27 | 56.27 | 31.50 | 32.42 | 35.40 | 36.73 | 36.93 |
| 28 | 24.00 | 48.70 | 52.00 | 47.60 | 45.00 | NA | 35.20 |
| 29 | 127.22 | 145.50 | 119.15 | 196.82 | 140.54 | 146.17 | 157.18 |
| 30 | 0.05 | 0.06 | 0.04 | 0.05 | 0.05 | 0.05 | 0.07 |
| 31 | 9.57 | NA | 7.66 | 7.93 | 8.13 | NA | 7.21 |

Table 31. Provided are the values of each of the parameters measured in Barley accessions (1-7) according to the correlation identifications (see Table 30). "NA" = not available.

TABLE 32

Barley accessions (8-14), additional measured parameters

| Ecotype/Treatment | Line-8 | Line-9 | Line-10 | Line-11 | Line-12 | Line-13 | Line-14 |
|---|---|---|---|---|---|---|---|
| 1 | 16.67 | 5.64 | 5.29 | 18.34 | 4.03 | 8.83 | 4.82 |
| 2 | 61.33 | 49.97 | 51.70 | 56.46 | 53.97 | 50.36 | 56.81 |
| 3 | 91.89 | 99.05 | 66.99 | 60.22 | 87.61 | 71.76 | 76.71 |
| 4 | 82.88 | 56.80 | 64.14 | 54.23 | 73.23 | 49.50 | 47.63 |
| 5 | 44.57 | 9.71 | 38.18 | 46.74 | 42.32 | 11.62 | 9.33 |
| 6 | 4.13 | 3.47 | 3.15 | 1.88 | 3.35 | 3.60 | 3.24 |
| 7 | 2.78 | 2.66 | 2.63 | 2.28 | 2.54 | 2.37 | 2.71 |
| 8 | 0.33 | 0.29 | 0.30 | 0.28 | 0.30 | 0.27 | 0.32 |
| 9 | 1.15 | 1.09 | 1.08 | 0.88 | 1.03 | 0.96 | 1.12 |
| 10 | 0.42 | 0.39 | 0.39 | 0.45 | 0.42 | 0.41 | 0.41 |
| 11 | 58.33 | 56.03 | 59.08 | 27.27 | 55.87 | 61.53 | 50.80 |
| 12 | 78.18 | 79.86 | 54.34 | 46.37 | 71.89 | 56.24 | 61.63 |
| 13 | 3.47 | 2.60 | 2.84 | 1.51 | 2.84 | 2.98 | 2.85 |
| 14 | 1.00 | 5.00 | 3.00 | 1.00 | 1.00 | 2.20 | 3.00 |
| 15 | 0.45 | 0.51 | 0.41 | 0.40 | 0.45 | 0.48 | 0.50 |
| 16 | 111.60 | 86.80 | 106.20 | 117.80 | 111.60 | 85.40 | 90.00 |
| 17 | 156.20 | 159.60 | 157.00 | 162.20 | 159.60 | 157.00 | 150.50 |
| 18 | 104.01 | 70.78 | 98.11 | 57.88 | 94.52 | 73.20 | 78.65 |
| 19 | 3.82 | 2.30 | 3.60 | 3.83 | 3.63 | 2.43 | 2.26 |
| 20 | 44.60 | 72.80 | 50.80 | 44.40 | 46.00 | 71.60 | 61.50 |
| 21 | 6.30 | 1.20 | 2.10 | 10.00 | 2.60 | 1.63 | 1.00 |
| 22 | 9.89 | 9.58 | 11.19 | 8.76 | 10.49 | 10.83 | 11.23 |
| 23 | 6.39 | 7.73 | 8.45 | 10.55 | 7.60 | 7.87 | 9.42 |
| 24 | 1.83 | 1.50 | 1.57 | 0.96 | 1.63 | 1.63 | 1.43 |
| 25 | 1.93 | 1.59 | 1.71 | 1.17 | 1.75 | 1.72 | 1.58 |
| 26 | 0.51 | 0.64 | 0.51 | 0.53 | 0.55 | 0.61 | 0.62 |
| 27 | 32.10 | 48.53 | 29.80 | 50.80 | 32.40 | 26.80 | 42.42 |
| 28 | 38.50 | 21.50 | 36.10 | 57.25 | 42.20 | 19.13 | 21.63 |
| 29 | 178.63 | 155.85 | 131.13 | 114.45 | 160.84 | 121.26 | 124.34 |
| 30 | 0.05 | 0.06 | 0.05 | 0.06 | 0.06 | 0.06 | 0.05 |
| 31 | 5.65 | 7.94 | 8.55 | 10.59 | 7.44 | 7.36 | 9.60 |

Table 32. Provided are the values of each of the parameters measured in Barley accessions (8-14) according to the correlation identifications (see Table 30).

TABLE 33

Barley accessions (15-21), additional measured parameters

| Ecotype/Treatment | Line-15 | Line-16 | Line-17 | Line-18 | Line-19 | Line-20 | Line-21 |
|---|---|---|---|---|---|---|---|
| 1 | 29.49 | 5.01 | 3.74 | 11.42 | 5.13 | 4.07 | 6.62 |
| 2 | 57.98 | 51.44 | 58.07 | 53.45 | 48.66 | 39.48 | 41.96 |
| 3 | 81.14 | 77.90 | 68.17 | 70.73 | 54.13 | 48.72 | 64.51 |
| 4 | 66.51 | 77.50 | 81.58 | 67.92 | 81.05 | 66.73 | 91.79 |
| 5 | 47.56 | 30.93 | NA | 35.49 | 38.41 | NA | 41.56 |
| 6 | 3.12 | 1.69 | 1.66 | 3.50 | 1.16 | 2.95 | 1.36 |
| 7 | 2.90 | 2.28 | 2.42 | 2.65 | 2.16 | 2.16 | 2.45 |
| 8 | 0.34 | 0.27 | 0.30 | 0.30 | 0.26 | 0.23 | 0.23 |
| 9 | 1.22 | 0.89 | 0.96 | 1.08 | 0.83 | 0.85 | 0.94 |
| 10 | 0.41 | 0.42 | 0.44 | 0.40 | 0.42 | 0.39 | 0.36 |
| 11 | 45.48 | 24.77 | 21.15 | 59.72 | 17.46 | 63.19 | 19.87 |
| 12 | 64.82 | 56.43 | 49.68 | 54.97 | 40.33 | NA | NA |
| 13 | 2.39 | 1.21 | 1.18 | 2.93 | 0.83 | 2.38 | 0.78 |
| 14 | 1.00 | 1.00 | 3.80 | 3.80 | 1.00 | 3.40 | 1.00 |
| 15 | 0.44 | 0.36 | 0.33 | 0.40 | 0.29 | NA | NA |
| 16 | 113.20 | 113.40 | 98.50 | 109.60 | 119.40 | 98.80 | 119.40 |
| 17 | 158.00 | 170.00 | 170.00 | 155.20 | 170.00 | 156.20 | 170.00 |
| 18 | 90.73 | 64.27 | 82.73 | 94.12 | 63.47 | 102.12 | 94.80 |
| 19 | 3.89 | 3.46 | NA | 3.60 | 3.64 | NA | 3.74 |
| 20 | 44.80 | 56.60 | 71.50 | 45.60 | 50.60 | 57.40 | 50.60 |
| 21 | 17.00 | 3.00 | 1.00 | 3.80 | 4.20 | 1.00 | 4.63 |
| 22 | 7.89 | 9.15 | 8.57 | 11.30 | 7.04 | 8.37 | 7.28 |
| 23 | 6.68 | 12.05 | 10.74 | 8.60 | 8.94 | 6.03 | 10.99 |
| 24 | 1.45 | 0.88 | 0.92 | 1.56 | 0.92 | 1.67 | 0.76 |
| 25 | 1.52 | 1.03 | 1.10 | 1.72 | 1.08 | 1.75 | 0.90 |
| 26 | 0.55 | 0.50 | 0.45 | 0.51 | 0.39 | 0.42 | 0.41 |
| 27 | 39.73 | 71.33 | 65.40 | 33.27 | 82.47 | 32.87 | 73.13 |
| 28 | 59.80 | 62.50 | 31.20 | 34.00 | 78.90 | 26.50 | 69.88 |
| 29 | 147.66 | 155.41 | 149.76 | 138.64 | 135.18 | 115.45 | 156.29 |
| 30 | 0.05 | 0.04 | 0.05 | 0.04 | 0.06 | 0.05 | 0.05 |
| 31 | 6.23 | NA | NA | 8.57 | NA | 6.26 | NA |

Table 33. Provided are the values of each of the parameters measured in Barley accessions (15-21) according to the correlation identifications (see Table 30).

TABLE 34

Barley accessions (22-28), additional measured parameters

| Ecotype/Treatment | Line-22 | Line-23 | Line-24 | Line-25 | Line-26 | Line-27 | Line-28 |
|---|---|---|---|---|---|---|---|
| 1 | 3.51 | 7.34 | 31.12 | NA | NA | 11.07 | 21.67 |
| 2 | 18.60 | 42.65 | 39.67 | 24.43 | 28.42 | 28.40 | 23.52 |
| 3 | 33.60 | 33.22 | 52.10 | 33.28 | 47.69 | 52.78 | 52.54 |
| 4 | 50.17 | 45.22 | 67.20 | 43.40 | 79.51 | 61.09 | 59.71 |
| 5 | 174.82 | 8.39 | 51.83 | NA | NA | 38.46 | 38.79 |
| 6 | 0.90 | 3.09 | 1.22 | 0.91 | 0.92 | 1.08 | 0.95 |
| 7 | 2.65 | 2.19 | 2.44 | 2.90 | 2.62 | 2.66 | 2.68 |
| 8 | 0.25 | 0.25 | 0.25 | 0.27 | 0.25 | 0.25 | 0.24 |
| 9 | 1.11 | 0.88 | 0.96 | 1.20 | 1.07 | 1.08 | 1.11 |
| 10 | 0.31 | 0.39 | 0.37 | 0.32 | 0.32 | 0.33 | 0.31 |
| 11 | 16.30 | 60.49 | 17.54 | 12.00 | 20.01 | 20.00 | 17.01 |
| 12 | NA | NA | NA | NA | NA | NA | NA |
| 13 | 0.31 | 2.43 | 0.67 | 0.31 | 0.56 | 0.56 | 0.38 |
| 14 | 1.00 | 3.00 | 1.00 | 1.00 | 1.00 | 1.00 | 1.00 |
| 15 | NA | NA | NA | NA | NA | NA | NA |
| 16 | 95.60 | 90.00 | 111.00 | 83.60 | 122.00 | 111.40 | 109.20 |
| 17 | 133.00 | 161.40 | 145.80 | 140.20 | 153.00 | 143.00 | 140.40 |
| 18 | 90.49 | 88.53 | 90.10 | 92.47 | 99.08 | 91.69 | 94.67 |
| 19 | 5.01 | 2.12 | 3.97 | NA | NA | 3.67 | 3.68 |
| 20 | 37.40 | 71.40 | 34.80 | 56.60 | 31.00 | 31.60 | 31.20 |
| 21 | 1.88 | 1.00 | 15.50 | NA | NA | 7.10 | 15.70 |
| 22 | 4.98 | 11.56 | 6.52 | 5.39 | 8.16 | 8.08 | 5.73 |
| 23 | 8.58 | 9.02 | 8.63 | 7.96 | 10.20 | 10.52 | 8.35 |
| 24 | 0.68 | 1.53 | 0.88 | 0.81 | 0.97 | 0.92 | 0.78 |
| 25 | 0.79 | 1.68 | 1.01 | 0.88 | 1.05 | 1.01 | 0.90 |
| 26 | 0.41 | 0.42 | 0.44 | 0.44 | 0.38 | 0.46 | 0.47 |
| 27 | 88.07 | 20.53 | 48.53 | 51.33 | 65.80 | 55.80 | 65.60 |
| 28 | 55.25 | 14.00 | 48.50 | NA | NA | 69.00 | 76.40 |
| 29 | 83.76 | 78.44 | 119.30 | 76.68 | 127.20 | 113.88 | 112.25 |

TABLE 34-continued

Barley accessions (22-28), additional measured parameters

| Ecotype/Treatment | Line-22 | Line-23 | Line-24 | Line-25 | Line-26 | Line-27 | Line-28 |
|---|---|---|---|---|---|---|---|
| 30 | 0.03 | 0.06 | 0.05 | 0.05 | 0.04 | 0.05 | 0.05 |
| 31 | 9.74 | 9.06 | 8.69 | 8.90 | 10.13 | 10.61 | 9.60 |

Table 34. Provided are the values of each of the parameters measured in Barley accessions (22-28) according to the correlation identifications (see Table 30).

TABLE 35

Barley accessions (29-35), additional measured parameters

| Ecotype/Treatment | Line-29 | Line-30 | Line-31 | Line-32 | Line-33 | Line-34 | Line-35 |
|---|---|---|---|---|---|---|---|
| 1 | 3.93 | 16.51 | 3.19 | 10.55 | 26.51 | 15.15 | 4.28 |
| 2 | 45.71 | 26.47 | 23.14 | 27.64 | 29.37 | 27.74 | 42.12 |
| 3 | 83.98 | 47.05 | 48.92 | 47.26 | 48.82 | 46.56 | 89.21 |
| 4 | 45.36 | 60.37 | 67.39 | 67.12 | 61.35 | 59.03 | 71.31 |
| 5 | 10.63 | 29.60 | 14.28 | 37.74 | 39.23 | 34.46 | 41.16 |
| 6 | 2.99 | 0.85 | 0.85 | 0.89 | 1.10 | 1.09 | 2.93 |
| 7 | 2.77 | 2.66 | 2.57 | 2.93 | 3.16 | 2.99 | 2.97 |
| 8 | 0.30 | 0.25 | 0.24 | 0.29 | 0.33 | 0.29 | 0.30 |
| 9 | 1.13 | 1.09 | 1.06 | 1.23 | 1.33 | 1.27 | 1.16 |
| 10 | 0.39 | 0.32 | 0.32 | 0.33 | 0.34 | 0.32 | 0.39 |
| 11 | 56.85 | 18.19 | 13.50 | 12.83 | 14.49 | 13.72 | 54.84 |
| 12 | NA | NA | NA | NA | NA | NA | NA |
| 13 | 2.63 | 0.46 | 0.31 | 0.37 | 0.43 | 0.39 | 2.14 |
| 14 | 2.20 | 1.00 | 1.00 | 1.00 | 1.00 | 1.00 | 1.00 |
| 15 | NA | NA | NA | NA | NA | NA | NA |
| 16 | 89.20 | 104.00 | 89.20 | 97.80 | 113.60 | 109.20 | 110.40 |
| 17 | 151.60 | 140.20 | 140.40 | 140.40 | 145.80 | 143.00 | 156.20 |
| 18 | 66.65 | 105.78 | 112.21 | 103.83 | 105.74 | 107.45 | 100.65 |
| 19 | 2.37 | 3.42 | 2.67 | 3.64 | 3.65 | 3.51 | 3.74 |
| 20 | 62.40 | 36.20 | 51.20 | 42.60 | 32.20 | 33.80 | 45.80 |
| 21 | 1.00 | 12.30 | 1.10 | 8.50 | 18.67 | 11.00 | 2.50 |
| 22 | 8.94 | 4.69 | 5.47 | 5.92 | 6.16 | 6.88 | 11.03 |
| 23 | 7.75 | 6.85 | 8.51 | 8.32 | 9.80 | 9.28 | 8.77 |
| 24 | 1.37 | 0.81 | 0.75 | 0.83 | 0.74 | 0.88 | 1.53 |
| 25 | 1.52 | 0.91 | 0.85 | 0.96 | 0.82 | 0.94 | 1.60 |
| 26 | 0.65 | 0.44 | 0.42 | 0.41 | 0.41 | 0.44 | 0.56 |
| 27 | 44.87 | 77.13 | 85.00 | 67.53 | 50.87 | 55.67 | 38.60 |
| 28 | 26.50 | 76.60 | 35.30 | 75.30 | 68.50 | 66.80 | 55.80 |
| 29 | 129.34 | 107.42 | 116.31 | 114.38 | 104.47 | 105.59 | 160.52 |
| 30 | 0.05 | 0.04 | 0.04 | 0.05 | 0.04 | 0.06 | 0.05 |
| 31 | 7.97 | 8.24 | 9.14 | 8.71 | 9.82 | 10.00 | 8.47 |

Table 35. Provided are the values of each of the parameters measured in Barley accessions (29-35) according to the correlation identifications (see Table 30).

TABLE 36

Barley accessions (36-42), additional measured parameters

| Ecotype/Treatment | Line-36 | Line-37 | Line-38 | Line-39 | Line-40 | Line-41 | Line-42 |
|---|---|---|---|---|---|---|---|
| 1 | 9.46 | 4.75 | NA | 4.60 | 21.49 | 21.20 | 14.49 |
| 2 | 26.38 | 19.78 | 31.00 | 47.79 | 32.57 | 36.89 | 24.24 |
| 3 | 43.46 | 27.36 | 44.56 | 69.91 | 44.21 | 50.54 | 44.04 |
| 4 | 48.56 | 31.46 | 59.31 | 43.15 | 72.36 | 91.79 | 63.37 |
| 5 | 23.84 | 11.91 | NA | 8.31 | 55.42 | 55.88 | 31.34 |
| 6 | 0.74 | 1.15 | 1.32 | 3.51 | 1.45 | 1.40 | 0.93 |
| 7 | 3.17 | 2.74 | 2.69 | 2.93 | 2.38 | 2.67 | 3.05 |
| 8 | 0.30 | 0.26 | 0.26 | 0.32 | 0.23 | 0.28 | 0.30 |
| 9 | 1.30 | 1.11 | 1.10 | 1.21 | 0.95 | 1.09 | 1.28 |
| 10 | 0.31 | 0.32 | 0.33 | 0.39 | 0.33 | 0.36 | 0.33 |
| 11 | 11.25 | 16.11 | 21.71 | 58.20 | 34.19 | 20.75 | 11.50 |
| 12 | NA | NA | NA | NA | NA | NA | NA |
| 13 | 0.24 | 0.32 | 0.66 | 2.82 | 0.94 | 0.75 | 0.31 |
| 14 | 1.00 | 1.00 | 1.00 | 3.80 | 1.00 | 1.40 | 1.00 |

TABLE 36-continued

Barley accessions (36-42), additional measured parameters

| Ecotype/Treatment | Line-36 | Line-37 | Line-38 | Line-39 | Line-40 | Line-41 | Line-42 |
|---|---|---|---|---|---|---|---|
| 15 | NA | NA | NA | NA | NA | NA | NA |
| 16 | 108.40 | 91.60 | 115.60 | 84.20 | 118.00 | 116.80 | 111.00 |
| 17 | 140.40 | 133.00 | 145.80 | 148.00 | 153.80 | 144.20 | 140.20 |
| 18 | 106.34 | 78.29 | 107.63 | 77.57 | 93.91 | 126.08 | 107.15 |
| 19 | 3.17 | 2.50 | NA | 2.12 | 4.03 | NA | 3.44 |
| 20 | 32.00 | 41.40 | 30.20 | 63.80 | 36.00 | 27.40 | 29.25 |
| 21 | 7.40 | 1.50 | NA | 0.81 | 14.80 | 15.50 | 10.70 |
| 22 | 5.17 | 7.72 | 8.37 | 7.41 | 7.83 | 8.38 | 5.09 |
| 23 | 7.81 | 11.96 | 11.32 | 7.52 | 8.33 | 10.12 | 8.27 |
| 24 | 0.79 | 0.75 | 0.86 | 1.16 | 1.15 | 0.99 | 0.72 |
| 25 | 0.91 | 0.92 | 0.94 | 1.31 | 1.24 | 1.06 | 0.82 |
| 26 | 0.47 | 0.48 | 0.43 | 0.62 | 0.37 | 0.36 | 0.41 |
| 27 | 64.67 | 50.93 | 48.40 | 32.00 | 43.40 | 45.80 | 73.53 |
| 28 | 69.30 | 32.20 | NA | 15.81 | 66.40 | 75.13 | 71.20 |
| 29 | 92.02 | 58.82 | 110.88 | 113.06 | 116.57 | 149.88 | 107.41 |
| 30 | 0.06 | 0.03 | 0.04 | 0.06 | 0.05 | NA | 0.06 |
| 31 | 8.36 | 12.49 | 11.03 | 8.21 | 7.97 | 10.44 | 8.66 |

Table 36. Provided are the values of each of the parameters measured in Barley accessions (36-42) according to the correlation identifications (see Table 30).

TABLE 37

Barley accessions (43-49), additional measured parameters

| Ecotype/Treatment | Line-43 | Line-44 | Line-45 | Line-46 | Line-47 | Line-48 | Line-49 |
|---|---|---|---|---|---|---|---|
| 1 | 17.05 | 12.52 | 9.87 | 10.75 | 10.80 | 14.99 | 16.12 |
| 2 | 27.81 | 23.34 | 31.77 | 27.36 | 25.70 | 24.92 | 26.31 |
| 3 | 50.12 | 40.37 | 55.92 | 33.55 | 31.74 | 50.70 | 44.59 |
| 4 | 69.41 | 58.51 | 61.56 | 42.29 | 41.24 | 71.38 | 73.03 |
| 5 | 32.88 | 35.99 | 42.56 | 19.47 | 26.16 | 39.22 | 49.89 |
| 6 | 0.96 | 0.82 | 1.34 | 1.16 | 1.18 | 0.94 | 1.05 |
| 7 | 2.77 | 2.94 | 3.18 | 3.06 | 2.75 | 2.62 | 2.99 |
| 8 | 0.26 | 0.29 | 0.33 | 0.30 | 0.26 | 0.24 | 0.29 |
| 9 | 1.14 | 1.25 | 1.32 | 1.25 | 1.13 | 1.06 | 1.25 |
| 10 | 0.33 | 0.32 | 0.35 | 0.34 | 0.32 | 0.32 | 0.33 |
| 11 | 17.55 | 10.65 | 15.98 | 14.58 | 17.44 | 18.90 | 14.60 |
| 12 | NA | NA | NA | NA | NA | NA | NA |
| 13 | 0.47 | 0.25 | 0.53 | 0.43 | 0.45 | 0.47 | 0.40 |
| 14 | 1.00 | 1.00 | 1.00 | 1.00 | 1.00 | 1.00 | 1.00 |
| 15 | NA | NA | NA | NA | NA | NA | NA |
| 16 | 111.00 | 111.00 | 111.00 | 99.20 | 105.80 | 111.00 | 117.20 |
| 17 | 146.00 | 140.20 | 143.00 | 133.00 | 133.00 | 143.00 | 148.20 |
| 18 | 106.69 | 96.26 | 99.81 | 91.75 | 80.80 | 105.57 | 101.87 |
| 19 | 3.52 | 3.60 | 3.75 | 2.94 | 3.29 | 3.68 | 3.84 |
| 20 | 35.00 | 29.20 | 32.00 | 33.80 | 27.20 | 32.00 | 31.00 |
| 21 | 15.00 | 11.70 | 6.90 | 5.50 | 10.30 | 12.40 | 13.33 |
| 22 | 5.03 | 4.88 | 8.33 | 7.43 | 6.71 | 6.61 | 7.10 |
| 23 | 8.45 | 7.95 | 10.21 | 11.52 | 10.17 | 9.09 | 9.79 |
| 24 | 0.65 | 0.72 | 0.96 | 0.76 | 0.77 | 0.94 | 0.85 |
| 25 | 0.76 | 0.82 | 1.04 | 0.91 | 0.92 | 0.97 | 0.95 |
| 26 | 0.42 | 0.41 | 0.48 | 0.44 | 0.46 | 0.42 | 0.38 |
| 27 | 79.33 | 61.67 | 49.13 | 55.10 | 56.67 | 62.20 | 70.93 |
| 28 | 86.70 | 90.70 | 71.40 | 58.50 | 90.90 | 87.50 | 108.50 |
| 29 | 119.53 | 98.88 | 117.49 | 75.84 | 72.98 | 122.08 | 117.62 |
| 30 | 0.04 | 0.03 | 0.05 | 0.05 | 0.04 | 0.07 | 0.05 |
| 31 | 9.91 | 8.51 | 10.18 | 11.82 | 10.58 | 9.42 | 10.04 |

Table 37. Provided are the values of each of the parameters measured in Barley accessions (43-49) according to the correlation identifications (see Table 30).

TABLE 38

Barley accessions (50-55), additional measured parameters

| Ecotype/Treatment | Line-50 | Line-51 | Line-52 | Line-53 | Line-54 | Line-55 |
|---|---|---|---|---|---|---|
| 1 | 31.13 | NA | 15.51 | 6.88 | 7.07 | 6.72 |
| 2 | 30.08 | 24.82 | 26.46 | 21.49 | 43.66 | 47.91 |
| 3 | 36.91 | 26.20 | 57.49 | 47.76 | 43.70 | 68.61 |
| 4 | 50.75 | 52.91 | 73.30 | 65.81 | 56.28 | NA |
| 5 | 37.91 | NA | 38.72 | 29.92 | 14.62 | 67.47 |
| 6 | 1.01 | 1.01 | 0.84 | 0.75 | 3.71 | 2.78 |

TABLE 38-continued

Barley accessions (50-55), additional measured parameters

| Ecotype/Treatment | Line-50 | Line-51 | Line-52 | Line-53 | Line-54 | Line-55 |
|---|---|---|---|---|---|---|
| 7 | 3.06 | 3.24 | 2.90 | 2.65 | 2.24 | 2.56 |
| 8 | 0.31 | 0.32 | 0.26 | 0.25 | 0.25 | 0.28 |
| 9 | 1.26 | 1.36 | 1.17 | 1.10 | 0.88 | 1.05 |
| 10 | 0.35 | 0.33 | 0.32 | 0.31 | 0.40 | 0.38 |
| 11 | 13.58 | 13.07 | 19.84 | 17.16 | 65.39 | 43.77 |
| 12 | NA | NA | NA | NA | 34.58 | 53.97 |
| 13 | 0.40 | 0.32 | 0.50 | 0.38 | 2.64 | 2.06 |
| 14 | 1.00 | 1.00 | 1.00 | 1.00 | 5.00 | 1.80 |
| 15 | NA | NA | NA | NA | 0.35 | NA |
| 16 | 113.00 | 122.60 | 111.00 | 107.60 | 88.40 | 128.00 |
| 17 | 143.60 | 152.00 | 142.40 | 140.40 | 157.00 | 170.00 |
| 18 | 95.35 | 80.26 | 105.02 | 98.42 | 93.79 | 90.30 |
| 19 | NA | NA | 3.66 | 3.41 | 2.18 | 4.23 |
| 20 | 30.60 | 29.40 | 31.40 | 32.80 | 68.60 | 42.00 |
| 21 | 20.20 | NA | 18.30 | 6.60 | 2.50 | 3.10 |
| 22 | 6.86 | 8.62 | 7.16 | 5.75 | 10.74 | 10.04 |
| 23 | 9.38 | 11.73 | 10.01 | 8.78 | 8.54 | 8.59 |
| 24 | 0.87 | 0.87 | 0.86 | 0.77 | 1.49 | 1.45 |
| 25 | 0.94 | 0.97 | 0.94 | 0.89 | 1.68 | 1.57 |
| 26 | 0.42 | 0.33 | 0.44 | 0.42 | 0.44 | NA |
| 27 | 39.27 | 45.00 | 74.58 | 74.53 | 20.80 | 38.00 |
| 28 | 64.60 | NA | 113.50 | 95.60 | 15.60 | 43.20 |
| 29 | 87.66 | 79.11 | 130.79 | 113.58 | 99.98 | NA |
| 30 | NA | 0.04 | 0.04 | 0.05 | 0.05 | 0.05 |
| 31 | 9.41 | 11.67 | 10.60 | 9.72 | 8.26 | 9.22 |

Table 38. Provided are the values of each of the parameters measured in Barley accessions (50-55) according to the correlation identifications (see Table 30).

TABLE 39

Barley accessions, additional measured parameters

| Ecotype/Treatment | Line-21 | Line-22 | Line-24 | Line-25 | Line-26 | Line-27 | Line-28 |
|---|---|---|---|---|---|---|---|
| 1 | 6.62 | 3.51 | 31.12 | NA | NA | 11.07 | 21.67 |
| 2 | 41.96 | 18.60 | 39.67 | 24.43 | 28.42 | 28.40 | 23.52 |
| 3 | 64.51 | 33.60 | 52.10 | 33.28 | 47.69 | 52.78 | 52.54 |
| 4 | 91.79 | 50.17 | 67.20 | 43.40 | 79.51 | 61.09 | 59.71 |
| 5 | 41.56 | 174.82 | 51.83 | NA | NA | 38.46 | 38.79 |
| 6 | 1.36 | 0.90 | 1.22 | 0.91 | 0.92 | 1.08 | 0.95 |
| 7 | 2.45 | 2.65 | 2.44 | 2.90 | 2.62 | 2.66 | 2.68 |
| 8 | 0.23 | 0.25 | 0.25 | 0.27 | 0.25 | 0.25 | 0.24 |
| 9 | 0.94 | 1.11 | 0.96 | 1.20 | 1.07 | 1.08 | 1.11 |
| 10 | 0.36 | 0.31 | 0.37 | 0.32 | 0.32 | 0.33 | 0.31 |
| 11 | 19.87 | 16.30 | 17.54 | 12.00 | 20.01 | 20.00 | 17.01 |
| 12 | NA | NA | NA | NA | NA | NA | NA |
| 13 | 0.78 | 0.31 | 0.67 | 0.31 | 0.56 | 0.56 | 0.38 |
| 14 | 1.00 | 1.00 | 1.00 | 1.00 | 1.00 | 1.00 | 1.00 |
| 15 | NA | NA | NA | NA | NA | NA | NA |
| 16 | 119.40 | 95.60 | 111.00 | 83.60 | 122.00 | 111.40 | 109.20 |
| 17 | 170.00 | 133.00 | 145.80 | 140.20 | 153.00 | 143.00 | 140.40 |
| 18 | 94.80 | 90.49 | 90.10 | 92.47 | 99.08 | 91.69 | 94.67 |
| 19 | 3.74 | 5.01 | 3.97 | NA | NA | 3.67 | 3.68 |
| 20 | 50.60 | 37.40 | 34.80 | 56.60 | 31.00 | 31.60 | 31.20 |
| 21 | 4.63 | 1.88 | 15.50 | NA | NA | 7.10 | 15.70 |
| 22 | 7.28 | 4.98 | 6.52 | 5.39 | 8.16 | 8.08 | 5.73 |
| 23 | 10.99 | 8.58 | 8.63 | 7.96 | 10.20 | 10.52 | 8.35 |
| 24 | 0.76 | 0.68 | 0.88 | 0.81 | 0.97 | 0.92 | 0.78 |
| 25 | 0.90 | 0.79 | 1.01 | 0.88 | 1.05 | 1.01 | 0.90 |
| 26 | 0.41 | 0.41 | 0.44 | 0.44 | 0.38 | 0.46 | 0.47 |
| 27 | 73.13 | 88.07 | 48.53 | 51.33 | 65.80 | 55.80 | 65.60 |
| 28 | 69.88 | 55.25 | 48.50 | NA | NA | 69.00 | 76.40 |
| 29 | 156.29 | 83.76 | 119.30 | 76.68 | 127.20 | 113.88 | 112.25 |
| 30 | 0.05 | 0.03 | 0.05 | 0.05 | 0.04 | 0.05 | 0.05 |
| 31 | NA | 9.74 | 8.69 | 8.90 | 10.13 | 10.61 | 9.60 |

Table 39. Provided are the values of each of the parameters measured in Barley Hordeum spontaneum accessions (21-22, 24-28) according to the correlation identifications (see Table 30).

TABLE 40

Barley accessions, additional measured parameters

| Ecotype/Treatment | Line30 | Line-31 | Line-32 | Line-33 | Line-34 | Line-36 | Line-37 |
|---|---|---|---|---|---|---|---|
| 1 | 16.51 | 3.19 | 10.55 | 26.51 | 15.15 | 9.46 | 4.75 |
| 2 | 26.47 | 23.14 | 27.64 | 29.37 | 27.74 | 26.38 | 19.78 |
| 3 | 47.05 | 48.92 | 47.26 | 48.82 | 46.56 | 43.46 | 27.36 |
| 4 | 60.37 | 67.39 | 67.12 | 61.35 | 59.03 | 48.56 | 31.46 |
| 5 | 29.60 | 14.28 | 37.74 | 39.23 | 34.46 | 23.84 | 11.91 |
| 6 | 0.85 | 0.85 | 0.89 | 1.10 | 1.09 | 0.74 | 1.15 |
| 7 | 2.66 | 2.57 | 2.93 | 3.16 | 2.99 | 3.17 | 2.74 |
| 8 | 0.25 | 0.24 | 0.29 | 0.33 | 0.29 | 0.30 | 0.26 |

TABLE 40-continued

| Barley accessions, additional measured parameters | | | | | | | |
|---|---|---|---|---|---|---|---|
| Ecotype/Treatment | Line30 | Line-31 | Line-32 | Line-33 | Line-34 | Line-36 | Line-37 |
| 9 | 1.09 | 1.06 | 1.23 | 1.33 | 1.27 | 1.30 | 1.11 |
| 10 | 0.32 | 0.32 | 0.33 | 0.34 | 0.32 | 0.31 | 0.32 |
| 11 | 18.19 | 13.50 | 12.83 | 14.49 | 13.72 | 11.25 | 16.11 |
| 12 | NA | NA | NA | NA | NA | NA | NA |
| 13 | 0.46 | 0.31 | 0.37 | 0.43 | 0.39 | 0.24 | 0.32 |
| 14 | 1.00 | 1.00 | 1.00 | 1.00 | 1.00 | 1.00 | 1.00 |
| 15 | NA | NA | NA | NA | NA | NA | NA |
| 16 | 104.00 | 89.20 | 97.80 | 113.60 | 109.20 | 108.40 | 91.60 |
| 17 | 140.20 | 140.40 | 140.40 | 145.80 | 143.00 | 140.40 | 133.00 |
| 18 | 105.78 | 112.21 | 103.83 | 105.74 | 107.45 | 106.34 | 78.29 |
| 19 | 3.42 | 2.67 | 3.64 | 3.65 | 3.51 | 3.17 | 2.50 |
| 20 | 36.20 | 51.20 | 42.60 | 32.20 | 33.80 | 32.00 | 41.40 |
| 21 | 12.30 | 1.10 | 8.50 | 18.67 | 11.00 | 7.40 | 1.50 |
| 22 | 4.69 | 5.47 | 5.92 | 6.16 | 6.88 | 5.17 | 7.72 |
| 23 | 6.85 | 8.51 | 8.32 | 9.80 | 9.28 | 7.81 | 11.96 |
| 24 | 0.81 | 0.75 | 0.83 | 0.74 | 0.88 | 0.79 | 0.75 |
| 25 | 0.91 | 0.85 | 0.96 | 0.82 | 0.94 | 0.91 | 0.92 |
| 26 | 0.44 | 0.42 | 0.41 | 0.41 | 0.44 | 0.47 | 0.48 |
| 27 | 77.13 | 85.00 | 67.53 | 50.87 | 55.67 | 64.67 | 50.93 |
| 28 | 76.60 | 35.30 | 75.30 | 68.50 | 66.80 | 69.30 | 32.20 |
| 29 | 107.42 | 116.31 | 114.38 | 104.47 | 105.59 | 92.02 | 58.82 |
| 30 | 0.04 | 0.04 | 0.05 | 0.04 | 0.06 | 0.06 | 0.03 |
| 31 | 8.24 | 9.14 | 8.71 | 9.82 | 10.00 | 8.36 | 12.49 |

Table 40. Provided are the values of each of the parameters measured in Barley Hordeum spontaneum accessions (30-34, 36-37) according to the correlation identifications (see Table 30).

TABLE 41

| Barley accessions, additional measured parameters | | | | | | | |
|---|---|---|---|---|---|---|---|
| Ecotype/Treatment | Line-38 | Line-41 | Line-42 | Line-43 | Line-44 | Line-45 | Line-46 |
| 1 | NA | 21.20 | 14.49 | 17.05 | 12.52 | 9.87 | 10.75 |
| 2 | 31.00 | 36.89 | 24.24 | 27.81 | 23.34 | 31.77 | 27.36 |
| 3 | 44.56 | 50.54 | 44.04 | 50.12 | 40.37 | 55.92 | 33.55 |
| 4 | 59.31 | 91.79 | 63.37 | 69.41 | 58.51 | 61.56 | 42.29 |
| 5 | NA | 55.88 | 31.34 | 32.88 | 35.99 | 42.56 | 19.47 |
| 6 | 1.32 | 1.40 | 0.93 | 0.96 | 0.82 | 1.34 | 1.16 |
| 7 | 2.69 | 2.67 | 3.05 | 2.77 | 2.94 | 3.18 | 3.06 |
| 8 | 0.26 | 0.28 | 0.30 | 0.26 | 0.29 | 0.33 | 0.30 |
| 9 | 1.10 | 1.09 | 1.28 | 1.14 | 1.25 | 1.32 | 1.25 |
| 10 | 0.33 | 0.36 | 0.33 | 0.33 | 0.32 | 0.35 | 0.34 |
| 11 | 21.71 | 20.75 | 11.50 | 17.55 | 10.65 | 15.98 | 14.58 |
| 12 | NA | NA | NA | NA | NA | NA | NA |
| 13 | 0.66 | 0.75 | 0.31 | 0.47 | 0.25 | 0.53 | 0.43 |
| 14 | 1.00 | 1.40 | 1.00 | 1.00 | 1.00 | 1.00 | 1.00 |
| 15 | NA | NA | NA | NA | NA | NA | NA |
| 16 | 115.60 | 116.80 | 111.00 | 111.00 | 111.00 | 111.00 | 99.20 |
| 17 | 145.80 | 144.20 | 140.20 | 146.00 | 140.20 | 143.00 | 133.00 |
| 18 | 107.63 | 126.08 | 107.15 | 106.69 | 96.26 | 99.81 | 91.75 |
| 19 | NA | NA | 3.44 | 3.52 | 3.60 | 3.75 | 2.94 |
| 20 | 30.20 | 27.40 | 29.25 | 35.00 | 29.20 | 32.00 | 33.80 |
| 21 | NA | 15.50 | 10.70 | 15.00 | 11.70 | 6.90 | 5.50 |
| 22 | 8.37 | 8.38 | 5.09 | 5.03 | 4.88 | 8.33 | 7.43 |
| 23 | 11.32 | 10.12 | 8.27 | 8.45 | 7.95 | 10.21 | 11.52 |
| 24 | 0.86 | 0.99 | 0.72 | 0.65 | 0.72 | 0.96 | 0.76 |
| 25 | 0.94 | 1.06 | 0.82 | 0.76 | 0.82 | 1.04 | 0.91 |
| 26 | 0.43 | 0.36 | 0.41 | 0.42 | 0.41 | 0.48 | 0.44 |
| 27 | 48.40 | 45.80 | 73.53 | 79.33 | 61.67 | 49.13 | 55.10 |
| 28 | NA | 75.13 | 71.20 | 86.70 | 90.70 | 71.40 | 58.50 |
| 29 | 110.88 | 149.88 | 107.41 | 119.53 | 98.88 | 117.49 | 75.84 |
| 30 | 0.04 | NA | 0.06 | 0.04 | 0.03 | 0.05 | 0.05 |
| 31 | 11.03 | 10.44 | 8.66 | 9.91 | 8.51 | 10.18 | 11.82 |

Table 41. Provided are the values of each of the parameters measured in Barley Hordeum spontaneum accessions (38, 41-46) according to the correlation identifications (see Table 30).

TABLE 42

Barley accessions, additional measured parameters

| Ecotype/Treatment | Line-47 | Line-48 | Line-49 | Line-51 | Line-52 | Line-53 |
|---|---|---|---|---|---|---|
| 1 | 10.80 | 14.99 | 16.12 | NA | 15.51 | 6.88 |
| 2 | 25.70 | 24.92 | 26.31 | 24.82 | 26.46 | 21.49 |
| 3 | 31.74 | 50.70 | 44.59 | 26.20 | 57.49 | 47.76 |
| 4 | 41.24 | 71.38 | 73.03 | 52.91 | 73.30 | 65.81 |
| 5 | 26.16 | 39.22 | 49.89 | NA | 38.72 | 29.92 |
| 6 | 1.18 | 0.94 | 1.05 | 1.01 | 0.84 | 0.75 |
| 7 | 2.75 | 2.62 | 2.99 | 3.24 | 2.90 | 2.65 |
| 8 | 0.26 | 0.24 | 0.29 | 0.32 | 0.26 | 0.25 |
| 9 | 1.13 | 1.06 | 1.25 | 1.36 | 1.17 | 1.10 |
| 10 | 0.32 | 0.32 | 0.33 | 0.33 | 0.32 | 0.31 |
| 11 | 17.44 | 18.90 | 14.60 | 13.07 | 19.84 | 17.16 |
| 12 | NA | NA | NA | NA | NA | NA |
| 13 | 0.45 | 0.47 | 0.40 | 0.32 | 0.50 | 0.38 |
| 14 | 1.00 | 1.00 | 1.00 | 1.00 | 1.00 | 1.00 |
| 15 | NA | NA | NA | NA | NA | NA |
| 16 | 105.80 | 111.00 | 117.20 | 122.60 | 111.00 | 107.60 |
| 17 | 133.00 | 143.00 | 148.20 | 152.00 | 142.40 | 140.40 |
| 18 | 80.80 | 105.57 | 101.87 | 80.26 | 105.02 | 98.42 |
| 19 | 3.29 | 3.68 | 3.84 | NA | 3.66 | 3.41 |
| 20 | 27.20 | 32.00 | 31.00 | 29.40 | 31.40 | 32.80 |
| 21 | 10.30 | 12.40 | 13.33 | NA | 18.30 | 6.60 |
| 22 | 6.71 | 6.61 | 7.10 | 8.62 | 7.16 | 5.75 |
| 23 | 10.17 | 9.09 | 9.79 | 11.73 | 10.01 | 8.78 |
| 24 | 0.77 | 0.94 | 0.85 | 0.87 | 0.86 | 0.77 |
| 25 | 0.92 | 0.97 | 0.95 | 0.97 | 0.94 | 0.89 |
| 26 | 0.46 | 0.42 | 0.38 | 0.33 | 0.44 | 0.42 |
| 27 | 56.67 | 62.20 | 70.93 | 45.00 | 74.58 | 74.53 |
| 28 | 90.90 | 87.50 | 108.50 | NA | 113.50 | 95.60 |
| 29 | 72.98 | 122.08 | 117.62 | 79.11 | 130.79 | 113.58 |
| 30 | 0.04 | 0.07 | 0.05 | 0.04 | 0.04 | 0.05 |
| 31 | 10.58 | 9.42 | 10.04 | 11.67 | 10.60 | 9.72 |

Table 42. Provided are the values of each of the parameters measured in Barley Hordeum spontaneum accessions (47-49, 51-53) according to the correlation identifications (see Table 30).

TABLE 43

Barley accessions, additional measured parameters

| Ecotype/Treatment | Line-1 | Line-2 | Line-4 | Line-5 | Line-6 | Line-8 | Line-9 |
|---|---|---|---|---|---|---|---|
| 1 | 4.31 | 18.25 | 40.15 | 33.22 | NA | 16.67 | 5.64 |
| 2 | 50.11 | 49.98 | 52.43 | 47.22 | 49.33 | 61.33 | 49.97 |
| 3 | 80.88 | 60.47 | 69.45 | 61.03 | 63.22 | 91.89 | 99.05 |
| 4 | 46.33 | 85.03 | 127.37 | 79.51 | 82.95 | 82.88 | 56.80 |
| 5 | 11.34 | 52.57 | 126.89 | 60.56 | NA | 44.57 | 9.71 |
| 6 | 3.33 | 1.56 | 3.11 | 3.18 | 2.85 | 4.13 | 3.47 |
| 7 | 2.62 | 2.41 | 2.67 | 2.62 | 2.59 | 2.78 | 2.66 |
| 8 | 0.30 | 0.28 | 0.30 | 0.29 | 0.29 | 0.33 | 0.29 |
| 9 | 1.09 | 0.97 | 1.07 | 1.09 | 1.07 | 1.15 | 1.09 |
| 10 | 0.40 | 0.41 | 0.41 | 0.39 | 0.39 | 0.42 | 0.39 |
| 11 | 56.51 | 21.05 | 44.35 | 47.12 | 43.51 | 58.33 | 56.03 |
| 12 | 64.98 | 37.47 | 51.69 | 49.15 | 46.44 | 78.18 | 79.86 |
| 13 | 2.91 | 1.02 | 2.33 | 2.23 | 2.14 | 3.47 | 2.60 |
| 14 | 4.20 | 1.00 | 2.60 | 2.60 | 1.00 | 1.00 | 5.00 |
| 15 | 0.51 | 0.25 | 0.26 | 0.35 | 0.32 | 0.45 | 0.51 |
| 16 | 90.80 | 124.40 | NA | 122.00 | NA | 111.60 | 86.80 |
| 17 | 148.00 | 170.00 | 170.00 | 167.40 | 170.00 | 156.20 | 159.60 |
| 18 | 83.97 | 79.87 | 122.46 | 108.03 | 87.00 | 104.01 | 70.78 |
| 19 | 2.45 | 3.96 | 4.75 | 4.12 | NA | 3.82 | 2.30 |
| 20 | 57.20 | 45.60 | NA | 48.00 | NA | 44.60 | 72.80 |
| 21 | 1.00 | 9.20 | 19.20 | 14.63 | NA | 6.30 | 1.20 |
| 22 | 9.90 | 7.82 | 11.07 | 10.17 | 9.98 | 9.89 | 9.58 |
| 23 | 9.49 | 10.26 | 7.97 | 8.42 | 8.12 | 6.39 | 7.73 |
| 24 | 1.23 | 0.87 | 1.68 | 1.47 | 1.51 | 1.83 | 1.50 |
| 25 | 1.41 | 1.05 | 1.79 | 1.60 | 1.61 | 1.93 | 1.59 |
| 26 | 0.64 | 0.42 | 0.35 | 0.44 | 0.43 | 0.51 | 0.64 |
| 27 | 45.27 | 56.27 | 32.42 | 35.40 | 36.73 | 32.10 | 48.53 |
| 28 | 24.00 | 48.70 | 47.60 | 45.00 | NA | 38.50 | 21.50 |
| 29 | 127.22 | 145.50 | 196.82 | 140.54 | 146.17 | 178.63 | 155.85 |
| 30 | 0.05 | 0.06 | 0.05 | 0.05 | 0.05 | 0.05 | 0.06 |
| 31 | 9.57 | NA | 7.93 | 8.13 | NA | 5.65 | 7.94 |

Table 43. Provided are the values of each of the parameters measured in Barley Hordeum vulgare accessions (1-2, 4-6, 8-9) according to the correlation identifications (see Table 30).

TABLE 44

Barley accessions, additional measured parameters

| Ecotype/Treatment | Line-10 | Line-11 | Line-12 | Line-13 | Line-14 | Line-15 | Line-16 |
|---|---|---|---|---|---|---|---|
| 1 | 5.29 | 18.34 | 4.03 | 8.83 | 4.82 | 29.49 | 5.01 |
| 2 | 51.70 | 56.46 | 53.97 | 50.36 | 56.81 | 57.98 | 51.44 |
| 3 | 66.99 | 60.22 | 87.61 | 71.76 | 76.71 | 81.14 | 77.90 |
| 4 | 64.14 | 54.23 | 73.23 | 49.50 | 47.63 | 66.51 | 77.50 |
| 5 | 38.18 | 46.74 | 42.32 | 11.62 | 9.33 | 47.56 | 30.93 |
| 6 | 3.15 | 1.88 | 3.35 | 3.60 | 3.24 | 3.12 | 1.69 |
| 7 | 2.63 | 2.28 | 2.54 | 2.37 | 2.71 | 2.90 | 2.28 |
| 8 | 0.30 | 0.28 | 0.30 | 0.27 | 0.32 | 0.34 | 0.27 |
| 9 | 1.08 | 0.88 | 1.03 | 0.96 | 1.12 | 1.22 | 0.89 |
| 10 | 0.39 | 0.45 | 0.42 | 0.41 | 0.41 | 0.41 | 0.42 |
| 11 | 59.08 | 27.27 | 55.87 | 61.53 | 50.80 | 45.48 | 24.77 |
| 12 | 54.34 | 46.37 | 71.89 | 56.24 | 61.63 | 64.82 | 56.43 |
| 13 | 2.84 | 1.51 | 2.84 | 2.98 | 2.85 | 2.39 | 1.21 |
| 14 | 3.00 | 1.00 | 1.00 | 2.20 | 3.00 | 1.00 | 1.00 |
| 15 | 0.41 | 0.40 | 0.45 | 0.48 | 0.50 | 0.44 | 0.36 |
| 16 | 106.20 | 117.80 | 111.60 | 85.40 | 90.00 | 113.20 | 113.40 |
| 17 | 157.00 | 162.20 | 159.60 | 157.00 | 150.50 | 158.00 | 170.00 |
| 18 | 98.11 | 57.88 | 94.52 | 73.20 | 78.65 | 90.73 | 64.27 |
| 19 | 3.60 | 3.83 | 3.63 | 2.43 | 2.26 | 3.89 | 3.46 |
| 20 | 50.80 | 44.40 | 46.00 | 71.60 | 61.50 | 44.80 | 56.60 |
| 21 | 2.10 | 10.00 | 2.60 | 1.63 | 1.00 | 17.00 | 3.00 |
| 22 | 11.19 | 8.76 | 10.49 | 10.83 | 11.23 | 7.89 | 9.15 |
| 23 | 8.45 | 10.55 | 7.60 | 7.87 | 9.42 | 6.68 | 12.05 |
| 24 | 1.57 | 0.96 | 1.63 | 1.63 | 1.43 | 1.45 | 0.88 |
| 25 | 1.71 | 1.17 | 1.75 | 1.72 | 1.58 | 1.52 | 1.03 |
| 26 | 0.51 | 0.53 | 0.55 | 0.61 | 0.62 | 0.55 | 0.50 |
| 27 | 29.80 | 50.80 | 32.40 | 26.80 | 42.42 | 39.73 | 71.33 |
| 28 | 36.10 | 57.25 | 42.20 | 19.13 | 21.63 | 59.80 | 62.50 |
| 29 | 131.13 | 114.45 | 160.84 | 121.26 | 124.34 | 147.66 | 155.41 |
| 30 | 0.05 | 0.06 | 0.06 | 0.06 | 0.05 | 0.05 | 0.04 |
| 31 | 8.55 | 10.59 | 7.44 | 7.36 | 9.60 | 6.23 | NA |

Table 44. Provided are the values of each of the parameters measured in Barley Hordeum vulgare accessions (10-16) according to the correlation identifications (see Table 30).

TABLE 45

Barley accessions, additional measured parameters

| Ecotype/Treatment | Line-17 | Line-18 | Line-19 | Line-54 | Line-55 |
|---|---|---|---|---|---|
| 1 | 3.74 | 11.42 | 5.13 | 7.07 | 6.72 |
| 2 | 58.07 | 53.45 | 48.66 | 43.66 | 47.91 |
| 3 | 68.17 | 70.73 | 54.13 | 43.70 | 68.61 |
| 4 | 81.58 | 67.92 | 81.05 | 56.28 | NA |
| 5 | NA | 35.49 | 38.41 | 14.62 | 67.47 |
| 6 | 1.66 | 3.50 | 1.16 | 3.71 | 2.78 |
| 7 | 2.42 | 2.65 | 2.16 | 2.24 | 2.56 |
| 8 | 0.30 | 0.30 | 0.26 | 0.25 | 0.28 |
| 9 | 0.96 | 1.08 | 0.83 | 0.88 | 1.05 |
| 10 | 0.44 | 0.40 | 0.42 | 0.40 | 0.38 |
| 11 | 21.15 | 59.72 | 17.46 | 65.39 | 43.77 |
| 12 | 49.68 | 54.97 | 40.33 | 34.58 | 53.97 |
| 13 | 1.18 | 2.93 | 0.83 | 2.64 | 2.06 |
| 14 | 3.80 | 3.80 | 1.00 | 5.00 | 1.80 |
| 15 | 0.33 | 0.40 | 0.29 | 0.35 | NA |
| 16 | 98.50 | 109.60 | 119.40 | 88.40 | 128.00 |
| 17 | 170.00 | 155.20 | 170.00 | 157.00 | 170.00 |
| 18 | 82.73 | 94.12 | 63.47 | 93.79 | 90.30 |
| 19 | NA | 3.60 | 3.64 | 2.18 | 4.23 |
| 20 | 71.50 | 45.60 | 50.60 | 68.60 | 42.00 |
| 21 | 1.00 | 3.80 | 4.20 | 2.50 | 3.10 |
| 22 | 8.57 | 11.30 | 7.04 | 10.74 | 10.04 |
| 23 | 10.74 | 8.60 | 8.94 | 8.54 | 8.59 |
| 24 | 0.92 | 1.56 | 0.92 | 1.49 | 1.45 |
| 25 | 1.10 | 1.72 | 1.08 | 1.68 | 1.57 |
| 26 | 0.45 | 0.51 | 0.39 | 0.44 | NA |
| 27 | 65.40 | 33.27 | 82.47 | 20.80 | 38.00 |
| 28 | 31.20 | 34.00 | 78.90 | 15.60 | 43.20 |
| 29 | 149.76 | 138.64 | 135.18 | 99.98 | NA |
| 30 | 0.05 | 0.04 | 0.06 | 0.05 | 0.05 |
| 31 | NA | 8.57 | NA | 8.26 | 9.22 |

Table 45. Provided are the values of each of the parameters measured in Barley Hordeum vulgare accessions (17-19, 54-55) according to the correlation identifications (see Table 30).

TABLE 46

Correlation between the expression level of the selected polynucleotides of the invention and their homologues in specific tissues or developmental stages and the phenotypic performance across all 55 Barley accessions

| Gene Name | R | P value | Exp. set | Corr. Set ID |
|---|---|---|---|---|
| LGP21 | 0.72 | 3.67E−09 | 4 | 26 |

Table 46. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Table 30; Exp. Set = expression set specified in Table 29.

TABLE 47

Correlation between the expression level of the selected polynucleotides of the invention and their homologues in specific tissues or developmental stages and the phenotypic performance across 27 Barley Hordeum spontaneum accessions

| Gene Name | R | P value | Exp. set | Corr. Set ID |
|---|---|---|---|---|
| MGP3 | 0.74 | 3.13E−04 | 2 | 21 |

Table 47. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Table 30; Exp. Set = expression set specified in Table 29.

TABLE 48

Correlation between the expression level of the selected polynucleotides of the invention and their homologues in specific tissues or developmental stages and the phenotypic performance across 19 Barley Hordeum vulgare accessions

| Gene Name | R | P value | Exp. set | Corr. Set ID | Gene Name | R | P value | Exp. set | Corr. Set ID |
|---|---|---|---|---|---|---|---|---|---|
| LGP21 | 0.74 | 6.16E-04 | 3 | 26 | LGP21 | 0.71 | 1.50E-03 | 4 | 26 |
| LGP21 | 0.73 | 5.59E-04 | 2 | 8 | | | | | |

Table 48. Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Con. Vector = correlation vector specified in Table 30; Exp. Set = expression set specified in Table 29.

Example 6

Production of Arabidopsis Transcriptome and High Throughput Correlation Analysis of Yield, Biomass and/or Vigor Related Parameters Using 44K Arabidopsis Full Genome Oligonucleotide Micro-Array To produce a high throughput correlation analysis, the present inventors utilized an *Arabidopsis thaliana* oligonucleotide micro-array, produced by Agilent Technologies [chem. (dot) agilent (dot) com/Scripts/PDS (dot) asp?1Page=50879]. The array oligonucleotide represents about 40,000 *A. thaliana* genes and transcripts designed based on data from the TIGR ATH1 v.5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described as described hereinabove under "GENERAL EXPERIMENTAL AND BIOINFORMATICS METHODS". For convenience, each microarray expression information tissue type has received a Set ID as summarized in Table 49 below.

TABLE 49

Tissues used for *Arabidopsis* transcriptome expression sets

| Expression Set | Set ID |
|---|---|
| Leaf | 1 |
| Root | 2 |
| Seed 5 DAF | 3 |
| Flower | 4 |
| Seed 12DAF | 5 |

Table 49: Provided are the identification (ID) digits of each of the *Arabidopsis* expression sets (1-5). DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Root analysis—During 17 days, the different ecotypes were grown in transparent agar plates. The plates were photographed every 3 days starting at day 7 in the photography room and the roots development was documented (see examples in FIGS. 3A-F). The growth rate of root coverage was calculated according to Formula XXVIII above.

Vegetative growth rate analysis—was calculated according to Formula VII above. The analysis was ended with the appearance of overlapping plants.

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra—Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The vegetative portion above ground was separated from the seeds. The total weight of the vegetative portion above ground and the seed weight of each plot were measured and divided by the number of plants.

Dry weight (vegetative biomass)=total weight of the vegetative portion above ground (excluding roots) after drying at 30° C. in a drying chamber; all the above ground biomass that is not yield.

Seed yield per plant=total seed weight per plant (gr).

Oil yield—The oil yield was calculated using Formula XXIX above.

Harvest Index (seed)—The harvest index was calculated using Formula XV (described above).

Experimental Results

Nine different *Arabidopsis* ecotypes were grown and characterized for 18 parameters (named as vectors).

TABLE 50

*Arabidopsis* correlated parameters (vectors)

| Correlated parameter with | Correlation ID |
|---|---|
| Blade circularity (cm) | 1 |
| Dry matter per plant (gr) | 2 |
| Harvest Index (value) | 3 |
| Lamina length (cm) | 4 |
| Lamina width (cm) | 5 |
| Leaf width/length (ratio) | 6 |
| Oil % per seed (percent) | 7 |
| Oil yield per plant (mg) | 8 |
| Seeds per silique (number) | 9 |
| Silique length (cm) | 10 |
| Total Leaf Area per plant (cm$^2$) | 11 |
| Vegetative growth rate (cm$^2$/day) Until leaves were in overlap | 12 |
| Fresh weight (gr) (at bolting stage) | 13 |
| Relative root growth (cm/day) in early seedling stages | 14 |
| Root length day 13 (cm) | 15 |
| Root length day 7 (cm) | 16 |
| 1000 Seed weight (gr) | 17 |
| Seed yield per plant (gr) | 18 |

Table 50. Provided are the *Arabidopsis* correlated parameters (correlation ID Nos. 1-18). Abbreviations: Cm = centimeter(s); gr = gram(s); mg = milligram(s).

The characterized values are summarized in Table 51. Correlation analysis is provided in Table 52 below.

TABLE 51

Measured parameters in *Arabidopsis* ecotypes

| Ecotype/Treatment | Line-1 | Line-2 | Line-3 | Line-4 | Line-5 | Line- 6 | Line-7 | Line-8 | Line-9 |
|---|---|---|---|---|---|---|---|---|---|
| 1 | 0.51 | 0.48 | 0.45 | 0.37 | 0.50 | 0.38 | 0.39 | 0.49 | 0.41 |
| 2 | 0.64 | 1.27 | 1.05 | 1.28 | 1.69 | 1.34 | 0.81 | 1.21 | 1.35 |
| 3 | 0.53 | 0.35 | 0.56 | 0.33 | 0.37 | 0.32 | 0.45 | 0.51 | 0.41 |
| 4 | 2.77 | 3.54 | 3.27 | 3.78 | 3.69 | 4.60 | 3.88 | 3.72 | 4.15 |
| 5 | 1.38 | 1.70 | 1.46 | 1.37 | 1.83 | 1.65 | 1.51 | 1.82 | 1.67 |
| 6 | 0.35 | 0.29 | 0.32 | 0.26 | 0.36 | 0.27 | 0.30 | 0.34 | 0.31 |
| 7 | 34.42 | 31.19 | 38.05 | 27.76 | 35.49 | 32.91 | 31.56 | 30.79 | 34.02 |
| 8 | 118.63 | 138.73 | 224.06 | 116.26 | 218.27 | 142.11 | 114.15 | 190.06 | 187.62 |
| 9 | 45.44 | 53.47 | 58.47 | 35.27 | 48.56 | 37.00 | 39.38 | 40.53 | 25.53 |
| 10 | 1.06 | 1.26 | 1.31 | 1.47 | 1.24 | 1.09 | 1.18 | 1.18 | 1.00 |
| 11 | 46.86 | 109.89 | 58.36 | 56.80 | 114.66 | 110.82 | 88.49 | 121.79 | 93.04 |
| 12 | 0.31 | 0.38 | 0.48 | 0.47 | 0.43 | 0.64 | 0.43 | 0.38 | 0.47 |
| 13 | 1.51 | 3.61 | 1.94 | 2.08 | 3.56 | 4.34 | 3.47 | 3.48 | 3.71 |
| 14 | 0.63 | 0.66 | 1.18 | 1.09 | 0.91 | 0.77 | 0.61 | 0.70 | 0.78 |
| 15 | 4.42 | 8.53 | 5.62 | 4.83 | 5.96 | 6.37 | 5.65 | 7.06 | 7.04 |
| 16 | 0.94 | 1.76 | 0.70 | 0.73 | 0.99 | 1.16 | 1.28 | 1.41 | 1.25 |
| 17 | 0.02 | 0.02 | 0.03 | 0.03 | 0.02 | 0.03 | 0.02 | 0.02 | 0.02 |
| 18 | 0.34 | 0.44 | 0.59 | 0.42 | 0.61 | 0.43 | 0.36 | 0.62 | 0.55 |

Table 51. Provided are the values of each of the parameters measured in *Arabidopsis* ecotypes.

TABLE 52

Correlation between the expression level of selected genes of some embodiments of the invention in various tissues and the phenotypic performance under normal conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LGP1 | 0.77 | 2.42E-02 | 5 | 17 | LGP10 | 0.76 | 2.78E-02 | 4 | 4 |
| LGP10 | 0.77 | 2.65E-02 | 4 | 13 | LGP12 | 0.81 | 2.60E-02 | 3 | 3 |
| LGP18 | 0.83 | 2.01E-02 | 3 | 3 | LGP3 | 0.71 | 4.88E-02 | 4 | 4 |
|  |  |  |  |  | LGP46 | 0.71 | 7.57E-02 | 3 | 10 |
| LGP46 | 0.80 | 1.78E-02 | 4 | 15 | LGP46 | 0.85 | 6.92E-03 | 1 | 17 |
| LGP46 | 0.75 | 3.17E-02 | 1 | 2 | LGP46 | 0.94 | 4.58E-04 | 1 | 5 |
| LGP46 | 0.86 | 6.00E-03 | 1 | 11 | LGP46 | 0.78 | 2.20E-02 | 1 | 10 |
| LGP53 | 0.76 | 2.77E-02 | 2 | 17 | LGP53 | 0.75 | 3.06E-02 | 2 | 10 |
| LGP53 | 0.76 | 4.63E-02 | 3 | 3 | LGP53 | 0.80 | 1.83E-02 | 4 | 14 |
| LGP59 | 0.73 | 4.00E-02 | 2 | 1 | LGP59 | 0.79 | 2.06E-02 | 5 | 13 |
| LGP59 | 0.91 | 1.99E-03 | 1 | 1 | LGP6 | 0.81 | 2.73E-02 | 3 | 15 |
| LGP8 | 0.81 | 1.45E-02 | 5 | 7 | LYD691 | 0.76 | 4.75E-02 | 3 | 17 |
| LYD693 | 0.72 | 6.85E-02 | 3 | 5 | LYD693 | 0.80 | 1.60E-02 | 5 | 4 |
| LYD693 | 0.93 | 8.21E-04 | 5 | 12 | LYD693 | 0.76 | 2.74E-02 | 1 | 1 |

Table 52. Provided are the correlations (R) between the expression levels of yield improving genes and their homologues in tissues [leaf, flower, seed and root; Expression sets (Exp)] and the phenotypic performance in various yield, biomass, growth rate and/or vigor components [Correlation vector (corr.)] under normal conditions across *Arabidopsis* accessions.
"Corr. ID"—correlation set ID according to the correlated parameters specified in Table 50.
"Exp. Set"—Expression set specified in Table 50.
"R" = Pearson correlation coefficient;
"P" = p value.

Example 7

Production of *Arabidopsis* Transcriptome and High Throughput Correlation Analysis of Normal and Nitrogen Limiting Conditions Using 44K *Arabidopsis* Oligonucleotide Micro-Array In order to produce a high throughput correlation analysis, the present inventors utilized an *Arabidopsis* oligonucleotide micro-array, produced by Agilent Technologies [chem (dot) agilent (dot) com/Scripts/PDS (dot) asp?lPage=50879]. The array oligonucleotide represents about 44,000 *Arabidopsis* genes and transcripts. To define correlations between the levels of RNA expression with NUE, yield components or vigor related parameters various plant characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

Two tissues of plants [leaves and stems] growing at two different nitrogen fertilization levels (1.5 mM Nitrogen or 6 mM Nitrogen) were sampled and RNA was extracted as described hereinabove under "GENERAL EXPERIMENTAL AND BIOINFORMATICS METHODS". For convenience, each micro-array expression information tissue type has received a Set ID as summarized in Table 53 below.

TABLE 53

| Tissues used for *Arabidopsis* transcriptome expression sets | |
|---|---|
| Expression Set | Set ID |
| Leaves at 6 mM Nitrogen fertilization | 1 |
| Leaves at 1.5 mM Nitrogen fertilization | 2 |

TABLE 53-continued

| Tissues used for *Arabidopsis* transcriptome expression sets | |
|---|---|
| Expression Set | Set ID |
| Stems at 1.5 mM Nitrogen fertilization | 3 |
| Stems at 6 mM Nitrogen fertilization | 4 |

Table 53: Provided are the identification (ID) digits of each of the *Arabidopsis* expression sets.

Assessment of *Arabidopsis* yield components and vigor related parameters under different nitrogen fertilization levels—10 *Arabidopsis* accessions in 2 repetitive plots each containing 8 plants per plot were grown at greenhouse. The growing protocol used was as follows: surface sterilized seeds were sown in Eppendorf tubes containing 0.5× Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [rsb (dot) info (dot) nih (dot) gov/ij/] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

Data parameters collected are summarized in Table 54, hereinbelow.

TABLE 54

*Arabidopsis* correlated parameters (vectors)

| Correlated parameter with | Correlation ID |
|---|---|
| N 1.5 mM; 1000 Seeds weight [gr.] | 1 |
| N 1.5 mM; % Biomass reduction compared to N 6 mM | 2 |
| N 1.5 mM; DW/N level [gr/SPAD unit] | 3 |
| N 1.5 mM; Dry Weight [gr./plant] | 4 |
| N 1.5 mM; Harvest Index (ratio) | 5 |
| N 1.5 mM; Leaf Blade Area at day 10 [$cm^2$] | 6 |
| N 1.5 mM; Leaf Number at day 10 (number) | 7 |
| N 1.5 mM; RGR of Rosette Area at day 3 [$cm^2$/day] | 8 |
| N 1.5 mM; Rosette Area at day 10 [$cm^2$] | 9 |
| N 1.5 mM; Rosette Area at day 8 [$cm^2$] | 10 |
| N 1.5 mM; N level/DW [SPAD unit/gr.] | 11 |
| N 1.5 mM; Seed Yield [gr./plant] | 12 |
| N 1.5 mM; % Seed yield reduction compared to N 6 mM | 13 |
| N 1.5 mM; N level/FW [SPAD unit/gr.] | 14 |
| N 1.5 mM; seed yield/N level [gr/SPAD unit] | 15 |
| N 1.5 mM; seed yield/leaf blade [gr./$cm^2$] | 16 |
| N 1.5 mM; seed yield/rosette area at day 10 [gr./$cm^2$] | 17 |
| N 1.5 mM; t50 Flowering [day] | 18 |
| N 6 mM; DW/N level [gr./SPAD unit] | 19 |
| N 6 mM; N level/FW | 20 |
| N 6 mM; 1000 Seeds weight [gr.] | 21 |
| N 6 mM; Dry Weight [gr./plant] | 22 |
| N 6 mM; Harvest Index (ratio) | 23 |
| N 6 mM; Leaf Blade Area at day 10 ($cm^2$) | 24 |
| N 6 mM; Leaf Number at day 10 (number) | 25 |
| N 6 mM; RGR of Rosette Area at day 3 [$cm^2$/gr.] | 26 |
| N 6 mM; Rosette Area at day 10 [$cm^2$] | 27 |
| N 6 mM; Rosette Area at day 8 [$cm^2$] | 28 |
| N 6 mM; Seed Yield [gr./plant] | 29 |
| N 6 mM; Seed yield/N unit [gr./SPAD unit] | 30 |
| N 6 mM; seed yield/rosette area day at day 10 [gr./$cm^2$] | 31 |
| N 6 mM; seed yield/leaf blade [gr./$cm^2$] | 32 |
| N 6 mM; N level/DW (SPAD unit/gr. plant) | 33 |
| N 6 mM; t50 Flowering [day] | 34 |

Table 54. Provided are the *Arabidopsis* correlated parameters (vectors). "N" = Nitrogen at the noted concentrations; "gr." = grams; "SPAD" = chlorophyll levels; "t50" = time where 50% of plants flowered; "gr./SPAD unit" = plant biomass expressed in grams per unit of nitrogen in plant measured by SPAD. "DW" = Plant Dry Weight; "FW" = Plant Fresh weight; "N level/DW" = plant Nitrogen level measured in SPAD unit per plant biomass [gr.]; "DW/N level" = plant biomass per plant [gr.]/SPAD unit; Rosette Area (measured using digital analysis); Plot Coverage at the indicated day [%] (calculated by the dividing the total plant area with the total plot area); Leaf Blade Area at the indicated day [$cm^2$] (measured using digital analysis); RGR (relative growth rate) of Rosette Area at the indicated day [$cm^2$/day]; t50 Flowering [day] (the day in which 50% of plant flower); seed yield/rosette area at day 10 [gr/$cm^2$] (calculated); seed yield/leaf blade [gr/$cm^2$] (calculated); seed yield/N level [gr/SPAD unit] (calculated).

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process was repeated every 2-3 days starting at day 9-12 till day 16-19 (respectively) from transplanting.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at rsbweb (dot) nih (dot) gov/. Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate area of the rosette and the leaves was calculated according to Formulas IX and XIII, respectively, above.

Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The vegetative portion above ground was separated from the seeds. The total weight of the vegetative portion above ground and the seed weight of each plot were measured and divided by the number of plants.

Dry weight (vegetative biomass)=total weight of the vegetative portion above ground (excluding roots) after drying at 30° C. in a drying chamber; all the above ground biomass that is not yield.

Seed yield per plant=total seed weight per plant (gr).

Harvest Index (seed)—The harvest index was calculated using Formula XV as described above.

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in percentages (%).

Experimental Results 10 different *Arabidopsis* accessions (ecotypes) were grown and characterized for 34 parameters as described above. The average for each of the measured parameters was calculated using the JMP software (Table 55 below). Subsequent correlation analysis between the various transcriptome sets (Table 53) and the average parameters were conducted.

TABLE 55

Measured parameters in *Arabidopsis* accessions

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 0.02 | 0.02 | 0.02 | 0.01 | 0.02 | 0.01 | 0.01 | 0.02 | 0.02 | 0.02 |
| 2 | 60.75 | 76.71 | 78.56 | 78.14 | 78.64 | 73.19 | 83.07 | 77.19 | 70.12 | 62.97 |
| 4 | 0.16 | 0.12 | 0.08 | 0.11 | 0.12 | 0.13 | 0.11 | 0.15 | 0.17 | 0.18 |
| 5 | 0.19 | 0.20 | 0.29 | 0.08 | 0.07 | 0.24 | 0.18 | 0.08 | 0.08 | 0.03 |
| 6 | 0.33 | 0.27 | 0.37 | 0.39 | 0.37 | 0.39 | 0.35 | 0.38 | 0.31 | 0.37 |
| 7 | 6.88 | 7.31 | 7.31 | 7.88 | 7.75 | 7.63 | 7.19 | 8.63 | 5.93 | 7.94 |
| 8 | 0.63 | 0.79 | 0.50 | 0.49 | 0.72 | 0.83 | 0.65 | 0.67 | 0.64 | 0.61 |
| 9 | 1.43 | 1.33 | 1.77 | 1.97 | 1.83 | 1.82 | 1.64 | 2.00 | 1.15 | 1.75 |
| 10 | 0.76 | 0.71 | 1.06 | 1.16 | 1.00 | 0.91 | 0.94 | 1.12 | 0.64 | 1.00 |
| 12 | 0.03 | 0.03 | 0.02 | 0.01 | 0.01 | 0.03 | 0.02 | 0.01 | 0.01 | 0.01 |
| 13 | 72.56 | 84.70 | 78.78 | 88.00 | 92.62 | 76.71 | 81.94 | 91.30 | 85.76 | 91.82 |
| 16 | 0.09 | 0.09 | 0.06 | 0.03 | 0.02 | 0.08 | 0.06 | 0.03 | 0.04 | 0.01 |
| 17 | 0.02 | 0.02 | 0.01 | 0.01 | 0.00 | 0.02 | 0.01 | 0.01 | 0.01 | 0.00 |
| 18 | 15.97 | 20.97 | 14.84 | 24.71 | 23.70 | 18.06 | 19.49 | 23.57 | 21.89 | 23.57 |
| 21 | 0.01 | 0.02 | 0.02 | 0.01 | 0.02 | 0.02 | 0.01 | 0.02 | 0.02 | 0.02 |
| 22 | 0.42 | 0.53 | 0.38 | 0.52 | 0.58 | 0.50 | 0.63 | 0.65 | 0.57 | 0.50 |
| 23 | 0.28 | 0.31 | 0.28 | 0.16 | 0.21 | 0.28 | 0.17 | 0.21 | 0.17 | 0.14 |
| 24 | 0.34 | 0.31 | 0.52 | 0.45 | 0.43 | 0.50 | 0.43 | 0.51 | 0.41 | 0.43 |
| 25 | 6.25 | 7.31 | 8.06 | 8.75 | 8.75 | 8.38 | 7.13 | 9.44 | 6.31 | 8.06 |
| 26 | 0.69 | 1.02 | 0.61 | 0.60 | 0.65 | 0.68 | 0.58 | 0.61 | 0.52 | 0.48 |
| 27 | 1.41 | 1.57 | 2.67 | 2.42 | 2.14 | 2.47 | 1.97 | 2.72 | 1.64 | 2.21 |
| 28 | 0.76 | 0.86 | 1.48 | 1.28 | 1.10 | 1.24 | 1.09 | 1.41 | 0.89 | 1.22 |
| 29 | 0.12 | 0.17 | 0.11 | 0.08 | 0.12 | 0.14 | 0.11 | 0.14 | 0.09 | 0.07 |
| 31 | 0.08 | 0.11 | 0.04 | 0.03 | 0.06 | 0.06 | 0.06 | 0.05 | 0.06 | 0.03 |
| 32 | 0.34 | 0.53 | 0.21 | 0.18 | 0.28 | 0.28 | 0.25 | 0.27 | 0.24 | 0.16 |
| 34 | 16.37 | 20.50 | 14.63 | 24.00 | 23.60 | 15.03 | 19.75 | 22.89 | 18.80 | 23.38 |
| 3 | 0.01 | | | 0.00 | | 0.01 | | | 0.01 | 0.01 |
| 11 | 167.30 | | | 241.06 | | 194.98 | | | 169.34 | 157.82 |
| 14 | 45.59 | | | 42.11 | | 53.11 | | | 67.00 | 28.15 |
| 15 | 0.00 | | | 0.00 | | 0.00 | | | 0.00 | 0.00 |
| 19 | 0.02 | | | 0.02 | | 0.02 | | | 0.01 | 0.03 |
| 20 | 22.49 | | | 28.27 | | 33.32 | | | 39.00 | 17.64 |
| 30 | 0.00 | | | 0.00 | | 0.01 | | | 0.00 | 0.00 |
| 33 | 53.71 | | | 54.62 | | 66.48 | | | 68.05 | 35.55 |

Table 55. Provided are the measured parameters under various treatments in various ecotypes (*Arabidopsis* accessions).

TABLE 56

Correlation between the expression level of selected genes of some embodiments of the invention in various tissues and the phenotypic performance under normal or abiotic stress conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LGP1 | 0.70 | 2.35E-02 | 2 | 34 | LGP1 | 0.80 | 5.70E-03 | 1 | 18 |
| LGP1 | 0.91 | 2.31E-04 | 1 | 34 | LGP1 | 0.76 | 1.14E-02 | 1 | 13 |
| LGP1 | 0.72 | 1.80E-02 | 3 | 28 | LGP1 | 0.73 | 1.71E-02 | 3 | 5 |
| LGP10 | 0.77 | 1.47E-02 | 4 | 21 | LGP18 | 0.81 | 4.90E-03 | 2 | 2 |
| LGP3 | 0.72 | 2.76E-02 | 4 | 28 | LGP3 | 0.72 | 2.92E-02 | 4 | 7 |
| LGP39 | 0.85 | 1.66E-03 | 2 | 18 | LGP39 | 0.76 | 1.12E-02 | 2 | 34 |
| LGP39 | 0.75 | 1.17E-02 | 2 | 13 | LGP39 | 0.71 | 3.35E-02 | 4 | 7 |
| LGP44 | 0.81 | 4.29E-03 | 2 | 18 | LGP44 | 0.78 | 8.00E-03 | 2 | 13 |
| LGP44 | 0.70 | 2.36E-02 | 2 | 22 | LGP44 | 0.87 | 9.66E-04 | 3 | 18 |
| LGP44 | 0.79 | 6.40E-03 | 3 | 34 | LGP44 | 0.78 | 7.22E-03 | 3 | 13 |
| LGP46 | 0.83 | 3.10E-03 | 2 | 18 | LGP46 | 0.89 | 6.48E-04 | 2 | 34 |
| LGP46 | 0.92 | 1.84E-04 | 2 | 13 | LGP46 | 0.85 | 1.68E-03 | 2 | 22 |
| LGP46 | 0.71 | 3.39E-02 | 4 | 27 | LGP46 | 0.71 | 3.25E-02 | 4 | 9 |
| LGP46 | 0.87 | 9.96E-04 | 1 | 18 | LGP46 | 0.79 | 6.55E-03 | 1 | 34 |
| LGP46 | 0.83 | 2.66E-03 | 1 | 13 | LGP46 | 0.76 | 1.00E-02 | 1 | 1 |
| LGP46 | 0.76 | 1.13E-02 | 3 | 34 | LGP50 | 0.79 | 6.49E-03 | 2 | 18 |
| LGP50 | 0.76 | 1.10E-02 | 2 | 34 | LGP50 | 0.73 | L64E-02 | 2 | 13 |
| LGP50 | 0.72 | 1.92E-02 | 1 | 22 | LGP53 | 0.80 | 8.99E-03 | 4 | 25 |
| LGP53 | 0.76 | 1.86E-02 | 4 | 28 | LGP53 | 0.71 | 3.13E-02 | 4 | 10 |
| LGP53 | 0.83 | 5.75E-03 | 4 | 7 | LGP53 | 0.76 | 1.85E-02 | 4 | 27 |
| LGP59 | 0.82 | 3.33E-03 | 2 | 2 | LGP59 | 0.76 | 1.12E-02 | 1 | 5 |
| LGP6 | 0.78 | 8.36E-03 | 1 | 17 | LGP6 | 0.76 | 9.94E-03 | 1 | 16 |
| LGP6 | 0.78 | 8.30E-03 | 1 | 12 | LGP6 | 0.88 | 7.08E-04 | 1 | 5 |
| LGP6 | 0.81 | 4.68E-03 | 3 | 23 | LGP6 | 0.81 | 4.39E-03 | 3 | 12 |
| LGP6 | 0.86 | 1.62E-03 | 3 | 5 | LGP9 | 0.73 | 1.62E-02 | 2 | 17 |
| LGP9 | 0.91 | 2.42E-04 | 2 | 31 | LGP9 | 0.78 | 7.36E-03 | 2 | 16 |
| LGP9 | 0.92 | 1.99E-04 | 2 | 32 | LGP9 | 0.89 | 4.89E-04 | 2 | 26 |

TABLE 56-continued

Correlation between the expression level of selected genes of some embodiments of the invention in various tissues and the phenotypic performance under normal or abiotic stress conditions across *Arabidopsis* accessions

| Gene Name | R | P value | Exp. set | Corr. Set ID | Gene Name | R | P value | Exp. set | Corr. Set ID |
|---|---|---|---|---|---|---|---|---|---|
| LGP9 | 0.88 | 1.94E-03 | 4 | 25 | LGP9 | 0.74 | 2.27E-02 | 4 | 7 |
| LGP9 | 0.73 | 2.61E-02 | 4 | 27 | LGP9 | 0.73 | 2.62E-02 | 4 | 9 |
| LYD691 | 0.83 | 2.65E-03 | 2 | 21 | LYD691 | 0.90 | 9.18E-04 | 4 | 21 |
| LYD691 | 0.71 | 2.25E-02 | 1 | 21 | LYD691 | 0.92 | 1.81E-04 | 3 | 21 |

Table 56. Table 56. Provided are the correlations (R) between the expression levels of yield improving genes and their homologues in tissues [Leaves or stems; Expression sets (Exp)] and the phenotypic performance in various yield, biomass, growth rate and/or vigor components [Correlation vector (corr.)] under nitrogen limiting conditions or normal conditions across *Arabidopsis* accessions.
"Corr. ID"—correlation set ID according to the correlated parameters specified in Table 54.
"Exp. Set"—Expression set specified in Table 53.
"R" = Pearson correlation coefficient;
"P" = p value.

Example 8

Production of *Sorghum* Transcriptome and High Throughput Correlation Analysis with ABST Related Parameters Using 44K *Sorghum* Oligonucleotide Micro-Arrays In order to produce a high throughput correlation analysis between plant phenotype and gene expression level, the present inventors utilized a sorghum oligonucleotide micro-array, produced by Agilent Technologies [chem. (dot) agilent (dot) com/Scripts/PDS (dot) asp?1Page=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739 (dot) html].

I. Correlation of *Sorghum* Varieties Across Ecotypes Grown Under Regular Growth Conditions, Severe Drought Conditions and Low Nitrogen Conditions Experimental Procedures 17 *Sorghum* varieties were grown in 3 repetitive plots, in field. Briefly, the growing protocol was as follows:

1. Regular growth conditions: sorghum plants were grown in the field using commercial fertilization and irrigation protocols (370,000 liter per dunam (1000 square meters), fertilization of 14 units of nitrogen per dunam entire growth period).

2. Drought conditions: sorghum seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: sorghum plants were fertilized with 50% less amount of nitrogen in the field than the amount of nitrogen applied in the regular growth treatment. All the fertilizer was applied before flowering.

Analyzed *Sorghum* tissues—All 10 selected *Sorghum* hybrids were sampled per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 57 below.

TABLE 57

*Sorghum* transcriptome expression sets

| Expression Set | Set ID |
|---|---|
| Flag leaf at flowering stage under drought growth conditions | 1 |
| Flag leaf at flowering stage under low nitrogen growth conditions | 2 |
| Flag leaf at flowering stage under normal growth conditions | 3 |
| Flower meristem at flowering stage under drought growth conditions | 4 |
| Flower meristem at flowering stage under low nitrogen growth conditions | 5 |
| Flower meristem at flowering stage under normal growth conditions | 6 |
| Flower at flowering stage under drought growth conditions | 7 |
| Flower at flowering stage under low nitrogen growth conditions | 8 |
| Flower at flowering stage under normal growth conditions | 9 |

Table 57: Provided are the *sorghum* transcriptome expression sets 1-9. Flag leaf = the leaf below the flower; Flower meristem = Apical meristem following panicle initiation; Flower = the flower at the anthesis day. Expression sets 3, 6, and 9 are from plants grown under normal conditions; Expression sets 2, 5 and 8 are from plants grown under Nitrogen-limiting conditions; Expression sets 1, 4 and 7 are from plants grown under drought conditions.

The following parameters were collected using digital imaging system:

At the end of the growing period the grains were separated from the Plant 'Head' and the following parameters were measured and collected:

Average Grain Area ($cm^2$)—A sample of ~200 grains was weighted, photographed and images were processed using the below described image processing system. The grain area was measured from those images and was divided by the number of grains.

Upper and Lower Ratio Average of Grain Area, width, length, diameter and perimeter—Grain projection of area, width, diameter and perimeter were extracted from the digital images using open source package imagej (nih). Seed data was analyzed in plot average levels as follows:

Average of all seeds;

Average of upper 20% fraction—contained upper 20% fraction of seeds;

Average of lower 20% fraction—contained lower 20% fraction of seeds;

Further on, ratio between each fraction and the plot average was calculated for each of the data parameters.

At the end of the growing period 5 'Heads' were photographed and images were processed using the below described image processing system.

(i) Head Average Area (cm$^2$)—At the end of the growing period 5 'Heads' were photographed and images were processed using the below described image processing system. The 'Head' area was measured from those images and was divided by the number of 'Heads'.

(ii) Head Average Length (cm)—At the end of the growing period 5 'Heads' were photographed and images were processed using the below described image processing system. The 'Head' length (longest axis) was measured from those images and was divided by the number of 'Heads'.

(iii) Head Average width (cm)—At the end of the growing period 5 'Heads' were photographed and images were processed using the below described image processing system. The 'Head' width was measured from those images and was divided by the number of 'Heads'.

(iv) Head Average perimeter (cm)—At the end of the growing period 5 'Heads' were photographed and images were processed using the below described image processing system. The 'Head' perimeter was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight/Head (gr.) (grain yield)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gram—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants) plants.

Plant height—Plants were characterized for height during growing period at 5 time points. In each measure, plants were measured for their height using a measuring tape. Height was measured from ground level to top of the longest leaf.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative fresh weight and Heads—At the end of the experiment (when Inflorescence were dry) all Inflorescence and vegetative material from plots within blocks A-C were collected. The biomass and Heads weight of each plot was separated, measured and divided by the number of Heads.

Plant biomass (Fresh weight)—At the end of the experiment (when Inflorescence were dry) the vegetative material from plots within blocks A-C were collected. The plants biomass without the Inflorescence were measured and divided by the number of Plants.

FW Heads/(FW Heads+FW Plants)—The total fresh weight of heads and their respective plant biomass were measured at the harvest day. The heads weight was divided by the sum of weights of heads and plants.

Experimental Results 17 different sorghum varieties were grown and characterized for different parameters: The average for each of the measured parameters was calculated using the JMP software (Tables 59-60) and a subsequent correlation analysis between the various transcriptome sets (Table 57) and the average parameters, was conducted (Table 61). Results were then integrated to the database.

TABLE 58

*Sorghum* correlated parameters (vectors)

| Correlated parameter with | Correlation ID |
|---|---|
| Average Grain Area (cm$^2$), Drought | 1 |
| Average Grain Area (cm$^2$), Low N | 2 |
| Average Grain Area (cm$^2$), Normal | 3 |
| FW - Head/Plant (gr) (based on plot), Drought | 4 |
| FW - Head/Plant (gr.) (based on plot), Low N | 5 |
| FW - Head/Plant (gr.) (based on plot), Normal | 6 |
| FW - Head/Plant (gr.) (based on 5 plants), Low N | 7 |
| FW - Head/Plant (gr.) (based on 5 plants), Normal | 8 |
| FW Heads/(FW Heads + FW Plants)(all plot), Drought | 9 |
| FW Heads/(FW Heads + FW Plants)(all plot), Low N | 10 |
| FW Heads/(FW Heads + FW Plants) (all plot), Normal | 11 |
| FW/Plant (gr) (based on plot), Drought | 12 |
| FW/Plant (gr.) (based on plot), Low N | 13 |
| FW/Plant (gr.) (based on plot), Normal | 14 |
| Final Plant Height (cm), Drought | 15 |
| Final Plant Height (cm), Low N | 16 |
| Final Plant Height (cm), Normal | 17 |
| Head Average Area (cm$^2$), Drought | 18 |
| Head Average Area (cm$^2$), Low N | 19 |
| Head Average Area (cm$^2$), Normal | 20 |
| Head Average Length (cm), Drought | 21 |
| Head Average Length (cm), Low N | 22 |
| Head Average Length (cm), Normal | 23 |
| Head Average Perimeter (cm), Drought | 24 |
| Head Average Perimeter (cm), Low N | 25 |
| Head Average Perimeter (cm), Normal | 26 |
| Head Average Width (cm), Drought | 27 |
| Head Average Width (cm), Low N | 28 |
| Head Average Width (cm), Normal | 29 |
| Leaf SPAD 64 DPS (Days Post Sowing), Drought | 30 |
| Leaf SPAD 64 DPS (Days Post Sowing), Low N | 31 |
| Leaf SPAD 64 DPS (Days Post Sowing), Normal | 32 |
| Lower Ratio Average Grain Area (value), Low N | 33 |
| Lower Ratio Average Grain Area (value), Normal | 34 |
| Lower Ratio Average Grain Length (value), Low N | 35 |
| Lower Ratio Average Grain Length (value), Normal | 36 |
| Lower Ratio Average Grain Perimeter (value), Low N | 37 |
| Lower Ratio Average Grain Perimeter, (value) Normal | 38 |
| Lower Ratio Average Grain Width (value), Low N | 39 |
| Lower Ratio Average Grain Width (value), Normal | 40 |
| Total grain weight/Head (based on plot) (gr.), Low N | 41 |
| Total grain weight/Head (gr.) (based on 5 heads), Low N | 42 |
| Total grain weight/Head (gr.) (based on 5 heads), Normal | 43 |
| Total grain weight/Head (gr.) (based on plot), Normal | 44 |
| Total grain weight/Head (gr.) (based on plot), Drought | 45 |
| Upper Ratio Average Grain Area, Drought (value) | 46 |
| Upper Ratio Average Grain Area (value), Low N | 47 |
| Upper Ratio Average Grain Area (value), Normal | 48 |
| [Grain Yield + plant biomass/SPAD 64 DPS] (gr.), Normal | 49 |
| [Grain Yield + plant biomass/SPAD 64 DPS] (gr.), Low N | 50 |
| [Grain yield/SPAD 64 DPS] (gr.), Low N | 51 |
| [Grain yield/SPAD 64 DPS] (gr.), Normal | 52 |
| [Plant biomass (FW)/SPAD 64 DPS] (gr) Drought | 53 |
| [Plant biomass (FW)/SPAD 64 DPS] (gr.), Low N | 54 |

Table 58. Provided are the *Sorghum* correlated parameters (vectors). "gr." = grams; "SPAD" = chlorophyll levels; "FW" = Plant Fresh weight; "normal" = standard growth conditions.

TABLE 59

Measured parameters in *Sorghum* accessions

| Ecotype/Treatment | Line-1 | Line-2 | Line-3 | Line-4 | Line-5 | Line-6 | Line-7 | Line-8 | Line-9 |
|---|---|---|---|---|---|---|---|---|---|
| 1 | 0.10 | 0.11 | 0.11 | 0.09 | 0.09 | 0.11 | | | |
| 2 | 0.11 | 0.11 | 0.14 | 0.12 | 0.14 | 0.13 | 0.12 | 0.12 | 0.12 |
| 3 | 0.105 | 0.112 | 0.131 | 0.129 | 0.139 | 0.141 | 0.110 | 0.113 | 0.102 |
| 4 | 154.90 | 122.02 | 130.51 | 241.11 | 69.03 | 186.41 | 62.11 | 39.02 | 58.94 |
| 5 | 214.78 | 205.05 | 73.49 | 122.96 | 153.07 | 93.23 | 134.11 | 77.43 | 129.63 |
| 6 | 175.15 | 223.49 | 56.40 | 111.62 | 67.34 | 66.90 | 126.18 | 107.74 | 123.86 |
| 7 | 388.00 | 428.67 | 297.67 | 280.00 | 208.33 | 303.67 | 436.00 | 376.33 | 474.67 |
| 8 | 406.50 | 518.00 | 148.00 | 423.00 | 92.00 | 101.33 | 423.50 | 386.50 | 409.50 |
| 9 | 0.42 | 0.47 | 0.42 | 0.37 | 0.23 | 0.31 | 0.41 | 0.44 | 0.40 |
| 10 | 0.51 | 0.51 | 0.17 | 0.39 | 0.21 | 0.19 | 0.48 | 0.37 | 0.42 |
| 11 | 0.51 | 0.51 | 0.12 | 0.26 | 0.12 | 0.18 | 0.46 | 0.43 | 0.42 |
| 12 | 207.99 | 138.02 | 255.41 | 402.22 | 233.55 | 391.75 | 89.31 | 50.61 | 87.02 |
| 13 | 204.78 | 199.64 | 340.51 | 240.60 | 537.78 | 359.40 | 149.20 | 129.06 | 178.71 |
| 14 | 162.56 | 212.59 | 334.83 | 313.46 | 462.28 | 318.26 | 151.13 | 137.60 | 167.98 |
| 15 | 89.40 | 75.73 | 92.10 | 94.30 | 150.80 | 110.73 | 99.20 | 84.00 | 99.00 |
| 16 | 104.00 | 80.93 | 204.73 | 125.40 | 225.40 | 208.07 | 121.40 | 100.27 | 121.13 |
| 17 | 95.25 | 79.20 | 197.85 | 234.20 | 189.40 | 194.67 | 117.25 | 92.80 | 112.65 |
| 18 | 83.14 | 107.79 | 88.68 | 135.91 | 90.76 | 123.95 | 86.06 | 85.20 | 113.10 |
| 19 | 96.24 | 214.72 | 98.59 | 182.83 | 119.64 | 110.19 | 172.36 | 84.81 | 156.25 |
| 20 | 120.14 | 167.60 | 85.14 | 157.26 | 104.00 | 102.48 | 168.54 | 109.32 | 135.13 |
| 21 | 21.63 | 21.94 | 21.57 | 22.01 | 20.99 | 28.60 | 21.35 | 20.81 | 24.68 |
| 22 | 23.22 | 25.58 | 20.93 | 28.43 | 24.32 | 22.63 | 32.11 | 20.38 | 26.69 |
| 23 | 25.58 | 26.84 | 21.02 | 26.84 | 23.14 | 21.82 | 31.33 | 23.18 | 25.70 |
| 24 | 52.78 | 64.49 | 56.59 | 64.37 | 53.21 | 71.66 | 55.61 | 52.96 | 69.83 |
| 25 | 56.32 | 79.20 | 53.25 | 76.21 | 67.27 | 59.49 | 79.28 | 51.52 | 69.88 |
| 26 | 61.22 | 67.90 | 56.26 | 65.38 | 67.46 | 67.46 | 74.35 | 56.16 | 61.64 |
| 27 | 4.83 | 6.31 | 5.16 | 7.78 | 5.28 | 5.49 | 5.04 | 5.07 | 5.77 |
| 28 | 5.26 | 10.41 | 5.93 | 8.25 | 6.19 | 6.12 | 6.80 | 5.25 | 7.52 |
| 29 | 5.97 | 7.92 | 4.87 | 7.43 | 5.58 | 5.88 | 6.78 | 5.99 | 6.62 |
| 30 | 40.58 | 40.88 | 45.01 | 42.30 | 45.24 | 40.56 | 44.80 | 45.07 | 40.65 |
| 31 | 38.33 | 38.98 | 42.33 | 40.90 | 43.15 | 39.85 | 42.68 | 43.31 | 39.01 |
| 32 | 43.01 | . | 43.26 | 44.74 | 45.76 | 41.61 | 45.21 | 45.14 | 43.03 |
| 33 | 0.82 | 0.77 | 0.81 | 0.79 | 0.78 | 0.80 | 0.83 | 0.79 | 0.81 |
| 34 | 0.825 | 0.740 | 0.778 | 0.802 | 0.697 | 0.699 | 0.827 | 0.805 | 0.841 |
| 35 | 0.91 | 0.90 | 0.92 | 0.90 | 0.91 | 0.93 | 0.92 | 0.89 | 0.90 |
| 36 | 0.914 | 0.884 | 0.921 | 0.908 | 0.890 | 0.877 | 0.913 | 0.903 | 0.920 |
| 37 | 0.90 | 0.88 | 0.92 | 0.90 | 0.92 | 0.92 | 0.92 | 0.89 | 0.90 |
| 38 | 0.91 | 0.87 | 0.91 | 0.95 | 0.90 | 0.91 | 0.91 | 0.91 | 0.92 |
| 39 | 0.90 | 0.85 | 0.89 | 0.88 | 0.86 | 0.87 | 0.91 | 0.89 | 0.90 |
| 40 | 0.91 | 0.83 | 0.85 | 0.87 | 0.79 | 0.80 | 0.90 | 0.89 | 0.91 |
| 41 | 25.95 | 30.57 | 19.37 | 35.62 | 25.18 | 22.18 | 49.96 | 27.48 | 51.12 |
| 42 | 50.27 | 50.93 | 36.13 | 73.10 | 37.87 | 36.40 | 71.67 | 35.00 | 76.73 |
| 43 | 47.40 | 46.30 | 28.37 | 70.40 | 32.15 | 49.23 | 63.45 | 44.45 | 56.65 |
| 44 | 31.12 | 26.35 | 18.72 | 38.38 | 26.67 | 28.84 | 47.67 | 31.00 | 39.99 |
| 45 | 22.11 | 16.77 | 9.19 | 104.44 | 3.24 | 22.00 | 9.97 | 18.58 | 29.27 |
| 46 | 1.31 | 1.19 | 1.29 | 1.46 | 1.21 | 1.21 | | | |
| 47 | 1.18 | 1.31 | 1.11 | 1.21 | 1.19 | 1.18 | 1.16 | 1.23 | 1.17 |
| 48 | 1.22 | 1.30 | 1.13 | 1.14 | 1.16 | 1.15 | 1.19 | 1.23 | 1.25 |
| 49 | 4.50 | 8.17 | 7.87 | 10.68 | 8.34 | 4.40 | 3.74 | 4.83 | 3.67 |
| 50 | 6.02 | 5.91 | 8.50 | 6.75 | 13.05 | 9.58 | 4.67 | 3.61 | 5.89 |
| 51 | 0.68 | 0.78 | 0.46 | 0.87 | 0.58 | 0.56 | 1.17 | 0.63 | 1.31 |
| 52 | 3.78 | 7.74 | 7.01 | 10.10 | 7.65 | 3.34 | 3.05 | 3.90 | 2.83 |
| 53 | 5.13 | 3.38 | 5.67 | 9.51 | 5.16 | 9.66 | 1.99 | 1.12 | 2.14 |
| 54 | 5.34 | 5.12 | 8.05 | 5.88 | 12.46 | 9.02 | 3.50 | 2.98 | 4.58 |
| 55 | 0.72 | 0.43 | 0.86 | 0.58 | 0.69 | 1.05 | 0.69 | 0.93 | 0.84 |

Table 59: Provided are the values of each of the parameters (as described above) measured in *Sorghum* accessions (ecotype) under normal, low nitrogen and drought conditions. Growth conditions are specified in the experimental procedure section.

TABLE 60

Additional measured parameters in *Sorghum* accessions

| Ecotype/Treatment | Line-10 | Line-11 | Line-12 | Line-13 | Line-14 | Line-15 | Line-16 | Line-17 |
|---|---|---|---|---|---|---|---|---|
| 1 | | | | | | | | |
| 2 | 0.13 | 0.13 | 0.12 | 0.12 | 0.11 | 0.11 | 0.12 | 0.11 |
| 3 | 0.118 | 0.121 | 0.111 | 0.117 | 0.108 | 0.105 | 0.110 | 0.105 |
| 4 | 76.37 | 33.47 | 42.20 | 41.53 | 131.67 | 60.84 | 44.33 | 185.44 |
| 5 | 99.83 | 76.95 | 84.25 | 92.24 | 138.83 | 113.32 | 95.50 | 129.49 |
| 6 | 102.75 | 82.33 | 77.59 | 91.17 | 150.44 | 109.10 | 107.58 | 130.88 |
| 7 | 437.67 | 383.00 | 375.00 | 425.00 | 434.00 | 408.67 | 378.50 | 432.00 |
| 8 | 328.95 | 391.00 | 435.75 | 429.50 | 441.00 | 415.75 | 429.50 | 428.50 |
| 9 | 0.44 | 0.47 | 0.47 | 0.48 | 0.35 | 0.35 | 0.23 | 0.33 |
| 10 | 0.44 | 0.43 | 0.39 | 0.44 | 0.44 | 0.44 | 0.43 | 0.42 |

TABLE 60-continued

Additional measured parameters in Sorghum accessions

| Ecotype/Treatment | Line-10 | Line-11 | Line-12 | Line-13 | Line-14 | Line-15 | Line-16 | Line-17 |
|---|---|---|---|---|---|---|---|---|
| 11 | 0.44 | 0.46 | 0.45 | 0.45 | 0.51 | 0.46 | 0.44 | 0.39 |
| 12 | 120.43 | 37.21 | 48.18 | 44.20 | 231.60 | 116.01 | 123.08 | 342.50 |
| 13 | 124.27 | 101.33 | 132.12 | 117.90 | 176.99 | 143.67 | 126.98 | 180.45 |
| 14 | 128.97 | 97.62 | 99.32 | 112.24 | 157.42 | 130.55 | 135.66 | 209.21 |
| 15 | 92.20 | 81.93 | 98.80 | 86.47 | 99.60 | 83.00 | 83.53 | 92.30 |
| 16 | 94.53 | 110.00 | 115.07 | 104.73 | 173.67 | 115.60 | 138.80 | 144.40 |
| 17 | 97.50 | 98.00 | 100.00 | 105.60 | 151.15 | 117.10 | 124.45 | 126.50 |
| 18 | 100.79 | 80.41 | 126.89 | 86.41 | 92.29 | 77.89 | 76.93 | |
| 19 | 136.71 | 137.70 | 96.54 | 158.19 | 163.95 | 138.39 | 135.46 | 165.64 |
| 20 | 169.03 | 156.10 | 112.14 | 154.74 | 171.70 | 168.51 | 162.51 | 170.46 |
| 21 | 24.28 | 21.95 | 24.98 | 19.49 | 20.42 | 16.81 | 18.88 | |
| 22 | 26.31 | 25.43 | 23.11 | 27.87 | 28.88 | 27.64 | 25.52 | 30.33 |
| 23 | 28.82 | 28.13 | 22.97 | 28.09 | 30.00 | 30.54 | 27.17 | 29.26 |
| 24 | 65.14 | 55.27 | 69.06 | 53.32 | 56.29 | 49.12 | 51.88 | |
| 25 | 66.17 | 67.37 | 57.90 | 70.61 | 73.76 | 66.87 | 65.40 | 75.97 |
| 26 | 71.40 | 68.56 | 56.44 | 67.79 | 71.54 | 78.94 | 67.03 | 74.11 |
| 27 | 5.37 | 4.66 | 6.35 | 5.58 | 5.76 | 5.86 | 5.10 | |
| 28 | 6.59 | 6.85 | 5.32 | 7.25 | 7.19 | 6.27 | 6.57 | 6.82 |
| 29 | 7.42 | 6.98 | 6.19 | 7.02 | 7.18 | 7.00 | 7.39 | 7.35 |
| 30 | 45.43 | 42.58 | 44.18 | 44.60 | 42.41 | 43.25 | 40.30 | 40.75 |
| 31 | 42.71 | 40.08 | 43.98 | 45.44 | 44.75 | 42.58 | 43.81 | 46.73 |
| 32 | 45.59 | 44.83 | 45.33 | 46.54 | 43.99 | 45.09 | 45.14 | 43.13 |
| 33 | 0.77 | 0.74 | 0.80 | 0.79 | 0.82 | 0.80 | 0.81 | 0.81 |
| 34 | 0.788 | 0.765 | 0.803 | 0.806 | 0.821 | 0.814 | 0.818 | 0.817 |
| 35 | 0.91 | 0.89 | 0.90 | 0.89 | 0.91 | 0.89 | 0.89 | 0.90 |
| 36 | 0.923 | 0.893 | 0.913 | 0.907 | 0.911 | 0.904 | 0.903 | 0.913 |
| 37 | 0.91 | 0.89 | 0.90 | 0.90 | 0.91 | 0.89 | 0.90 | 0.90 |
| 38 | 0.93 | 0.91 | 0.92 | 0.90 | 0.91 | 0.90 | 0.91 | 0.91 |
| 39 | 0.86 | 0.84 | 0.90 | 0.89 | 0.91 | 0.90 | 0.90 | 0.90 |
| 40 | 0.85 | 0.86 | 0.88 | 0.90 | 0.90 | 0.91 | 0.90 | 0.90 |
| 41 | 36.84 | 29.45 | 26.70 | 29.42 | 51.12 | 37.04 | 39.85 | 41.78 |
| 42 | 57.58 | 42.93 | 36.47 | 68.60 | 71.80 | 49.27 | 43.87 | 52.07 |
| 43 | 60.00 | 45.45 | 58.19 | 70.60 | 70.10 | 53.95 | 59.87 | 52.65 |
| 44 | 38.36 | 32.10 | 32.69 | 32.79 | 51.53 | 35.71 | 38.31 | 42.44 |
| 45 | 10.45 | 14.77 | 12.86 | 18.24 | 11.60 | 18.65 | 16.36 | |
| 46 | | | | | | | | |
| 47 | 1.22 | 1.24 | 1.19 | 1.23 | 1.16 | 1.34 | 1.21 | 1.21 |
| 48 | 1.24 | 1.32 | 1.22 | 1.18 | 1.18 | 1.22 | 1.25 | 1.22 |
| 49 | 2.89 | 2.91 | 3.12 | 4.75 | 3.69 | 3.85 | 5.84 | |
| 50 | 3.77 | 3.26 | 3.61 | 3.24 | 5.10 | 4.25 | 3.81 | 4.76 |
| 51 | 0.86 | 0.73 | 0.61 | 0.65 | 1.14 | 0.87 | 0.91 | 0.89 |
| 52 | 2.18 | 2.19 | 2.41 | 3.58 | 2.90 | 3.01 | 4.85 | |
| 53 | 2.65 | 0.87 | 1.09 | 0.99 | 5.46 | 2.68 | 3.05 | 8.40 |
| 54 | 2.91 | 2.53 | 3.00 | 2.60 | 3.96 | 3.38 | 2.90 | 3.86 |
| 55 | 0.72 | 0.72 | 0.70 | 1.17 | 0.79 | 0.85 | 0.98 | |

Table 60: Provided are the values of each of the parameters (as described above) measured in Sorghum accessions (ecotype) under normal, low nitrogen and drought conditions. Growth conditions are specified in the experimental procedure section.

TABLE 61

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGP102 | 0.75 | 1.27E−02 | 6 | 17 | LGP102 | 0.70 | 2.42E−02 | 6 | 20 |
| LGP102 | 0.87 | 1.10E−03 | 4 | 53 | LGP102 | 0.86 | 1.50E−03 | 4 | 4 |
| LGP102 | 0.87 | 9.79E−04 | 4 | 12 | | | | | |
| LGP52 | 0.71 | 2.13E−02 | 6 | 17 | LGP52 | 0.78 | 7.56E−03 | 6 | 44 |
| LGP52 | 0.74 | 1.48E−02 | 6 | 36 | MGP7 | 0.76 | 1.06E−02 | 9 | 17 |

Table 61. Provided are the correlations (R) between the expression levels of yield improving genes and their homologues in tissues [Flag leaf, Flower meristem, stem and Flower; Expression sets (Exp)] and the phenotypic performance in various yield, biomass, growth rate and/or vigor components [Correlation vector (corr.)] under stress conditions or normal conditions across Sorghum accessions.
P = p value.

II. Correlation of Sorghum Varieties Across Ecotype Grown Under Salinity Stress and Cold Stress Conditions Sorghum vigor related parameters under 100 mM NaCl and low temperature (10±2° C.)—Ten Sorghum varieties were grown in 3 repetitive plots, each containing 17 plants, at a net house under semi-hydroponics conditions. Briefly, the growing protocol was as follows: Sorghum seeds were sown in trays filled with a mix of vermiculite and peat in a 1:1 ratio. Following germination, the trays were transferred to the high salinity solution (100 mM NaCl in addition to the Full Hogland solution), low temperature (10±2° C. in the presence of Full Hogland solution) or at Normal growth solution [Full Hogland solution at 28±2° C.].

Full Hogland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenyl acetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

All 10 selected varieties were sampled per each treatment. Two tissues [leaves and roots] growing at 100 mM NaCl, low temperature (10±2° C.) or under Normal conditions (full Hogland at a temperature between 28±2° C.) were sampled and RNA was extracted as described hereinabove under "GENERAL EXPERIMENTAL AND BIOINFORMATICS METHODS".

TABLE 62

Sorghum transcriptome expression sets

| Expression Set | Set ID |
|---|---|
| root at vegetative stage (V4-V5) under cold conditions | 1 |
| root vegetative stage (V4-V5) under normal conditions | 2 |
| root vegetative stage (V4-V5) under low nitrogen conditions | 3 |
| root vegetative stage (V4-V5) under salinity conditions | 4 |
| vegetative meristem at vegetative stage (V4-V5) under cold conditions | 5 |
| vegetative meristem at vegetative stage (V4-V5) under low nitrogen conditions | 6 |
| vegetative meristem at vegetative stage (V4-V5) under salinity conditions | 7 |
| vegetative meristem at vegetative stage (V4-V5) under normal conditions | 8 |

Table 62: Provided are the Sorghum transcriptome expression sets. Cold conditions = 10 ± 2° C.; NaCl = 100 mM NaCl; low nitrogen = 1.2 mM Nitrogen; Normal conditions = 16 mM Nitrogen.

Sorghum Biomass, Vigor, Nitrogen Use Efficiency and Growth-Related Components

Root DW (dry weight)—At the end of the experiment, the root material was collected, measured and divided by the number of plants.

Shoot DW—At the end of the experiment, the shoot material (without roots) was collected, measured and divided by the number of plants.

Total biomass—total biomass including roots and shoots.

Plant leaf number—Plants were characterized for leaf number at 3 time points during the growing period. In each measure, plants were measured for their leaf number by counting all the leaves of 3 selected plants per plot.

Shoot/root Ratio—The shoot/root Ratio was calculated using Formula XXX above.

Percent of reduction of root biomass compared to normal—the difference (reduction in percent) between root biomass under normal and under low nitrogen conditions.

Percent of reduction of shoot biomass compared to normal—the difference (reduction in percent) between shoot biomass under normal and under low nitrogen conditions.

Percent of reduction of total biomass compared to normal—the difference (reduction in percent) between total biomass (shoot and root) under normal and under low nitrogen conditions Plant height—Plants were characterized for height at 3 time points during the growing period. In each measure, plants were measured for their height using a measuring tape. Height was measured from ground level to top of the longest leaf Relative Growth Rate of leaf number was calculated using Formula VIII above.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Root Biomass [DW-gr.]/SPAD—root biomass divided by SPAD results.

Shoot Biomass [DW-gr.]/SPAD—shoot biomass divided by SPAD results.

Total Biomass-Root+Shoot [DW-gr.]/SPAD—total biomass divided by SPAD results.

Plant nitrogen level—calculated as SPAD/leaf biomass—The chlorophyll content of leaves is a good indicator of the nitrogen plant status since the degree of leaf greenness is highly correlated to this parameter.

Experimental Results 10 different Sorghum varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameters was calculated using the JMP software and values are summarized in Table 64 below. Subsequent correlation analysis between the various transcriptome sets and the average parameters were conducted (Table 65). Results were then integrated to the database.

TABLE 63

Sorghum correlated parameters (vectors)

| Correlated parameter with | Correlation ID |
|---|---|
| DW Root/Plant (gr./number)- 100 mM NaCl | 1 |
| DW Root/Plant, (gr/number) under Cold | 2 |
| DW Root/Plant (gr./number) at Low Nitrogen | 3 |
| DW Root/Plant (gr/number) - Normal | 4 |
| DW Shoot/Plant (gr./number) at Low Nitrogen | 5 |
| DW Shoot/Plant (gr./number) - 100 mM NaCl | 6 |
| DW Shoot/Plant, (gr/number) under Cold | 7 |
| DW Shoot/Plant (gr/number) - Normal | 8 |
| Leaf number (at time point 1), under 100 mM NaCl | 9 |
| Leaf number (at time point 1), under Cold | 10 |
| Leaf number (at time point 1), [Low Nitrogen] | 11 |
| Leaf number (at time point 1), under Normal | 12 |
| Leaf number (at time point 2), under 100 mM NaCl | 13 |
| Leaf number (at time point 2), under Cold | 14 |
| Leaf number (at time point 2), [Low Nitrogen] | 15 |
| Leaf number (at time point 2), under Normal | 16 |
| Leaf number (at time point 3), under 100 mM NaCl | 17 |
| Leaf number (at time point 3), under Cold | 18 |
| Leaf number (at time point 3), [Low Nitrogen] | 19 |
| Leaf number (at time point 3), under Normal | 20 |
| Low N - total biomass DW (gr.) | 21 |
| Low N - Shoot/Root (ratio) | 22 |
| Low N (low nitrogen) roots DW (gr.) | 23 |
| Low N (low nitrogen) shoots DW (gr.) | 24 |
| Low N percent root biomass compared to normal | 25 |
| Low N percent shoot biomass compared to normal | 26 |
| Low N percent total biomass reduction compared to normal | 27 |
| N level/Leaf (SPAD/gr) [Low Nitrogen] | 28 |
| N level/Leaf (SPAD/gr) [100 mM NaCl] | 29 |
| N level/Leaf (SPAD/gr) [Cold] | 30 |
| N level/Leaf (SPAD/gr) [Normal] | 31 |

TABLE 63-continued

Sorghum correlated parameters (vectors)

| Correlated parameter with | Correlation ID |
|---|---|
| Normal, Shoot/Root (ratio) | 32 |
| Roots DW (gr) [normal] | 33 |
| Shoots DW (gr) [normal] | 34 |
| Total biomass (gr) [normal] | 35 |
| Plant Height (at time point 1), (cm)[100 mM NaCl] | 36 |
| Plant Height (at time point 1), (cm) under Cold | 37 |
| Plant Height (at time point 1), (cm)[Low Nitrogen] | 38 |
| Plant Height (at time point 1), (cm) [normal] | 39 |
| Plant Height (at time point 2), (cm) under Cold | 40 |
| Plant Height (at time point 2), (cm)[Low Nitrogen] | 41 |
| Plant Height (at time point 2), (cm) [normal] | 42 |
| Plant Height (at time point 2), (cm)[100 mM NaCl] | 43 |
| Plant Height (at time point 3), (cm) [100 mM NaCl] | 44 |
| Plant Height (at time point 3), (cm) [Low Nitrogen] | 45 |
| RGR Leaf Num Normal | 46 |
| Root Biomass (DW - gr.)/SPAD [100 mM NaCl] | 47 |
| Root Biomass (DW, gr.)/SPAD [Cold] | 48 |
| Root Biomass (DW, gr.)/SPAD [Low Nitrogen] | 49 |
| Root Biomass [DW, gr.]/SPAD [Normal] | 50 |
| SPAD, underCold | 51 |
| SPAD (number) at Low Nitrogen | 52 |
| SPAD (number) - Normal | 53 |
| SPAD at 100 mM NaCl (number) | 54 |
| Shoot Biomass (DW, gr.)/SPAD [100 mM NaCl] | 55 |
| Shoot Biomass (DW, gr.)/SPAD [Cold] | 56 |
| Shoot Biomass (DW, gr.)/SPAD [Low Nitrogen] | 57 |
| Shoot Biomass (DW, gr.)/SPAD [Normal] | 58 |
| Total Biomass (Root + Shoot; DW, gr.)/SPAD [100 mM NaCl] | 59 |
| Total Biomass (Root + Shoot; DW, gr.)/SPAD [Cold] | 60 |
| Total Biomass (Root + Shoot; DW, gr.)/SPAD [Low Nitrogen] | 61 |
| Total Biomass (Root + Shoot; DW, gr.)/SPAD [Normal] | 62 |

Table 63: Provided are the Sorghum correlated parameters. Cold conditions = 10 ± 2° C.; NaCl = 100 mM NaCl; low nitrogen = 1.2 mM Nitrogen; Normal conditions = 16 mM Nitrogen.

TABLE 64

Sorghum accessions, measured parameters

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 4 | 0.05 | 0.13 | 0.17 | 0.10 | 0.11 | 0.12 | 0.14 | 0.12 | 0.10 | 0.11 |
| 8 | 0.10 | 0.24 | 0.31 | 0.16 | 0.19 | 0.19 | 0.24 | 0.24 | 0.19 | 0.24 |
| 12 | 3.00 | 3.07 | 3.80 | 3.20 | 3.23 | 3.20 | 3.13 | 3.43 | 3.00 | 3.00 |
| 16 | 4.17 | 4.50 | 4.80 | 4.60 | 4.53 | 4.97 | 4.60 | 4.93 | 4.50 | 4.57 |
| 20 | 5.33 | 5.87 | 6.20 | 5.80 | 5.80 | 5.73 | 5.73 | 6.00 | 5.60 | 6.07 |
| 39 | 7.47 | 9.30 | 12.87 | 8.57 | 8.93 | 8.53 | 10.67 | 10.27 | 7.87 | 8.77 |
| 42 | 14.97 | 18.23 | 22.10 | 17.60 | 18.07 | 18.53 | 22.83 | 22.03 | 20.03 | 21.80 |
| 46 | 0.16 | 0.19 | 0.16 | 0.17 | 0.17 | 0.17 | 0.17 | 0.17 | 0.17 | 0.20 |
| 53 | 26.70 | 29.33 | 29.86 | 29.09 | 24.98 | 24.62 | 30.79 | 25.50 | 32.89 | 33.54 |
| 3 | 0.04 | 0.11 | 0.20 | 0.10 | 0.08 | 0.09 | 0.13 | 0.09 | 0.09 | 0.09 |
| 5 | 0.08 | 0.19 | 0.33 | 0.16 | 0.16 | 0.16 | 0.26 | 0.20 | 0.13 | 0.18 |
| 11 | 3.00 | 3.13 | 3.87 | 3.53 | 3.20 | 3.13 | 3.13 | 3.30 | 3.07 | 3.07 |
| 15 | 4.00 | 4.58 | 4.97 | 4.73 | 4.60 | 4.70 | 4.97 | 4.87 | 4.67 | 4.57 |
| 19 | 3.90 | 4.27 | 4.70 | 4.23 | 4.30 | 4.57 | 4.63 | 4.67 | 3.97 | 4.10 |
| 38 | 6.73 | 9.77 | 12.70 | 8.67 | 9.77 | 9.23 | 10.27 | 10.10 | 7.93 | 8.23 |
| 41 | 13.30 | 20.63 | 23.70 | 18.03 | 19.33 | 19.20 | 21.87 | 22.13 | 18.20 | 21.00 |
| 45 | 22.23 | 31.07 | 34.67 | 30.03 | 30.83 | 29.87 | 30.87 | 32.40 | 29.37 | 30.70 |
| 52 | 26.88 | 28.02 | 29.64 | 31.52 | 29.61 | 26.82 | 28.48 | 28.21 | 30.48 | 27.63 |
| 1 | 0.05 | 0.10 | 0.12 | 0.07 | 0.08 | 0.08 | 0.14 | 0.10 | 0.16 | 0.14 |
| 6 | 0.09 | 0.19 | 0.20 | 0.14 | 0.13 | 0.13 | 0.15 | 0.19 | 0.10 | 0.12 |
| 9 | 3.00 | 3.13 | 3.40 | 3.07 | 3.33 | 3.07 | 3.07 | 3.27 | 3.00 | 3.07 |
| 13 | 4.00 | 4.37 | 4.87 | 4.60 | 4.50 | 4.53 | 4.50 | 4.77 | 4.32 | 4.20 |
| 17 | 4.00 | 4.13 | 4.57 | 4.43 | 4.07 | 4.33 | 4.13 | 4.50 | 3.78 | 4.20 |
| 36 | 7.90 | 9.50 | 10.93 | 7.93 | 9.70 | 8.53 | 8.90 | 10.37 | 7.00 | 7.83 |
| 43 | 14.20 | 16.27 | 20.37 | 13.33 | 15.90 | 16.53 | 15.47 | 18.93 | 13.68 | 15.77 |
| 44 | 21.80 | 23.17 | 30.37 | 22.83 | 23.70 | 23.30 | 22.47 | 26.83 | 20.28 | 23.57 |
| 54 | 32.73 | 35.14 | 27.97 | 30.93 | 34.53 | 29.99 | 32.09 | 31.86 | 32.51 | 34.32 |
| 2 | 0.07 | 0.11 | 0.16 | 0.09 | 0.08 | 0.11 | 0.14 | 0.13 | 0.11 | 0.14 |
| 7 | 0.08 | 0.15 | 0.19 | 0.11 | 0.13 | 0.16 | 0.15 | 0.15 | 0.11 | 0.14 |
| 10 | 3.00 | 3.00 | 3.50 | 3.17 | 3.40 | 3.20 | 3.13 | 3.07 | 3.07 | 3.00 |
| 14 | 3.90 | 4.13 | 4.63 | 4.17 | 4.27 | 4.23 | 4.20 | 4.30 | 4.17 | 4.00 |
| 18 | 4.73 | 5.33 | 5.43 | 5.50 | 5.33 | 5.07 | 4.50 | 5.40 | 5.37 | 5.18 |
| 37 | 6.50 | 8.77 | 10.40 | 6.80 | 9.03 | 9.00 | 7.97 | 9.17 | 6.50 | 7.23 |
| 40 | 11.17 | 15.87 | 18.43 | 12.20 | 16.03 | 14.63 | 14.60 | 17.27 | 13.43 | 13.91 |
| 51 | 28.62 | 30.31 | 27.04 | 32.28 | 28.28 | 29.89 | 32.47 | 28.63 | 31.71 | 29.56 |
| 30 | 6.05 | 5.68 | 4.98 | 5.30 | 5.87 | 5.90 | 7.21 | 5.30 | 5.91 | 5.70 |
| 48 | 0.002 | 0.004 | 0.006 | 0.003 | 0.003 | 0.004 | 0.004 | 0.004 | 0.003 | 0.005 |
| 56 | 0.003 | 0.005 | 0.007 | 0.003 | 0.005 | 0.006 | 0.005 | 0.005 | 0.004 | 0.005 |
| 60 | 0.005 | 0.009 | 0.013 | 0.006 | 0.008 | 0.009 | 0.009 | 0.010 | 0.007 | 0.009 |
| 21 | 27.53 | 64.12 | 115.23 | 58.02 | 52.22 | 35.10 | 84.57 | 63.73 | 47.03 | 60.00 |
| 22 | 1.87 | 1.71 | 1.73 | 1.57 | 2.10 | 1.81 | 2.06 | 2.10 | 1.50 | 2.00 |
| 23 | 9.65 | 23.54 | 43.88 | 22.58 | 16.89 | 12.44 | 28.19 | 20.53 | 18.76 | 20.09 |
| 24 | 17.88 | 40.59 | 71.35 | 35.44 | 35.33 | 22.66 | 56.38 | 43.20 | 28.27 | 39.91 |
| 25 | 84.53 | 80.95 | 117.00 | 100.52 | 72.54 | 71.78 | 93.47 | 76.05 | 86.82 | 80.51 |
| 26 | 81.57 | 79.16 | 104.75 | 103.50 | 83.71 | 83.22 | 107.69 | 81.39 | 70.30 | 75.86 |
| 27 | 82.58 | 79.81 | 109.10 | 102.32 | 79.74 | 78.77 | 102.49 | 79.59 | 76.07 | 77.36 |
| 28 | 6.89 | 6.57 | 6.31 | 7.45 | 6.89 | 5.87 | 6.15 | 6.05 | 7.68 | 6.74 |

TABLE 64-continued

*Sorghum* accessions, measured parameters

| Ecotype/ Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 49 | 0.002 | 0.004 | 0.007 | 0.003 | 0.003 | 0.003 | 0.005 | 0.003 | 0.003 | 0.003 |
| 57 | 0.003 | 0.007 | 0.011 | 0.005 | 0.005 | 0.006 | 0.009 | 0.007 | 0.004 | 0.007 |
| 61 | 0.005 | 0.011 | 0.018 | 0.008 | 0.008 | 0.009 | 0.014 | 0.010 | 0.007 | 0.010 |
| 29 | 8.18 | 8.50 | 6.12 | 6.98 | 8.49 | 6.92 | 7.76 | 7.08 | 8.60 | 8.17 |
| 47 | 0.002 | 0.003 | 0.004 | 0.002 | 0.002 | 0.003 | 0.004 | 0.003 | 0.005 | 0.004 |
| 55 | 0.003 | 0.005 | 0.007 | 0.004 | 0.004 | 0.004 | 0.005 | 0.006 | 0.003 | 0.004 |
| 59 | 0.004 | 0.008 | 0.012 | 0.007 | 0.006 | 0.007 | 0.009 | 0.009 | 0.008 | 0.008 |
| 31 | 5.01 | 5.00 | 4.82 | 5.02 | 4.31 | 4.29 | 5.37 | 4.25 | 5.87 | 5.53 |
| 32 | 1.98 | 1.94 | 1.90 | 1.59 | 1.81 | 1.58 | 1.76 | 1.99 | 1.89 | 2.20 |
| 33 | 0.86 | 2.19 | 2.83 | 1.69 | 1.76 | 1.96 | 2.27 | 2.04 | 1.09 | 1.88 |
| 34 | 1.65 | 3.87 | 5.14 | 2.58 | 3.18 | 3.08 | 3.95 | 4.00 | 2.02 | 3.97 |
| 35 | 2.51 | 6.06 | 7.96 | 4.28 | 4.94 | 5.04 | 6.22 | 6.04 | 3.11 | 5.85 |
| 50 | 0.002 | 0.005 | 0.006 | 0.004 | 0.004 | 0.005 | 0.005 | 0.005 | 0.003 | 0.003 |
| 58 | 0.004 | 0.008 | 0.010 | 0.005 | 0.008 | 0.008 | 0.008 | 0.010 | 0.006 | 0.007 |
| 62 | 0.006 | 0.013 | 0.016 | 0.009 | 0.012 | 0.012 | 0.012 | 0.014 | 0.009 | 0.011 |

Table 64: Provided are the measured parameters under 100 mM NaCl and low temperature (8-10° C.) conditions of *Sorghum* accessions (Seed ID) according to the Correlation ID numbers (described in Table 63 above).

TABLE 65

Correlation between the expression level of selected genes of some embodiments of the invention in roots and the phenotypic performance under normal or abiotic stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LGP102 | 0.79 | 1.10E−02 | 6 | 52 | | | | | |
| LGP52 | 0.76 | 4.65E−02 | 3 | 15 | LGP52 | 0.71 | 7.55E−02 | 3 | 45 |
| LGP52 | 0.72 | 7.05E−02 | 3 | 38 | LGP52 | 0.74 | 2.14E−02 | 5 | 7 |
| LGP52 | 0.84 | 4.64E−03 | 5 | 48 | LGP52 | 0.80 | 9.65E−03 | 5 | 2 |
| LGP52 | 0.77 | 1.54E−02 | 5 | 56 | LGP52 | 0.83 | 6.12E−03 | 5 | 60 |
| LGP52 | 0.79 | 1.17E−02 | 5 | 14 | LGP52 | 0.87 | 2.45E−03 | 6 | 49 |
| LGP52 | 0.78 | 1.38E−02 | 6 | 27 | LGP52 | 0.87 | 2.26E−03 | 6 | 3 |
| LGP52 | 0.76 | 1.64E−02 | 6 | 25 | LGP52 | 0.87 | 2.38E−03 | 6 | 5 |
| LGP52 | 0.87 | 2.26E−03 | 6 | 23 | LGP52 | 0.87 | 2.58E−03 | 6 | 61 |
| LGP52 | 0.87 | 2.38E−03 | 6 | 24 | LGP52 | 0.71 | 3.05E−02 | 6 | 26 |
| LGP52 | 0.88 | 1.76E−03 | 6 | 21 | LGP52 | 0.85 | 3.96E−03 | 6 | 57 |

Table 65. Provided are the correlations (R) between the expression levels yield improving genes and their homologues in various tissues [Expression sets (Exp)] and the phenotypic performance [yield, biomass, growth rate and/or vigor components (Correlation vector)] under abiotic stress conditions (salinity) or normal conditions across *Sorghum* accessions. Corr.—Correlation vector as described hereinabove (Table 63). P = p value.

Example 9

Production of *Sorghum* Transcriptome and High Throughput Correlation Analysis Using 60K *Sorghum* Oligonucleotide Micro-Array In order to produce a high throughput correlation analysis between plant phenotype and gene expression level, the present inventors utilized a sorghum oligonucleotide microarray, produced by Agilent Technologies [chem. (dot) agilent (dot) com/Scripts/PDS (dot) asp?1Page=50879]. The array oligonucleotide represents about 60,000 sorghum genes and transcripts. In order to define correlations between the levels of RNA expression with vigor related parameters, various plant characteristics of 10 different sorghum hybrids were analyzed. The correlation between the RNA levels and the characterized parameters was analyzed using Pearson correlation test [davidmlane (dot) com/hyperstat/A34739 (dot) html].

Experimental Procedures

Correlation of *Sorghum* varieties across ecotypes grown in growth chambers under temperature of 30° C. or 14° C. at low light (100 µE) or high light (250 µE) conditions.

Analyzed *Sorghum* tissues—All 10 selected *Sorghum* hybrids were sampled per each condition. Leaf tissue growing under 30° C. and low light (100 µE m$^{-2}$ sec$^{-1}$), 14° C. and low light (100 µE m$^{-2}$ sec$^{-1}$), 30° C. and high light (250 µE m$^{-2}$ sec$^{-1}$), 14° C. and high light (250 µE m$^{-2}$ sec$^{-1}$) were sampled at vegetative stage of four-five leaves and RNA was extracted as described above. Each micro-array expression information tissue type has received a Set ID as summarized in Table 66 below.

TABLE 66

Sorghum transcriptome expression sets in field experiments

| Description | Expression set |
|---|---|
| *Sorghum*/leaf, under 14 Celsius degrees and high light (light on) | 1 |
| *Sorghum*/leaf, under 14 Celsius degrees and low light (light on) | 2 |
| *Sorghum*/leaf, under 30 Celsius degrees and high light (light on) | 3 |
| *Sorghum*/leaf, under 30 Celsius degrees and low light (light on) | 4 |

Table 66: Provided are the sorghum transcriptome expression sets.

The following parameters were collected by sampling 8-10 plants per plot or by measuring the parameter across all the plants within the plot (Table 67 below).

Relative Growth Rate of vegetative dry weight was performed using Formula VII.

Leaves number—Plants were characterized for leaf number during growing period. In each measure, plants were measured for their leaf number by counting all the leaves of selected plants per plot.

Shoot FW—shoot fresh weight (FW) per plant, measurement of all vegetative tissue above ground.

Shoot DW—shoot dry weight (DW) per plant, measurement of all vegetative tissue above ground after drying at 70° C. in oven for 48 hours.

The average for each of the measured parameters was calculated and values are summarized in Tables 68-71 below. Subsequent correlation analysis was performed (Tables 72-75). Results were then integrated to the database.

TABLE 67

Sorghum correlated parameters (vectors)

| Correlated parameter with | Correlation ID |
|---|---|
| Leaves number | 1 |
| RGR (relative growth rate) | 2 |
| Shoot DW (dry weight) (gr.) | 3 |
| Shoot FW (fresh weight) (gr.) | 4 |

Table 67. Provided are the *Sorghum* correlated parameters (vectors).

TABLE 68

Measured parameters in *Sorghum* accessions under 14° C. and low light (100 µE m$^{-2}$ sec$^{-1}$)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 3.00 | 3.00 | 2.75 | 2.75 | 2.63 | 3.00 | 3.50 | 2.75 | 2.43 | 2.00 |
| 2 | 0.032 | −0.014 | −0.022 | 0.024 | −0.037 | −0.045 | 0.083 | NA | −0.050 | −0.073 |
| 3 | 0.041 | 0.013 | 0.013 | 0.009 | 0.011 | 0.011 | 0.031 | 0.009 | 0.009 | 0.009 |
| 4 | 0.55 | 0.30 | 0.33 | 0.28 | 0.36 | 0.36 | 0.58 | 0.22 | 0.18 | 0.30 |

Table 68: Provided are the values of each of the parameters (as described above) measured in *Sorghum* accessions (Seed ID) under 14° C. and low light (100 µE m$^{-2}$ sec$^{-1}$).

TABLE 69

Measured parameters in *Sorghum* accessions under 30° C. and low light (100 µE m$^{-2}$ sec$^{-1}$)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 5.27 | 5.00 | 4.75 | 4.00 | 4.00 | 4.00 | 5.25 | 4.50 | 3.75 | 4.00 |
| 2 | 0.099 | 0.098 | 0.090 | 0.122 | 0.108 | 0.084 | 0.113 | 0.121 | 0.042 | 0.039 |
| 3 | 0.114 | 0.079 | 0.071 | 0.056 | 0.093 | 0.077 | 0.040 | 0.055 | 0.036 | 0.050 |
| 4 | 1.35 | 1.05 | 0.88 | 0.95 | 1.29 | 1.13 | 0.71 | 0.79 | 0.67 | 0.82 |

Table 69: Provided are the values of each of the parameters (as described above) measured in *Sorghum* accessions (Seed ID) under 30° C. and low light (100 µE m$^{-2}$ sec$^{-1}$).

TABLE 70

Measured parameters in *Sorghum* accessions under 30° C. and high light (250 µE m$^{-2}$ sec$^{-1}$)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 4.00 | 3.70 | 3.50 | 3.33 | 4.00 | 4.00 | 3.60 | 3.40 | 3.30 | 3.40 |
| 2 | 0.098 | 0.096 | 0.087 | 0.070 | 0.094 | 0.118 | 0.097 | 0.099 | 0.106 | 0.121 |
| 3 | 0.076 | 0.050 | 0.047 | 0.036 | 0.065 | 0.085 | 0.049 | 0.042 | 0.042 | 0.062 |
| 4 | 0.77 | 0.52 | 0.49 | 0.38 | 0.71 | 0.86 | 0.49 | 0.45 | 0.44 | 0.67 |

Table 70: Provided are the values of each of the parameters (as described above) measured in *Sorghum* accessions (Seed ID) under 30° C. and high light (250 µE m$^{-2}$ sec$^{-1}$).

TABLE 71

Measured parameters in *Sorghum* accessions under 14° C. and high light (250 µE m$^{-2}$ sec$^{-1}$)

| Ecotype/Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 2 | 0.053 | 0.052 | 0.034 | 0.040 | 0.056 | 0.061 | 0.049 | 0.056 | 0.068 | 0.063 |
| 3 | 0.037 | 0.026 | 0.021 | 0.023 | 0.037 | 0.036 | 0.022 | 0.022 | 0.023 | 0.027 |
| 4 | 0.37 | 0.25 | 0.22 | 0.25 | 0.43 | 0.37 | 0.24 | 0.23 | 0.24 | 0.27 |

Table 71: Provided are the values of each of the parameters (as described above) measured in *Sorghum* accessions (Seed ID) under 14° C. and high light (250 µE m$^{-2}$ sec$^{-1}$).

TABLE 72

Correlation between the expression level of selected genes of some embodiments of the invention in various tissues and the phenotypic performance

| Gene Name | R | P value | Exp. set | Corr. Set ID |
|---|---|---|---|---|
| LGP52 | 0.75 | 8.85E−02 | 3 | 3 |

Table 72. Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] P = p value.

Example 10

Production of *Sorghum* Transcriptome and High Throughput Correlation Analysis with Yield and Drought Related Parameters Measured in Fields Using 65K *Sorghum* Oligonucleotide Micro-Arrays In order to produce a high throughput correlation analysis between plant phenotype and gene expression level, the present inventors utilized a sorghum oligonucleotide microarray, produced by Agilent Technologies [chem. (dot) agilent (dot) com/Scripts/PDS (dot) asp?1Page=50879]. The array oligonucleotide represents about 65,000 sorghum genes and transcripts. In order to define correlations between the levels of RNA expression with ABST, drought and yield components or vigor related parameters, various plant characteristics of 12 different sorghum hybrids were analyzed. Among them, 8 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

12 *Sorghum* varieties were grown in 6 repetitive plots, in field. Briefly, the growing protocol was as follows:

1. Regular growth conditions: sorghum plants were grown in the field using commercial fertilization and irrigation protocols, which include 452 m$^3$ water per dunam (1000 square meters) per entire growth period and fertilization of 14 units nitrogen per dunam per entire growth period (normal conditions). The nitrogen can be obtained using URAN® 21% (Nitrogen Fertilizer Solution; PCS Sales, Northbrook, Ill., USA).

2. Drought conditions: sorghum seeds were sown in soil and grown under normal condition until flowering stage (59 days from sowing), drought treatment was imposed by irrigating plants with 50% water relative to the normal treatment from this stage [309 m$^3$ water per dunam (1000 square meters) per the entire growth period)], with normal fertilization (i.e., 14 units nitrogen per dunam).

Analyzed *Sorghum* tissues—All 12 selected *Sorghum* hybrids were sampled per each treatment. Tissues [Flag leaf, upper stem, lower stem, flower, grain] representing different plant characteristics, from plants growing under normal conditions and drought stress conditions were sampled and RNA was extracted as described above. Each micro-array expression information tissue type has received a Set ID as summarized in Table 73 below.

TABLE 73

*Sorghum* transcriptome expression sets in field experiment

| Expression Set | Set ID |
|---|---|
| *Sorghum*/flag leaf/Drought/flowering | 1 |
| *Sorghum*/flag leaf/Drought/grain filling | 2 |

Table 73: Provided are the sorghum transcriptome expression sets. Flag leaf = the leaf below the flower.

*Sorghum* Yield Components and Vigor Related Parameters Assessment

Plants were phenotyped using the parameters listed in Tables 74-75 below. The following parameters were collected using digital imaging system:

Average Grain Area (cm$^2$)—At the end of the growing period the grains were separated from the Plant 'Head'. A sample of ~200 grains was weighted, photographed and images were processed using the below described image processing system. The grain area was measured from those images and was divided by the number of grains.

Average Grain Length (cm)—At the end of the growing period the grains were separated from the Plant 'Head'. A sample of ~200 grains was weighted, photographed and images were processed using the below described image processing system. The sum of grain lengths (longest axis) was measured from those images and was divided by the number of grains.

Average Grain Width (cm)—At the end of the growing period the grains were separated from the Plant 'Head'. A sample of ~200 grains was weighted, photographed and images were processed using the below described image processing system. The sum of grain width (longest axis) was measured from those images and was divided by the number of grains.

Average Grain Perimeter (cm)—At the end of the growing period the grains were separated from the Plant 'Head'. A sample of ~200 grains was weighted, photographed and images were processed using the below described image processing system. The sum of grain perimeter was measured from those images and was divided by the number of grains.

Grain circularity—At the end of the growing period the grains were separated from the Plant 'Head'. A sample of ~200 grains was weighted, photographed and images were processed using the below described image processing system. The circularity of the grains was calculated based on Formula XIX above.

Head Average Area (cm$^2$)—At the end of the growing period 8 'Heads' were photographed and images were processed using the below described image processing system. The 'Head' area was measured from those images and was divided by the number of 'Heads'.

Head Average Length (cm)—At the end of the growing period 8 'Heads' were photographed and images were processed using the below described image processing system. The 'Head' length (longest axis) was measured from those images and was divided by the number of 'Heads'.

Head Average Width (cm)—At the end of the growing period 8 'Heads' were photographed and images were processed using the below described image processing system. The 'Head' width (longest axis) was measured from those images and was divided by the number of 'Heads'.

An image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 8 plants per plot or by measuring the parameter across all the plants within the plot.

Head dry weight at grain filling (gr.)—5 heads per plot were collected at the grain filling stage (R2-R3) and weighted after oven dry (dry weight).

Head dry weights at harvest (gr.)—At the end of the growing period heads were collected (harvest stage), either from 8 plants per plot or from the rest of the plants in the plot. Heads were weighted after oven dry (dry weight), and average head weight per plant or per plot were calculated.

Total Seed Yield (gr.)—At the end of the growing period heads were collected (harvest stage). 8 heads were separately threshed and grains were weighted. The average grain weight per plant was calculated by dividing the total grain weight by the number of plants.

1000 Seeds weight [gr]—weight of 1000 seeds per plot.

Grain number (num.)—was calculated by dividing seed yield by 1000 seed weight.

Plant height (cm.)—Plants were characterized for height during growing period at 6 time points (including at harvest). In each measure, plants were measured for their height using a measuring tape. Height was measured from ground level to top of the longest leaf.

SPAD—Chlorophyll content was determined using a Minolta SPAD 502 chlorophyll meter and measurement was performed at early grain filling (SPAD_earlyGF) and late grain filling (SPAD_lateGF). SPAD meter readings were done on fully developed leaf. Three measurements per leaf were taken per plant.

Vegetative fresh and dry weight per plant (gr.)—At the end of the growing period all vegetative material (excluding roots) from plots were collected and weighted before (fresh weight) and after (dry weight) oven dry. The biomass per plant was calculated by dividing total biomass by the number of plants.

Relative water content (RWC, %)—at grain filling stage, leaves were collected from 5 plants per plot. Measurements of relative water content was done as follows: fresh weight (FW) was recorded immediately after leaf sampling; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to Formula I (above).

Specific Leaf Area (SLA)—at grain filling stage, leaves were collected from 5 plants per plot. Leaves were scanned to obtain leaf area per plant, and then leaves were dried in an oven to obtain the leaves dry weight per plant. Specific leaf area was calculated by the leaf area divided by leaf dry weight.

Stomatal conductance (F) (GF) (mmol m−2 s−1)—plants were evaluated for their stomata conductance using SC-1 Leaf Porometer (Decagon devices) at flowering (F) and at grain filling (GF) stages. Stomata conductance readings were done on fully developed leaf, for 2 leaves and 2 plants per plot.

Upper internode length (cm), width (cm) and volume ($cm^3$)—Upper internodes from at least 5 plants per plot were separated from the plant at flowering (F) and at harvest (H). Internodes were measured for their length (l) and width (d) using a ruler and a caliber. The internode volume was calculated using Formula XX.

Upper internode fresh and dry density (F) and (H) (gr/$cm^3$)—These parameters were measured at two time points during the course of the experiment: at flowering (F) and at harvest (H). Upper internodes from at least 5 plants per plot were separated from the plant and weighted (fresh and dry weight). To obtain stem density, stem weight (either fresh or dry) was divided by the stem volume (see above).

Lower internode length (cm), width (cm) and volume ($cm^3$)—Lower internodes from at least 5 plants per plot were separated from the plant at flowering (F) and at harvest (H). Internodes were measured for their length (l) and width (d) using a ruler and a caliber. The internode volume was calculated using Formula XX above.

Lower internode fresh and dry density (F) and (H) (gr/$cm^3$)—These parameters were measured at two time points during the course of the experiment: at flowering (F) and at harvest (H). Lower internodes from at least 5 plants per plot were separated from the plant and weighted (fresh and dry weight). To obtain stem density, stem weight (either fresh or dry) was divided by the stem volume (see above).

Number of days to heading—Calculated as the number of days from sowing till 50% of the plot arrives heading.

Number of days to maturity—Calculated as the number of days from sowing till 50% of the plot arrives seed maturation.

Maintenance of performance under drought conditions—Represent ratio for the specified parameter of Drought condition results divided by Normal conditions results (maintenance of phenotype under drought in comparison to normal conditions).

Data parameters collected are summarized in Tables 74-75, herein below.

TABLE 74

*Sorghum* correlated parameters under drought conditions (vectors)

| Correlated parameter with | Correlation ID |
|---|---|
| % Canopy coverage (GF) under drought (%) | 1 |
| 1000 grain weight under drought (gr) | 2 |
| Grain Circularity under drought (cm) | 3 |
| Grain Perimeter under drought (cm) | 4 |
| Grain area under drought ($cm^2$) | 5 |
| Grain length under drought (cm) | 6 |

TABLE 74-continued

Sorghum correlated parameters under drought conditions (vectors)

| Correlated parameter with | Correlation ID |
|---|---|
| Grain width under drought (cm) | 7 |
| Grains number under drought (number) | 8 |
| Grains weight per plant under drought (gr) | 9 |
| Head DW (GF) under drought (gr) | 10 |
| Heads weight per plant under drought (gr) | 11 |
| Lower Stem dry density (H) under drought (cm³) | 12 |
| Lower Stem fresh density (F) under drought (cm³) | 13 |
| Lower Stem width (F) under drought (cm) | 14 |
| Main Head Area under drought (cm²) | 15 |
| Main Head Width under drought (cm) | 16 |
| Main Head length under drought (cm) | 17 |
| Num Days to heading (field) under drought (days) | 18 |
| Num days to maturity under drought (days) | 19 |
| Plant height under drought (cm) | 20 |
| RWC_2 under drought (%) | 21 |
| SPAD_earlyGF under drought | 22 |
| SPAD_lateGF under drought | 23 |
| Specific leaf area (GF) under drought (cm²/gr) | 24 |
| Stomatal conductance (F) under drought(mmol m-2 s-1) | 25 |
| Stomatal conductance (GF) under drought (mmol m-2 s-1) | 26 |
| Upper internode dry density (H) under drought (gr/cm³) | 27 |
| Upper internode fresh density (H) under drought (gr/cm³) | 28 |
| Upper internode length (H) under drought (cm) | 29 |
| Upper internode volume (H) under drought (cm³) | 30 |
| Upper internode width (H) under drought (cm) | 31 |
| Vegetative DW per plant under drought (gr) | 32 |
| Vegetative FW per plant under drought (gr) | 33 |

Table 74. Provided are the Sorghum correlated parameters (vectors). "gr." = grams; "SPAD" = chlorophyll levels; "FW" = Plant Fresh weight; "DW" = Plant Dry weight; "GF" = grain filling growth stage; "F" = flowering stage; "H" = harvest stage.

TABLE 75

Sorghum correlated parameters for maintenance under drought conditions (vectors)

| Correlated parameter with | Correlation ID |
|---|---|
| 1000 grains weight D/N | 1 |
| Grain Perimeter D/N | 2 |
| Grain area D/N | 3 |
| Grain length D/N | 4 |
| Grain width D/N | 5 |
| Grains num (SP) D/N | 6 |
| Grains weight per plant D/N | 7 |
| Head DW (GF) D/N | 8 |
| Heads weight per plant (RP) D/N | 9 |
| Lower Stem width (F) D/N | 10 |
| Lower stem dry density (H) D/N | 11 |
| Lower stem fresh density (F) D/N | 12 |
| Main Head Area D/N | 13 |
| Main Head Width D/N | 14 |
| Main Head length D/N | 15 |
| Plant height D/N | 16 |
| RWC_2 D/N | 17 |
| SPAD_2 D/N | 18 |
| SPAD_3 D/N | 19 |
| Specific leaf area (GF) D/N | 20 |
| Stomatal conductance (F) D/N | 21 |
| Stomatal conductance (GF) D/N | 22 |
| Upper Stem length (h) D/N | 23 |
| Upper Stem width (h) D/N | 24 |
| Upper stem dry density (H) D/N | 25 |
| Upper stem fresh density (H) D/N | 26 |
| Upper stem volume (H) D/N | 27 |
| Vegetative DW per plant D/N | 28 |
| Vegetative FW per plant D/N | 29 |

Table 75. Provided are the Sorghum correlated parameters (vectors). "gr." = grams; "SPAD" = chlorophyll levels; "FW" = Plant Fresh weight; "DW" = Plant Dry weight; "Maintenance under drought" = calculated % of change under drought vs normal growth conditions. "GF" = grain filling growth stage; "F" = flowering stage; "H" = harvest stage.

Experimental Results 22 different sorghum hybrids were grown and characterized for different parameters (Tables 74-75). The average for each of the measured parameter was calculated using the JMP software (Tables 76-77) and a subsequent correlation analysis was performed (Tables 78-79). Results were then integrated to the database.

TABLE 76

Measured parameters in Sorghum accessions under drought conditions

| Ecotype/Treatment | Line-1 | Line-2 | Line-3 | Line-4 | Line-5 | Line-6 | Line-7 | Line-8 |
|---|---|---|---|---|---|---|---|---|
| 1 | 70.80 | 64.11 | 75.68 | 87.17 | 77.78 | 80.38 | 64.25 | 61.34 |
| 2 | 13.30 | 17.88 | 20.24 | 17.95 | 14.64 | 20.83 | 15.43 | 19.80 |
| 3 | 0.88 | 0.90 | 0.90 | 0.89 | 0.88 | 0.89 | 0.89 | 0.87 |
| 4 | 1.20 | 1.22 | 1.28 | 1.30 | 1.27 | 1.36 | 1.24 | 1.28 |
| 5 | 0.10 | 0.11 | 0.12 | 0.12 | 0.11 | 0.13 | 0.11 | 0.11 |
| 6 | 0.39 | 0.40 | 0.41 | 0.42 | 0.42 | 0.45 | 0.40 | 0.41 |
| 7 | 0.33 | 0.34 | 0.36 | 0.36 | 0.34 | 0.37 | 0.34 | 0.35 |
| 8 | 17494.21 | 14526.20 | 15728.96 | 13808.50 | 9838.55 | 12402.52 | 9979.86 | 5451.71 |
| 9 | 29.22 | 31.74 | 40.21 | 29.52 | 18.23 | 34.43 | 19.10 | 13.67 |
| 10 | 19.29 | 33.15 | 27.31 | 50.38 | 37.04 | 11.72 | 9.32 | 12.10 |
| 11 | 0.04 | 0.04 | 0.05 | 0.03 | 0.02 | 0.02 | 0.03 | 0.02 |
| 12 | 1.71 | 1.66 | 1.64 | 1.60 | 2.49 | 1.25 | 2.38 | 1.60 |
| 13 | 10.36 | 11.28 | 10.70 | 9.68 | 10.79 | 9.66 | 10.87 | 10.46 |
| 14 | 14.90 | 13.32 | 14.53 | 17.27 | 18.35 | 13.96 | 17.19 | 16.63 |
| 15 | 114.58 | 94.24 | 104.21 | 87.37 | 55.31 | 85.87 | 68.68 | 96.62 |
| 16 | 5.02 | 5.57 | 5.70 | 4.77 | 3.72 | 5.81 | 4.62 | 5.53 |
| 17 | 31.12 | 22.16 | 24.36 | 24.76 | 19.93 | 19.41 | 19.90 | 24.79 |
| 18 | 63.00 | 56.00 | 59.67 | 76.67 | 74.67 | 71.00 | 68.33 | 66.33 |
| 19 | 92.00 | 92.00 | 92.00 | 107.00 | 107.00 | 107.00 | 92.00 | 92.00 |
| 20 | 80.92 | 93.43 | 104.15 | 105.63 | 69.04 | 133.54 | 47.82 | 83.24 |
| 21 | 66.87 | 68.62 | 68.25 | 76.33 | 54.86 | 74.51 | 71.70 | 78.51 |
| 22 | 44.66 | 51.92 | 48.84 | 37.60 | 38.19 | 43.35 | 47.58 | 46.97 |
| 23 | 30.93 | 43.69 | 37.80 | 32.49 | 34.14 | 25.84 | 42.92 | 26.98 |
| 24 | 132.90 | 138.52 | 133.26 | 47.34 | 44.43 | 106.06 | 128.67 | 143.32 |
| 25 | 582.07 | 985.59 | 834.96 | 54.16 | 68.26 | 330.46 | 387.65 | 774.84 |

TABLE 76-continued

Measured parameters in *Sorghum* accessions under drought conditions

| Ecotype/Treatment | Line-1 | Line-2 | Line-3 | Line-4 | Line-5 | Line-6 | Line-7 | Line-8 |
|---|---|---|---|---|---|---|---|---|
| 26 | 129.78 | 241.65 | 322.92 | 127.17 | 276.22 | 217.19 | 81.21 | 561.18 |
| 27 | 1.65 | 1.62 | 1.63 | 1.76 | 1.92 | 1.66 | 1.55 | 1.43 |
| 28 | 5.18 | 5.39 | 5.40 | 5.53 | 8.60 | 3.60 | 4.61 | 5.72 |
| 29 | 48.60 | 48.78 | 48.73 | 26.05 | 31.06 | 20.72 | 24.07 | 39.57 |
| 30 | 2865.28 | 2857.93 | 2955.99 | 1288.48 | 1128.61 | 1724.93 | 1507.76 | 2524.28 |
| 31 | 8.60 | 8.59 | 8.73 | 7.85 | 6.63 | 10.20 | 8.88 | 8.92 |
| 32 | 0.03 | 0.03 | 0.04 | 0.08 | 0.06 | 0.05 | 0.04 | 0.04 |
| 33 | 0.09 | 0.10 | 0.11 | 0.19 | 0.15 | 0.11 | 0.08 | 0.10 |

Table 76: Provided are the values of each of the parameters (as described above) measured in *Sorghum* accessions (Line) under drought conditions. Growth conditions are specified in the experimental procedure section.

15

TABLE 77

Calculated parameters in *Sorghum* accessions under drought conditions
(maintenance of performance under drought vs normal growth conditions)

| Ecotype/Treatment | Line-1 | Line-2 | Line-3 | Line-4 | Line-5 | Line-6 | Line-7 | Line-8 |
|---|---|---|---|---|---|---|---|---|
| 1 | 0.72 | 0.76 | 0.78 | 0.88 | 0.79 | 0.77 | 0.84 | 0.87 |
| 2 | 0.92 | 0.93 | 0.95 | 0.99 | 0.96 | 0.94 | 0.97 | 0.98 |
| 3 | 0.85 | 0.87 | 0.90 | 0.97 | 0.91 | 0.88 | 0.94 | 0.96 |
| 4 | 0.93 | 0.94 | 0.95 | 0.99 | 0.97 | 0.93 | 0.97 | 0.98 |
| 5 | 0.91 | 0.93 | 0.95 | 0.97 | 0.94 | 0.94 | 0.97 | 0.98 |
| 6 | 0.81 | 1.11 | 0.93 | 0.56 | 0.65 | 0.71 | 0.72 | 0.87 |
| 7 | 0.59 | 0.81 | 0.73 | 0.46 | 0.55 | 0.57 | 0.60 | 0.76 |
| 8 | 0.70 | 1.05 | 1.06 | 0.68 | 0.90 | 0.77 | 0.91 | 0.94 |
| 9 | 0.57 | 0.64 | 0.70 | 0.42 | 0.43 | 0.36 | 0.46 | 0.52 |
| 10 | 0.80 | 0.98 | 0.97 | 1.05 | 1.02 | 0.87 | 0.97 | 0.99 |
| 11 | 0.69 | 0.65 | 0.66 | 0.97 | 0.99 | 0.70 | 0.81 | 0.79 |
| 12 | 0.96 | 1.04 | 0.99 | 0.92 | 0.99 | 0.96 | 1.02 | 0.98 |
| 13 | 0.82 | 0.95 | 0.91 | 0.59 | 0.69 | 0.77 | 0.80 | 1.20 |
| 14 | 0.79 | 0.94 | 0.91 | 0.75 | 0.82 | 0.81 | 0.85 | 1.11 |
| 15 | 1.01 | 0.98 | 0.99 | 0.81 | 0.84 | 0.94 | 0.93 | 1.15 |
| 16 | 0.85 | 0.92 | 0.92 | 0.64 | 0.70 | 0.79 | 0.87 | 0.80 |
| 17 | 0.74 | 0.76 | 0.77 | 0.93 | 0.63 | 0.82 | 0.81 | 0.86 |
| 18 | 0.83 | 0.99 | 0.91 | 0.85 | 0.78 | 0.92 | 0.91 | 0.95 |
| 19 | 0.74 | 0.93 | 0.81 | 0.81 | 0.81 | 0.77 | 0.86 | 0.76 |
| 20 | 0.62 | 0.65 | 0.62 | 0.70 | 0.58 | 0.65 | 0.66 | 0.84 |
| 21 | 0.73 | 1.12 | 1.03 | 0.09 | 0.11 | 0.60 | 0.82 | 0.76 |
| 22 | 0.15 | 0.33 | 0.36 | 0.33 | 0.57 | 0.34 | 0.17 | 0.69 |
| 23 | 0.81 | 0.94 | 0.89 | 0.54 | 0.59 | 0.61 | 0.84 | 0.88 |
| 24 | 1.00 | 1.01 | 0.95 | 0.84 | 0.86 | 1.01 | 1.05 | 1.20 |
| 25 | 0.95 | 0.91 | 0.98 | 1.05 | 1.05 | 0.89 | 0.88 | 0.81 |
| 26 | 0.71 | 0.68 | 0.77 | 1.15 | 1.04 | 0.78 | 0.64 | 0.64 |
| 27 | 0.82 | 0.98 | 0.81 | 0.39 | 0.46 | 0.62 | 0.94 | 1.16 |
| 28 | 0.74 | 0.71 | 0.69 | 0.77 | 0.82 | 0.77 | 0.85 | 0.78 |
| 29 | 0.60 | 0.69 | 0.59 | 0.80 | 0.68 | 0.73 | 0.66 | 0.69 |

Table 77: Provided are the values of each of the parameters (as described above) measured in *sorghum* accessions (line) for maintenance of performance under drought (calculated as % of change under drought vs normal growth conditions). Growth conditions are specified in the experimental procedure section.

TABLE 78

Correlation between the expression level of selected genes of some embodiments of the invention in various tissues and the phenotypic performance under drought stress conditions across *Sorghum* accessions

| Gene Name | R | P value | Exp. set | Corr. Set ID | Gene Name | R | P value | Exp. set | Corr. Set ID |
|---|---|---|---|---|---|---|---|---|---|
| LGP102 | 0.97 | 4.03E−04 | 1 | 21 | LGP102 | 0.74 | 5.51E−02 | 1 | 20 |
| LGP102 | 0.76 | 4.88E−02 | 1 | 6 | LGP102 | 0.78 | 4.05E−02 | 1 | 5 |
| LGP102 | 0.82 | 2.50E−02 | 1 | 4 | LGP102 | 0.73 | 6.51E−02 | 1 | 19 |
| LGP102 | 0.76 | 4.66E−02 | 1 | 7 | LGP102 | 0.78 | 3.91E−02 | 2 | 14 |
| LGP102 | 0.78 | 3.72E−02 | 2 | 32 | LGP102 | 0.94 | 1.59E−03 | 2 | 18 |
|  |  |  |  |  | LGP52 | 0.85 | 1.54E−02 | 1 | 3 |
| LGP52 | 0.76 | 4.58E−02 | 1 | 23 | LGP52 | 0.85 | 1.65E−02 | 2 | 3 |

TABLE 78-continued

Correlation between the expression level of selected genes of some embodiments of the invention in various tissues and the phenotypic performance under drought stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LGP52 | 0.71 | 7.40E−02 | 2 | 12 | LGP52 | 0.79 | 3.46E−02 | 2 | 9 |
| LGP52 | 0.80 | 3.18E−02 | 2 | 23 | | | | | |

Table 78. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

TABLE 79

Correlation between the expression level of selected genes of some embodiments of the invention in various tissues and the phenotypic performance of maintenance of performance under drought across Sorghum accessions

| Gene Name | R | P value | Exp. set | Corr. Set ID | Gene Name | R | P value | Exp. set | Corr. Set ID |
|---|---|---|---|---|---|---|---|---|---|
| LGP102 | 0.71 | 7.45E−02 | 1 | 1 | LGP102 | 0.81 | 2.78E−02 | 1 | 22 |
| LGP102 | 0.87 | 1.12E−02 | 1 | 20 | LGP102 | 0.73 | 6.26E−02 | 1 | 17 |
| LGP102 | 0.75 | 5.39E−02 | 1 | 5 | LGP102 | 0.73 | 6.30E−02 | 2 | 1 |
| LGP102 | 0.72 | 6.70E−02 | 2 | 28 | LGP102 | 0.75 | 5.30E−02 | 2 | 2 |
| LGP102 | 0.71 | 7.28E−02 | 2 | 3 | LGP102 | 0.88 | 9.67E−03 | 2 | 11 |
| LGP102 | 0.79 | 3.27E−02 | 2 | 17 | | | | | |
| LGP52 | 0.72 | 6.64E−02 | 1 | 16 | | | | | |

Table 79. Correlations (R) between the genes expression levels in various tissues and the phenotypic performance.
"Corr. ID"—correlation set ID according to the correlated parameters Table above.
"Exp. Set"—Expression set.
"R" = Pearson correlation coefficient;
"P" = p value.

Example 11

Production of Maize Transcriptome and High Throughput Correlation Analysis Using 60K Maize Oligonucleotide Micro-Array To produce a high throughput correlation analysis, the present inventors utilized a Maize oligonucleotide microarray, produced by Agilent Technologies [chem. (dot) agilent (dot) com/Scripts/PDS (dot) asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 12 different Maize hybrids were analyzed. Among them, 10 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Experimental Procedures

All 10 selected maize hybrids were sampled in three time points (TP2=V2-V3 (when two to three collar leaf are visible, rapid growth phase and kernel row determination begins), TP5=R1-R2 (silking-blister), TP6=R3-R4 (milk-dough). Four types of plant tissues [Ear, flag leaf indicated in Table as leaf, grain distal part, and internode] were sampled and RNA was extracted as described in "GENERAL EXPERIMENTAL AND BIOINFORMATICS METHODS". For convenience, each micro-array expression information tissue type has received a Set ID as summarized in Table 80 below.

TABLE 80

Tissues used for Maize transcriptome expression sets

| Expression Set | Set ID |
|---|---|
| Ear under normal conditions at reproductive stage: R1-R2 | 1 |
| Ear under normal conditions at reproductive stage: R3-R4 | 2 |
| Internode under normal conditions at vegetative stage: Vegetative V2-3 | 3 |
| Internode under normal conditions at reproductive stage: R1-R2 | 4 |
| Internode under normal conditions at reproductive stage: R3-R4 | 5 |
| Leaf under normal conditions at vegetative stage: Vegetative V2-3 | 6 |
| Leaf under normal conditions at reproductive stage: R1-R2 | 7 |
| Grain distal under normal conditions at reproductive stage: R1-R2 | 8 |

Table 80: Provided are the identification (ID) number of each of the Maize expression sets The following parameters were collected:

Grain Area ($cm^2$)—At the end of the growing period the grains were separated from the ear. A sample of ~200 grains was weighted, photographed and images were processed using the below described image processing system. The grain area was measured from those images and was divided by the number of grains.

Grain Length and Grain width (cm)—At the end of the growing period the grains were separated from the ear. A sample of ~200 grains was weighted, photographed and images were processed using the below described image processing system. The sum of grain lengths/or width (longest axis) was measured from those images and was divided by the number of grains.

Ear Area (cm²)—At the end of the growing period 6 ears were, photographed and images were processed using the below described image processing system. The Ear area was measured from those images and was divided by the number of Ears.

Ear Length and Ear Width (cm)—At the end of the growing period 6 ears were photographed and images were processed using the below described image processing system. The Ear length and width (longest axis) was measured from those images and was divided by the number of ears.

Filled per Whole Ear—it was calculated as the length of the ear with grains out of the total ear.

Percent Filled Ear—At the end of the growing period 6 ears were photographed and images were processed using the below described image processing system. The percent filled Ear grain was the ear with grains out of the total ear and was measured from those images and was divided by the number of Ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.), measurement of yield parameter—At the end of the experiment all ears from plots within blocks A-C were collected. Six ears were separately threshed and grains were weighted, all additional ears were threshed together and weighted as well. The grain weight was normalized using the relative humidity to be 0%. The normalized average grain weight per ear was calculated by dividing the total normalized grain weight by the total number of ears per plot (based on plot). In case of 6 ears, the total grains weight of 6 ears was divided by 6.

Ear fresh weight (FW) (gr.)—At the end of the experiment (when ears were harvested) total and 6 selected ears per plots within blocks A-C were collected separately. The plants' ears (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Leaf number per plant—Plants were characterized for leaf number during growing period at 5 time points. In each measure, plants were measured for their leaf number by counting all the leaves of 3 selected plants per plot.

Relative Growth Rate was calculated using regression coefficient of leaf number change a long time course.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS). Dry weight=total weight of the vegetative portion above ground (excluding roots) after drying at 70° C. in oven for 48 hours.

Dry weight per plant—At the end of the experiment when all vegetative material from plots within blocks A-C were collected, weight and divided by the number of plants.

Ear diameter [cm]—The diameter of the ear at the mid of the ear was measured using a ruler.

Cob diameter [cm]—The diameter of the cob without grains was measured using a ruler.

Kernel Row Number per Ear—The number of rows in each ear was counted. The average of 6 ears per plot was calculated.

Leaf area index [LAI]=total leaf area of all plants in a plot. Measurement was performed using a Leaf area-meter.

Yield/LAI [kg]—is the ratio between total grain yields and total leaf area index.

TABLE 81

Maize correlated parameters (vectors)

| Correlated parameter with | Correlation ID |
|---|---|
| Cob Diameter (mm) | 1 |
| DW per Plant based on 6 (gr.) | 2 |
| Ear Area (cm²) | 3 |
| Ear FW per Plant based on 6 (gr.) | 4 |
| Ear Height (cm) | 5 |
| Ear Length (cm) | 6 |
| Ear Width (cm) | 7 |
| Ears FW per plant based on all (gr.) | 8 |
| Filled per Whole Ear | 9 |
| Grain Area (cm²) | 10 |
| Grain Length (cm) | 11 |
| Grain Width (cm) | 12 |
| Growth Rate Leaf Number | 13 |
| Kernel Row Number per Ear | 14 |
| Leaf Number per Plant | 15 |
| Normalized Grain Weight per Plant based on all (gr.) | 16 |
| Normalized Grain Weight per plant based on 6 (gr.) | 17 |
| Percent Filled Ear | 18 |
| Plant Height per Plot (cm) | 19 |
| SPAD R1 | 20 |
| SPAD R2 | 21 |

Table 81.

Experimental Results

Twelve maize varieties were grown and characterized for parameters, as described above. The average for each parameter was calculated using the JMP software, and values are summarized in Tables 82-83 below. Subsequent correlation between the various transcriptome sets for all or sub sets of lines was done by the bioinformatic unit and results were integrated into the database (Table 84 below).

TABLE 82

Measured parameters in Maize Hybrid

| Ecotype/Treatment | Line-1 | Line-2 | Line-3 | Line-4 | Line-5 | Line-6 |
|---|---|---|---|---|---|---|
| 1 | 28.96 | 25.08 | 28.05 | 25.73 | 28.72 | 25.78 |
| 2 | 657.50 | 491.67 | 641.11 | 580.56 | 655.56 | 569.44 |
| 3 | 85.06 | 85.84 | 90.51 | 95.95 | 91.62 | 72.41 |
| 4 | 245.83 | 208.33 | 262.22 | 263.89 | 272.22 | 177.78 |
| 5 | 135.17 | 122.33 | 131.97 | 114.00 | 135.28 | 94.28 |

TABLE 82-continued

Measured parameters in Maize Hybrid

| Ecotype/Treatment | Line-1 | Line-2 | Line-3 | Line-4 | Line-5 | Line-6 |
|---|---|---|---|---|---|---|
| 6 | 19.69 | 19.05 | 20.52 | 21.34 | 20.92 | 18.23 |
| 7 | 5.58 | 5.15 | 5.67 | 5.53 | 5.73 | 5.23 |
| 8 | 278.19 | 217.50 | 288.28 | 247.88 | 280.11 | 175.84 |
| 9 | 0.916 | 0.922 | 0.927 | 0.917 | 0.908 | 0.950 |
| 10 | 0.75 | 0.71 | 0.75 | 0.77 | 0.81 | 0.71 |
| 11 | 1.17 | 1.09 | 1.18 | 1.20 | 1.23 | 1.12 |
| 12 | 0.81 | 0.81 | 0.80 | 0.80 | 0.82 | 0.80 |
| 13 | 0.28 | 0.22 | 0.28 | 0.27 | 0.31 | 0.24 |
| 14 | 16.17 | 14.67 | 16.20 | 15.89 | 16.17 | 15.17 |
| 15 | 12.00 | 11.11 | 11.69 | 11.78 | 11.94 | 12.33 |
| 16 | 153.90 | 135.88 | 152.50 | 159.16 | 140.46 | 117.14 |
| 17 | 140.68 | 139.54 | 153.67 | 176.98 | 156.61 | 119.67 |
| 18 | 80.62 | 86.76 | 82.14 | 92.71 | 80.38 | 82.76 |
| 19 | 278.08 | 260.50 | 275.13 | 238.50 | 286.94 | 224.83 |
| 20 | 51.67 | 56.41 | 53.55 | 55.21 | 55.30 | 59.35 |
| 21 | 54.28 | 57.18 | 56.01 | 59.68 | 54.77 | 59.14 |

Table 82.

TABLE 83

Measured parameters in Maize Hybrid additional parameters

| Ecotype/Treatment | Line-7 | Line-8 | Line-9 | Line-10 | Line-11 | Line-12 |
|---|---|---|---|---|---|---|
| 1 | 26.43 | 25.19 | | 26.67 | | |
| 2 | 511.11 | 544.44 | | 574.17 | 522.22 | |
| 3 | 74.03 | 76.53 | | 55.20 | 95.36 | |
| 4 | 188.89 | 197.22 | | 141.11 | 261.11 | |
| 5 | 120.94 | 107.72 | | 60.44 | 112.50 | |
| 6 | 19.02 | 18.57 | | 16.69 | 21.70 | |
| 7 | 5.22 | 5.33 | | 4.12 | 5.58 | |
| 8 | 192.47 | 204.70 | | 142.72 | 264.24 | |
| 9 | 0.87 | 0.94 | | 0.80 | 0.96 | |
| 10 | 0.71 | 0.75 | | 0.50 | 0.76 | |
| 11 | 1.14 | 1.13 | | 0.92 | 1.18 | |
| 12 | 0.79 | 0.84 | | 0.67 | 0.81 | |
| 13 | 0.24 | 0.27 | | 0.19 | 0.30 | |
| 14 | 16.00 | 14.83 | | 14.27 | 15.39 | |
| 15 | 12.44 | 12.22 | | 9.28 | 12.56 | |
| 16 | 123.24 | 131.27 | | 40.84 | 170.66 | |
| 17 | 119.69 | 133.51 | | 54.32 | 173.23 | |
| 18 | 73.25 | 81.06 | | 81.06 | 91.60 | |
| 19 | 264.44 | 251.61 | | 163.78 | 278.44 | |
| 20 | 58.48 | 55.88 | 52.98 | 53.86 | 59.75 | 49.99 |
| 21 | 57.99 | 60.36 | 54.77 | 51.39 | 61.14 | 53.34 |

Table 83.

TABLE 84

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LGP25 | 0.85 | 1.58E-02 | 1 | 2 | LGP27 | 0.93 | 2.27E-03 | 4 | 14 |
| LGP25 | 0.71 | 1.17E-01 | 4 | 1 | LGP25 | 0.94 | 4.53E-03 | 1 | 1 |
| LGP27 | 0.72 | 6.78E-02 | 1 | 5 | LGP27 | 0.79 | 6.16E-02 | 2 | 12 |
| LGP27 | 0.74 | 5.74E-02 | 4 | 11 | LGP27 | 0.73 | 6.00E-02 | 4 | 5 |
| LGP27 | 0.75 | 5.15E-02 | 4 | 7 | LGP27 | 0.75 | 5.32E-02 | 4 | 8 |
| LGP27 | 0.73 | 6.45E-02 | 4 | 4 | LGP27 | 0.72 | 6.91E-02 | 1 | 19 |
| LGP72 | 0.75 | 8.34E-02 | 2 | 15 | LGP72 | 0.74 | 9.47E-02 | 2 | 12 |
| LGP72 | 0.76 | 4.63E-02 | 4 | 3 | LGP72 | 0.75 | 5.29E-02 | 4 | 16 |
| LGP72 | 0.89 | 6.57E-03 | 4 | 14 | LGP72 | 0.75 | 5.04E-02 | 4 | 15 |
| LGP72 | 0.84 | 1.70E-02 | 4 | 13 | LGP72 | 0.76 | 4.74E-02 | 4 | 11 |
| LGP72 | 0.85 | 1.63E-02 | 4 | 6 | LGP72 | 0.73 | 6.09E-02 | 4 | 9 |
| LGP72 | 0.78 | 3.83E-02 | 4 | 7 | LGP72 | 0.87 | 1.03E-02 | 4 | 8 |
| LGP72 | 0.86 | 1.33E-02 | 4 | 4 | LGP72 | 0.74 | 5.92E-02 | 4 | 17 |
| LGP72 | 0.75 | 5.21E-02 | 7 | 3 | LGP72 | 0.71 | 7.50E-02 | 7 | 14 |
| LGP72 | 0.74 | 5.95E-02 | 7 | 5 | LGP72 | 0.73 | 6.43E-02 | 7 | 17 |
| LGP73 | 0.77 | 7.45E-02 | 1 | 1 | LGP73 | 0.86 | 2.66E-03 | 3 | 18 |
| LGP73 | 0.88 | 2.06E-02 | 4 | 1 | LGP73 | 0.75 | 5.43E-02 | 4 | 2 |
| LGP74 | 0.82 | 1.27E-02 | 5 | 12 | LGP74 | 0.78 | 3.70E-02 | 4 | 2 |
| LGP75 | 0.90 | 5.34E-03 | 1 | 16 | LGP75 | 0.76 | 4.78E-02 | 1 | 14 |
| LGP75 | 0.85 | 1.52E-02 | 1 | 15 | LGP75 | 0.81 | 2.76E-02 | 1 | 13 |
| LGP75 | 0.89 | 6.95E-03 | 1 | 11 | LGP75 | 0.80 | 3.10E-02 | 1 | 6 |
| LGP75 | 0.89 | 6.96E-03 | 1 | 9 | LGP75 | 0.87 | 1.02E-02 | 1 | 10 |
| LGP75 | 0.87 | 1.19E-02 | 1 | 19 | LGP75 | 0.81 | 2.86E-02 | 1 | 5 |
| LGP75 | 0.92 | 3.16E-03 | 1 | 7 | LGP75 | 0.79 | 3.34E-02 | 1 | 8 |
| LGP75 | 0.78 | 3.95E-02 | 1 | 12 | LGP75 | 0.79 | 3.37E-02 | 1 | 4 |
| LGP75 | 0.86 | 1.32E-02 | 1 | 17 | LGP75 | 0.77 | 2.58E-02 | 8 | 12 |
| LGP75 | 0.72 | 1.03E-01 | 2 | 18 | LGP80 | 0.76 | 2.82E-02 | 5 | 14 |
| LGP75 | 0.74 | 2.16E-02 | 3 | 16 | LGP75 | 0.71 | 3.26E-02 | 3 | 17 |
| LGP75 | 0.87 | 1.07E-02 | 4 | 2 | LGP75 | 0.83 | 1.94E-02 | 1 | 3 |
| LGP75 | 0.80 | 1.81E-02 | 5 | 3 | LGP75 | 0.93 | 6.85E-03 | 4 | 1 |
| LGP75 | 0.82 | 3.48E-03 | 6 | 3 | LGP75 | 0.78 | 7.94E-03 | 6 | 16 |
| LGP75 | 0.82 | 3.49E-03 | 6 | 14 | LGP75 | 0.79 | 6.20E-03 | 6 | 11 |
| LGP75 | 0.81 | 4.64E-03 | 6 | 6 | LGP75 | 0.71 | 2.18E-02 | 6 | 10 |
| LGP75 | 0.73 | 1.61E-02 | 6 | 5 | LGP75 | 0.80 | 5.68E-03 | 6 | 7 |
| LGP75 | 0.84 | 2.14E-03 | 6 | 8 | LGP75 | 0.87 | 1.07E-03 | 6 | 4 |
| LGP75 | 0.80 | 5.74E-03 | 6 | 17 | LGP75 | 0.74 | 2.14E-02 | 3 | 3 |
| LGP80 | 0.83 | 4.31E-02 | 4 | 1 | LGP82 | 0.86 | 2.69E-02 | 1 | 1 |
| LGP82 | 0.71 | 7.33E-02 | 1 | 8 | LGP82 | 0.81 | 8.59E-03 | 3 | 5 |
| LGP82 | 0.72 | 2.97E-02 | 3 | 8 | LGP82 | 0.86 | 2.88E-02 | 2 | 12 |
| LGP86 | 0.72 | 6.82E-02 | 1 | 3 | LGP86 | 0.79 | 3.40E-02 | 1 | 16 |

TABLE 84-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LGP86 | 0.90 | 6.16E−03 | 1 | 14 | LGP86 | 0.73 | 5.99E−02 | 1 | 15 |
| LGP86 | 0.77 | 4.11E−02 | 1 | 13 | LGP86 | 0.89 | 7.89E−03 | 1 | 11 |
| LGP86 | 0.74 | 5.87E−02 | 1 | 9 | LGP86 | 0.86 | 1.39E−02 | 1 | 10 |
| LGP86 | 0.76 | 4.97E−02 | 1 | 19 | LGP86 | 0.82 | 2.24E−02 | 1 | 5 |
| LGP86 | 0.91 | 4.28E−03 | 1 | 7 | LGP86 | 0.80 | 3.22E−02 | 1 | 8 |
| LGP86 | 0.74 | 5.82E−02 | 1 | 12 | LGP86 | 0.76 | 4.68E−02 | 1 | 4 |
| LGP86 | 0.76 | 4.60E−02 | 1 | 17 | LGP86 | 0.76 | 2.76E−02 | 8 | 18 |
| LGP86 | 0.72 | 2.88E−02 | 3 | 16 | LGP86 | 0.72 | 2.81E−02 | 3 | 19 |
| LGP86 | 0.81 | 7.92E−03 | 3 | 5 | LGP86 | 0.76 | 1.86E−02 | 3 | 7 |
| LGP86 | 0.78 | 1.32E−02 | 3 | 8 | LGP87 | 0.71 | 2.19E−02 | 6 | 20 |
| LGP86 | 0.87 | 1.17E−02 | 4 | 16 | LGP86 | 0.90 | 6.32E−03 | 4 | 14 |
| LGP86 | 0.71 | 7.43E−02 | 4 | 13 | LGP86 | 0.86 | 1.33E−02 | 4 | 11 |
| LGP86 | 0.84 | 1.74E−02 | 4 | 6 | LGP86 | 0.80 | 2.90E−02 | 4 | 10 |
| LGP86 | 0.82 | 2.41E−02 | 4 | 19 | LGP86 | 0.92 | 3.17E−03 | 4 | 5 |
| LGP86 | 0.88 | 8.16E−03 | 4 | 7 | LGP86 | 0.94 | 1.93E−03 | 4 | 8 |
| LGP86 | 0.92 | 3.57E−03 | 4 | 4 | LGP86 | 0.86 | 1.20E−02 | 4 | 17 |
| LGP86 | 0.72 | 4.27E−02 | 5 | 9 | LGP86 | 0.90 | 5.39E−03 | 4 | 3 |
| LGP86 | 0.98 | 1.25E−04 | 7 | 3 | LGP86 | 0.90 | 5.89E−03 | 7 | 16 |
| LGP86 | 0.82 | 2.51E−02 | 7 | 11 | LGP86 | 0.92 | 3.20E−03 | 7 | 6 |
| LGP86 | 0.77 | 4.11E−02 | 7 | 10 | LGP86 | 0.78 | 3.66E−02 | 7 | 18 |
| LGP86 | 0.79 | 3.42E−02 | 7 | 19 | LGP86 | 0.85 | 1.47E−02 | 7 | 5 |
| LGP86 | 0.81 | 2.89E−02 | 7 | 7 | LGP86 | 0.87 | 1.03E−02 | 7 | 8 |
| LGP86 | 0.93 | 2.46E−03 | 7 | 4 | LGP86 | 0.93 | 2.24E−03 | 7 | 17 |
| LGP88 | 0.79 | 6.15E−02 | 2 | 6 | LGP89 | 0.77 | 4.11E−02 | 4 | 14 |
| LGP88 | 0.77 | 7.40E−02 | 4 | 1 | LGP88 | 0.77 | 7.59E−02 | 1 | 1 |
| LGP89 | 0.75 | 5.29E−02 | 1 | 2 | LGP89 | 0.71 | 2.07E−02 | 6 | 3 |
| LGP89 | 0.73 | 1.02E−01 | 2 | 12 | LGP90 | 0.86 | 2.80E−02 | 7 | 1 |
| LGP89 | 0.77 | 4.31E−02 | 4 | 6 | LGP89 | 0.71 | 7.64E−02 | 4 | 18 |
| LGP89 | 0.77 | 4.22E−02 | 4 | 4 | LGP89 | 0.71 | 1.15E−01 | 1 | 1 |
| LGP89 | 0.71 | 2.05E−02 | 6 | 6 | LGP89 | 0.71 | 2.25E−02 | 6 | 7 |
| LGP89 | 0.80 | 5.58E−03 | 6 | 8 | LGP89 | 0.77 | 9.49E−03 | 6 | 4 |
| LGP90 | 0.74 | 5.66E−02 | 1 | 3 | LGP90 | 0.77 | 4.10E−02 | 1 | 16 |
| LGP90 | 0.72 | 6.54E−02 | 1 | 9 | LGP90 | 0.78 | 3.89E−02 | 1 | 10 |
| LGP90 | 0.83 | 2.19E−02 | 1 | 19 | LGP90 | 0.91 | 4.05E−03 | 1 | 5 |
| LGP90 | 0.72 | 6.56E−02 | 1 | 7 | LGP90 | 0.85 | 1.51E−02 | 1 | 12 |
| LGP90 | 0.74 | 5.61E−02 | 1 | 17 | LGP90 | 0.81 | 4.96E−02 | 2 | 14 |
| LGP91 | 0.74 | 5.75E−02 | 1 | 3 | LGP91 | 0.73 | 1.62E−02 | 6 | 20 |
| LGP91 | 0.72 | 1.05E−01 | 2 | 2 | LGP92 | 0.77 | 4.39E−02 | 4 | 2 |
| LGP91 | 0.74 | 3.59E−02 | 5 | 18 | LGP91 | 0.81 | 2.77E−02 | 7 | 3 |
| LGP91 | 0.74 | 5.89E−02 | 7 | 16 | LGP91 | 0.73 | 6.14E−02 | 7 | 19 |
| LGP91 | 0.83 | 2.14E−02 | 7 | 5 | LGP91 | 0.76 | 4.71E−02 | 7 | 17 |
| LGP92 | 0.92 | 8.68E−03 | 2 | 14 | LGP92 | 0.73 | 1.01E−01 | 2 | 5 |
| LGP92 | 0.82 | 1.34E−02 | 8 | 1 | LGP92 | 0.83 | 1.07E−02 | 8 | 2 |
| LGP94 | 0.84 | 3.67E−02 | 1 | 1 | LGP94 | 0.71 | 1.12E−01 | 2 | 12 |
| LGP94 | 0.80 | 3.14E−02 | 4 | 15 | LGP94 | 0.82 | 2.34E−02 | 4 | 9 |
| LGP94 | 0.74 | 5.96E−02 | 4 | 19 | LGP94 | 0.80 | 3.05E−02 | 4 | 12 |
| LGP95 | 0.74 | 1.48E−02 | 6 | 3 | LGP95 | 0.71 | 2.05E−02 | 6 | 10 |
| LGP95 | 0.75 | 1.24E−02 | 6 | 4 | LGP95 | 0.71 | 2.02E−02 | 6 | 17 |

Table 84. Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal conditions across maize varieties. P = p value.

Example 12

Production of Maize Transcriptome and High Throughput Correlation Analysis with Yield, NUE, and ABST Related Parameters Measured in Semi-Hydroponics Conditions Using 60K Maize Oligonucleotide Micro-Arrays Maize vigor related parameters under low nitrogen, 100 mM NaCl, low temperature (10±2° C.) and normal growth conditions—Twelve Maize hybrids were grown in 5 repetitive plots, each containing 7 plants, at a net house under semi-hydroponics conditions. Briefly, the growing protocol was as follows: Maize seeds were sown in trays filled with a mix of vermiculite and peat in a 1:1 ratio. Following germination, the trays were transferred to the high salinity solution (100 mM NaCl in addition to the Full Hoagland solution), low temperature ("cold conditions" of 10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.6 mM N) or at Normal growth solution (Full Hoagland containing 16 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.136 grams/liter and 0.01% (volume/volume) of 'Super coratin' micro elements (Iron-EDDHA [ethylenediamine-N,N'-bis(2-hydroxyphenyl acetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed Maize tissues—Twelve selected Maize hybrids were sampled per each treatment. Two tissues [leaves and root tip] growing at 100 mM NaCl, low temperature (10±2° C.), low Nitrogen (1.6 mM N) or under Normal conditions were sampled at the vegetative stage (V4-5) and RNA was extracted as described above. Each micro-array expression information tissue type has received a Set ID as summarized in Table 85-88 below.

TABLE 85

Maize transcriptome expression sets under semi hydroponics conditions

| Expression set | Set ID |
|---|---|
| leaf at vegetative stage (V4-V5) under Normal conditions | 1 |
| root tip at vegetative stage (V4-V5) under Normal conditions | 2 |

Table 85: Provided are the Maize transcriptome expression sets at normal conditions.

TABLE 86

Maize transcriptome expression sets under semi hydroponics conditions

| Expression set | Set ID |
|---|---|
| leaf at vegetative stage (V4-V5) under cold conditions | 1 |
| root tip at vegetative stage (V4-V5) under cold conditions | 2 |

Table 86: Provided are the Maize transcriptome expression sets at cold conditions.

TABLE 87

Maize transcriptome expression sets under semi hydroponics conditions

| Expression set | Set ID |
|---|---|
| leaf at vegetative stage (V4-V5) under low N conditions (1.6 mM N) | 1 |
| root tip at vegetative stage (V4-V5) under low N conditions (1.6 mM N) | 2 |

Table 87: Provided are the Maize transcriptome expression sets at low nitrogen conditions 1.6 Mm Nitrogen.

TABLE 88

Maize transcriptome expression sets under semi hydroponics conditions

| Expression set | Set ID |
|---|---|
| leaf at vegetative stage (V4-V5) under salinity conditions (NaCl 100 mM) | 1 |
| root tip at vegetative stage (V4-V5) under salinity conditions (NaCl 100 mM) | 2 |

Table 88: Provided are the Maize transcriptome expression sets at 100 mM NaCl.

The following parameters were collected:

Leaves DW—leaves dry weight per plant (average of five plants).

Plant Height growth—was calculated as regression coefficient of plant height [cm] along time course (average of five plants).

Root DW—root dry weight per plant, all vegetative tissue above ground (average of four plants).

Root length—the length of the root was measured at V4 developmental stage.

Shoot DW—shoot dry weight per plant, all vegetative tissue above ground (average of four plants) after drying at 70° C. in oven for 48 hours.

Shoot FW—shoot fresh weight per plant, all vegetative tissue above ground (average of four plants).

SPAD—Chlorophyll content was determined using a Minolta SPAD 502 chlorophyll meter and measurement was performed 30 days post sowing. SPAD meter readings were done on young fully developed leaf. Three measurements per leaf were taken per plot.

Experimental Results 12 different Maize hybrids were grown and characterized at the vegetative stage (V4-5) for different parameters. The correlated parameters are described in Table 89 below. The average for each of the measured parameter was calculated using the JMP software and values are summarized in Tables 90-97 below. Subsequent correlation analysis was performed (Table 98-101). Results were then integrated to the database.

TABLE 89

Maize correlated parameters (vectors)

| Correlated parameter with | Correlation ID |
|---|---|
| Leaves DW [gr] | 1 |
| Plant height growth [cm/day] | 2 |
| Root DW [gr] | 3 |
| Root length [cm] | 4 |
| SPAD | 5 |
| Shoot DW [gr] | 6 |
| Shoot FW [gr] | 7 |

Table 89: Provided are the Maize correlated parameters.

TABLE 90

Maize accessions, measured parameters under low nitrogen growth conditions

| Ecotype/Treatment | Line-1 | Line-2 | Line-3 | Line-4 | Line-5 | Line-6 |
|---|---|---|---|---|---|---|
| 1 | 0.57 | 0.45 | 0.46 | 0.48 | 0.36 | 0.51 |
| 2 | 0.75 | 0.81 | 0.88 | 0.69 | 0.83 | 0.84 |
| 3 | 0.38 | 0.35 | 0.25 | 0.36 | 0.31 | 0.30 |
| 4 | 44.50 | 45.63 | 44.25 | 43.59 | 40.67 | 42.03 |
| 5 | 21.43 | 21.24 | 22.23 | 24.56 | 22.75 | 26.47 |
| 6 | 2.56 | 1.96 | 2.01 | 1.94 | 1.94 | 2.52 |
| 7 | 23.27 | 20.58 | 19.26 | 20.02 | 17.98 | 22.06 |

Table 90: Provided are the values of each of the parameters (as described above) measured in Maize accessions (Seed ID) under low nitrogen conditions. Growth conditions are specified in the experimental procedure section.

TABLE 91

Maize accessions, measured parameters under low nitrogen growth conditions

| Ecotype/Treatment | Line-7 | Line-8 | Line-9 | Line-10 | Line-11 | Line-12 |
|---|---|---|---|---|---|---|
| 1 | 0.53 | 0.58 | 0.55 | 0.51 | 0.56 | 0.39 |
| 2 | 0.78 | 0.92 | 0.89 | 0.85 | 0.80 | 0.64 |
| 3 | 0.29 | 0.31 | 0.29 | 0.32 | 0.43 | 0.17 |
| 4 | 42.65 | 45.06 | 45.31 | 42.17 | 41.03 | 37.65 |
| 5 | 22.08 | 25.09 | 23.73 | 25.68 | 25.02 | 19.51 |
| 6 | 2.03 | 2.37 | 2.09 | 2.17 | 2.62 | 1.53 |
| 7 | 21.28 | 22.13 | 20.29 | 19.94 | 22.50 | 15.93 |

Table 91: Provided are the values of each of the parameters (as described above) measured in Maize accessions (Seed ID) under low nitrogen conditions. Growth conditions are specified in the experimental procedure section.

TABLE 92

Maize accessions, measured parameters under 100 mM NaCl growth conditions

| Ecotype/Treatment | Line-1 | Line-2 | Line-3 | Line-4 | Line-5 | Line-6 |
|---|---|---|---|---|---|---|
| 1 | 0.41 | 0.50 | 0.43 | 0.48 | 0.43 | 0.56 |
| 2 | 0.46 | 0.40 | 0.45 | 0.32 | 0.32 | 0.31 |
| 3 | 0.05 | 0.05 | 0.03 | 0.07 | 0.05 | 0.03 |
| 4 | 10.88 | 11.28 | 11.82 | 10.08 | 8.46 | 10.56 |
| 5 | 36.55 | 39.92 | 37.82 | 41.33 | 40.82 | 44.40 |
| 6 | 2.43 | 2.19 | 2.25 | 2.26 | 1.54 | 1.94 |
| 7 | 19.58 | 20.78 | 18.45 | 19.35 | 15.65 | 16.09 |

Table 92: Provided are the values of each of the parameters (as described above) measured in Maize accessions (Seed ID) under 100 mM NaCl growth conditions. Growth conditions are specified in the experimental procedure section.

TABLE 93

Maize accessions, measured parameters under 100 mM NaCl growth conditions

| Ecotype/Treatment | Line-7 | Line-8 | Line-9 | Line-10 | Line-11 | Line-12 |
|---|---|---|---|---|---|---|
| 1 | 0.33 | 0.51 | 0.47 | 0.98 | 0.48 | 0.15 |
| 2 | 0.29 | 0.36 | 0.37 | 0.35 | 0.31 | 0.27 |
| 3 | 0.10 | 0.06 | 0.02 | 0.04 | 0.05 | 0.01 |
| 4 | 10.14 | 11.83 | 10.55 | 11.18 | 10.09 | 8.90 |
| 5 | 37.92 | 43.22 | 39.83 | 38.20 | 38.14 | 37.84 |
| 6 | 1.78 | 1.90 | 1.89 | 2.20 | 1.86 | 0.97 |
| 7 | 12.46 | 16.92 | 16.75 | 17.64 | 15.90 | 9.40 |

Table 93: Provided are the values of each of the parameters (as described above) measured in Maize accessions (Seed ID) under 100 mM NaCl growth conditions. Growth conditions are specified in the experimental procedure section.

TABLE 94

Maize accessions, measured parameters under cold growth conditions

| Ecotype/Treatment | Line-1 | Line-2 | Line-3 | Line-4 | Line-5 | Line-6 |
|---|---|---|---|---|---|---|
| 1 | 1.19 | 1.17 | 1.02 | 1.18 | 1.04 | 1.23 |
| 2 | 2.15 | 1.93 | 2.12 | 1.80 | 2.32 | 2.15 |
| 3 | 0.05 | 0.07 | 0.10 | 0.08 | 0.07 | 0.07 |
| 5 | 28.88 | 29.11 | 27.08 | 32.38 | 32.68 | 32.89 |
| 6 | 5.74 | 4.86 | 3.98 | 4.22 | 4.63 | 4.93 |
| 7 | 73.79 | 55.46 | 53.26 | 54.92 | 58.95 | 62.36 |

Table 94: Provided are the values of each of the parameters (as described above) measured in Maize accessions (Seed ID) under cold growth conditions. Growth conditions are specified in the experimental procedure section.

TABLE 95

Maize accessions, measured parameters under cold growth conditions

| Ecotype/Treatment | Line-7 | Line-8 | Line-9 | Line-10 | Line-11 | Line-12 |
|---|---|---|---|---|---|---|
| 1 | 1.13 | 0.98 | 0.88 | 1.28 | 1.10 | 0.60 |
| 2 | 2.49 | 2.01 | 1.95 | 2.03 | 1.85 | 1.21 |
| 3 | 0.14 | 0.07 | 0.07 | 0.02 | 0.05 | 0.06 |
| 5 | 31.58 | 33.01 | 28.65 | 31.43 | 30.64 | 30.71 |
| 6 | 4.82 | 4.03 | 3.57 | 3.99 | 4.64 | 1.89 |
| 7 | 63.65 | 54.90 | 48.25 | 52.83 | 55.08 | 29.61 |

Table 95: Provided are the values of each of the parameters (as described above) measured in Maize accessions (Seed ID) under cold growth conditions. Growth conditions are specified in the experimental procedure section.

TABLE 96

Maize accessions, measured parameters under regular growth conditions

| Ecotype/Treatment | Line-1 | Line-2 | Line-3 | Line-4 | Line-5 | Line-6 |
|---|---|---|---|---|---|---|
| 1 | 1.16 | 1.10 | 0.92 | 1.01 | 0.93 | 0.91 |
| 2 | 1.99 | 1.92 | 1.93 | 1.93 | 2.15 | 1.95 |
| 3 | 0.14 | 0.11 | 0.23 | 0.16 | 0.08 | 0.05 |
| 4 | 20.15 | 15.89 | 18.59 | 18.72 | 16.38 | 14.93 |
| 5 | 34.50 | 35.77 | 34.70 | 34.42 | 35.26 | 37.52 |
| 6 | 5.27 | 4.67 | 3.88 | 5.08 | 4.10 | 4.46 |
| 7 | 79.00 | 62.85 | 59.73 | 63.92 | 60.06 | 64.67 |

Table 96: Provided are the values of each of the parameters (as described above) measured in Maize accessions (Seed ID) under regular growth conditions. Growth conditions are specified in the experimental procedure section.

TABLE 97

Maize accessions, measured parameters under regular growth conditions

| Ecotype/Treatment | Line-7 | Line-8 | Line-9 | Line-10 | Line-11 | Line-12 |
|---|---|---|---|---|---|---|
| 1 | 1.11 | 1.01 | 1.01 | 1.02 | 1.23 | 0.44 |
| 2 | 2.23 | 1.94 | 1.97 | 2.05 | 1.74 | 1.26 |
| 3 | 0.17 | 0.10 | 0.07 | 0.10 | 0.14 | 0.03 |
| 4 | 17.48 | 15.74 | 15.71 | 17.58 | 16.13 | 17.43 |
| 5 | 36.50 | 36.07 | 33.74 | 34.34 | 35.74 | 29.04 |
| 6 | 4.68 | 4.59 | 4.08 | 4.61 | 5.42 | 2.02 |
| 7 | 68.10 | 65.81 | 58.31 | 61.87 | 70.04 | 35.96 |

Table 97: Provided are the values of each of the parameters (as described above) measured in Maize accessions (Seed ID) under regular growth conditions. Growth conditions are specified in the experimental procedure section.

TABLE 98

Correlation between the expression level of selected genes of some embodiments of the invention in various tissues and the phenotypic performance under normal conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGP25 | 0.74 | 2.15E−02 | 2 | 7 | LGP25 | 0.75 | 1.99E−02 | 2 | 6 |
| LGP72 | 0.71 | 2.02E−02 | 1 | 3 | LGP72 | 0.70 | 2.29E−02 | 1 | 6 |
| LGP74 | 0.83 | 2.88E−03 | 1 | 4 | LGP75 | 0.71 | 2.02E−02 | 1 | 7 |
| LGP75 | 0.77 | 9.15E−03 | 1 | 2 | LGP75 | 0.71 | 2.07E−02 | 1 | 1 |
| LGP75 | 0.73 | 1.61E−02 | 1 | 4 | LGP92 | 0.80 | 9.13E−03 | 2 | 7 |
| LGP92 | 0.72 | 2.94E−02 | 2 | 6 | | | | | |

Table 98. Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under normal conditions across Maize accessions. P = p value.

TABLE 99

Correlation between the expression level of selected genes of some embodiments of the invention in various tissues and the phenotypic performance under low nitrogen conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGP73 | 0.81 | 7.64E−03 | 2 | 2 | LGP73 | 0.73 | 2.46E−02 | 2 | 1 |
| LGP73 | 0.91 | 6.97E−04 | 2 | 4 | LGP86 | 0.70 | 2.30E−02 | 1 | 4 |

Table 99. Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under low nitrogen conditions across Maize accessions. P = p value.

TABLE 100

Correlation between the expression level of selected genes of some embodiments of the invention in various tissues and the phenotypic performance under cold conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGP25 | 0.72 | 2.79E−02 | 2 | 7 | LGP25 | 0.78 | 1.29E−02 | 2 | 1 |
| LGP25 | 0.75 | 1.89E−02 | 2 | 6 | LGP27 | 0.77 | 2.64E−02 | 1 | 3 |
| LGP72 | 0.74 | 3.65E−02 | 1 | 3 | LGP89 | 0.79 | 1.84E−02 | 1 | 3 |
| LGP92 | 0.85 | 6.86E−03 | 1 | 5 | | | | | |

Table 100. Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under cold conditions (10 ± 2° C.) across Maize accessions. P = p value.

TABLE 101

Correlation between the expression level of selected genes of some embodiments of the invention in various tissues and the phenotypic performance under salinity conditions across Maize accessions

| Gene Name | R | P value | Exp. set | Corr. Set ID | Gene Name | R | P value | Exp. set | Corr. Set ID |
|---|---|---|---|---|---|---|---|---|---|
| LGP25 | 0.78 | 1.27E−02 | 2 | 5 | LGP25 | 0.77 | 1.43E−02 | 2 | 1 |
| LGP73 | 0.71 | 3.13E−02 | 2 | 2 | LGP88 | 0.75 | 1.19E−02 | 1 | 5 |
| LGP92 | 0.75 | 1.31E−02 | 1 | 5 | | | | | |

Table 101. Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under salinity conditions (100 mM NaCl) across Maize accessions. P = p value.

Example 13

Production of Maize Transcriptome and High Throughput Correlation Analysis when Grown Under Normal and Defoliation Conditions Using 60K Maize Oligonucleotide Micro-Array To produce a high throughput correlation analysis, the present inventors utilized a Maize oligonucleotide microarray, produced by Agilent Technologies [chem. (dot) agilent (dot) com/Scripts/PDS (dot) asp?1Page=50879]. The array oligonucleotide represents about 60K Maize genes and transcripts designed based on data from Public databases (Example 1). To define correlations between the levels of RNA expression and yield, biomass components or vigor related parameters, various plant characteristics of 13 different Maize hybrids were analyzed under normal and defoliation conditions. Same hybrids were subjected to RNA expression analysis. The correlation between the RNA levels and the characterized parameters was analyzed using Pearson correlation test [davidmlane (dot) com/hyperstat/A34739 (dot) html].

Experimental Procedures 13 maize hybrids lines were grown in 6 repetitive plots, in field. Maize seeds were planted and plants were grown in the field using commercial fertilization and irrigation protocols. After silking 3 plots in every hybrid line underwent the defoliation treatment. In this treatment all the leaves above the ear (about 75% of the total leaves) were removed. After the treatment all the plants were grown according to the same commercial fertilization and irrigation protocols.

Three tissues at flowering developmental (R1) and grain filling (R3) stage including leaf (flowering -R1), stem (flowering -R1 and grain filling -R3), and flowering meristem (flowering -R1) representing different plant characteristics, were sampled from treated and untreated plants. RNA was extracted as described in "GENERAL EXPERIMENTAL AND BIOINFORMATICS METHODS". For convenience, each micro-array expression information tissue type has received a Set ID as summarized in Tables 102-104 below.

TABLE 102

Tissues used for Maize transcriptome expression sets (Under normal conditions)

| Expression Set | Set ID |
|---|---|
| Female meristem at flowering stage under normal conditions | 1 |
| leaf at flowering stage under normal conditions | 2 |
| stem at flowering stage under normal conditions | 3 |
| stem at grain filling stage under normal conditions | 4 |

Table 102: Provided are the identification (ID) numbers of each of the Maize expression sets.

TABLE 103

Tissues used for Maize transcriptome expression sets (Under defoliation conditions)

| Expression Set | Set ID |
|---|---|
| Female meristem at flowering stage under defoliation conditions | 1 |
| leaf at flowering stage under defoliation conditions | 2 |
| stem at flowering stage under defoliation conditions | 3 |
| stem at grain filling stage under defoliation conditions | 4 |

Table 103: Provided are the identification (ID) numbers of each of the Maize expression sets.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

The following parameters were collected by imaging.

1000 grain weight—At the end of the experiment all seeds from all plots were collected and weighed and the weight of 1000 was calculated.

Ear Area (cm$^2$)—At the end of the growing period 5 ears were photographed and images were processed using the below described image processing system. The Ear area was measured from those images and was divided by the number of ears.

Ear Length and Ear Width (cm)—At the end of the growing period 6 ears were, photographed and images were processed using the below described image processing system. The Ear length and width (longest axis) was measured from those images and was divided by the number of ears.

Grain Area (cm$^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains was weighted, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains was weighted, photographed and images were processed using the below described image processing system. The sum of grain perimeter was measured from those images and was divided by the number of grains.

Ear filled grain area (cm$^2$)—At the end of the growing period 5 ears were photographed and images were processed using the below described image processing system. The Ear area filled with kernels was measured from those images and was divided by the number of Ears.

Filled per Whole Ear—was calculated as the length of the ear with grains out of the total ear.

Additional parameters were collected either by sampling 6 plants per plot or by measuring the parameter across all the plants within the plot.

Cob width [cm]—The diameter of the cob without grains was measured using a ruler.

Ear average weight [kg]—At the end of the experiment (when ears were harvested) total and 6 selected ears per plots were collected. The ears were weighted and the average ear per plant was calculated. The ear weight was normalized using the relative humidity to be 0%.

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Ear row num—The number of rows per ear was counted.

Ear fresh weight per plant (GF)—During the grain filling period (GF) and total and 6 selected ears per plot were collected separately. The ears were weighted and the average ear weight per plant was calculated.

Ears dry weight—At the end of the experiment (when ears were harvested) total and 6 selected ears per plots were collected and weighted. The ear weight was normalized using the relative humidity to be 0%.

Ears fresh weight—At the end of the experiment (when ears were harvested) total and 6 selected ears per plots were collected and weighted.

Ears per plant—number of ears per plant were counted.

Grains weight (Kg.)—At the end of the experiment all ears were collected. Ears from 6 plants from each plot were separately threshed and grains were weighted.

Grains dry weight (Kg.)—At the end of the experiment all ears were collected. Ears from 6 plants from each plot were separately threshed and grains were weighted. The grain weight was normalized using the relative humidity to be 0%.

Grain weight per ear (Kg.)—At the end of the experiment all ears were collected. 5 ears from each plot were separately threshed and grains were weighted. The average grain weight per ear was calculated by dividing the total grain weight by the number of ears.

Leaves area per plant at GF and HD [LAI, leaf area index]=Total leaf area of 6 plants in a plot his parameter was measured at two time points during the course of the experiment; at heading (HD) and during the grain filling period (GF). Measurement was performed using a Leaf area-meter at two time points in the course of the experiment; during the grain filling period and at the heading stage (VT).

Leaves fresh weight at GF and HD—This parameter was measured at two time points during the course of the experiment; at heading (HD) and during the grain filling period (GF). Leaves used for measurement of the LAI were weighted.

Lower stem fresh weight at GF, HD and H—This parameter was measured at three time points during the course of the experiment: at heading (HD), during the grain filling period (GF) and at harvest (H). Lower internodes from at least 4 plants per plot were separated from the plant and weighted. The average internode weight per plant was calculated by dividing the total grain weight by the number of plants.

Lower stem length at GF, HD and H—This parameter was measured at three time points during the course of the experiment; at heading (HD), during the grain filling period (GF) and at harvest (H). Lower internodes from at least 4 plants per plot were separated from the plant and their length was measured using a ruler. The average internode length per plant was calculated by dividing the total grain weight by the number of plants.

Lower stem width at GF, HD, and H—This parameter was measured at three time points during the course of the experiment: at heading (HD), during the grain filling period (GF) and at harvest (H). Lower internodes from at least 4 plants per plot were separated from the plant and their diameter was measured using a caliber. The average internode width per plant was calculated by dividing the total grain weight by the number of plants.

Plant height growth—the relative growth rate (RGR) of Plant Height was calculated as described in Formula III above.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Stem fresh weight at GF and HD—This parameter was measured at two time points during the course of the experiment: at heading (HD) and during the grain filling period (GF). Stems of the plants used for measurement of the LAI were weighted.

Total dry matter—Total dry matter was calculated using Formula XXI above.

Upper stem fresh weight at GF, HD and H—This parameter was measured at three time points during the course of the experiment; at heading (HD), during the grain filling period (GF) and at harvest (H). Upper internodes from at least 4 plants per plot were separated from the plant and weighted. The average internode weight per plant was calculated by dividing the total grain weight by the number of plants.

Upper stem length at GF, HD, and H—This parameter was measured at three time points during the course of the experiment; at heading (HD), during the grain filling period (GF) and at harvest (H). Upper internodes from at least 4 plants per plot were separated from the plant and their length was measured using a ruler. The average internode length per plant was calculated by dividing the total grain weight by the number of plants.

Upper stem width at GF, HD and H (mm)—This parameter was measured at three time points during the course of the experiment; at heading (HD), during the grain filling period (GF) and at harvest (H). Upper internodes from at least 4 plants per plot were separated from the plant and their diameter was measured using a caliber. The average internode width per plant was calculated by dividing the total grain weight by the number of plants.

Vegetative dry weight (Kg.)—total weight of the vegetative portion of 6 plants (above ground excluding roots) after drying at 70° C. in oven for 48 hours weight by the number of plants.

Vegetative fresh weight (Kg.)—total weight of the vegetative portion of 6 plants (above ground excluding roots).

Node number—nodes on the stem were counted at the heading stage of plant development.

TABLE 104

Maize correlated parameters (vectors) under normal grown conditions and under the treatment of defoliation

| Normal conditions | | Defoliation | |
| --- | --- | --- | --- |
| Correlated parameter with | Correlation ID | Correlated parameter with | Correlation ID |
| 1000 grain weight [g] | 1 | 1000 grain weight | 1 |
| Avr internode length | 2 | Avr_internode_length | 2 |
| Cob width [mm] | 3 | Cob width | 3 |
| Ear Area [cm$^2$] | 4 | Ear Area (cm$^2$) | 4 |
| Ear filled grain area [cm$^2$] | 5 | Ear filled grain area | 5 |
| Ear Width [cm] | 6 | Ear Width | 6 |
| Ear average weight [g] | 7 | Ear average weight | 7 |
| Ear height [cm] | 8 | Ear height | 8 |
| Ear length [cm] | 9 | Ear length | 9 |
| Ear row num | 10 | Ear row num | 10 |
| Ear fresh weight per plant (GF) [g/plant] | 11 | Ears dry weight | 11 |
| Ears dry weight [kg] | 12 | Ears fresh weight | 12 |
| Ears fresh weight [kg] | 13 | Ears per plant | 13 |
| Ears per plant [number] | 14 | Filled per Whole Ear | 14 |
| Filled per Whole Ear [value] | 15 | Grain Perimeter | 15 |
| Grain Perimeter [cm] | 16 | Grain area [cm$^2$] | 16 |
| Grain area [cm$^2$] | 17 | Grain length | 17 |
| Grain length [cm] | 18 | Grain_width | 18 |
| Grain width [cm] | 19 | Grains dry weight | 19 |
| Grains dry weight [kg] | 20 | Grains weight | 20 |
| Grains weight [kg] | 21 | Grain weight per ear | 21 |
| Grain weight per ear [kg] | 22 | Harvest_index | 22 |
| Harvest index | 23 | Leaves fresh weight (HD) | 23 |
| Leaves fresh weight (GF) [g] | 24 | Leaves area per plant (hd) | 24 |
| Leaves fresh weight (HD) [g] | 25 | Leaves temperature (GF) | 25 |

TABLE 104-continued

Maize correlated parameters (vectors) under normal grown conditions and under the treatment of defoliation

| Normal conditions | | Defoliation | |
|---|---|---|---|
| Correlated parameter with | Correlation ID | Correlated parameter with | Correlation ID |
| Leaves area per plant (GF) [cm$^2$] | 26 | Lower stem fresh weight (H) | 26 |
| Leaves area per plant (HD) [cm$^2$] | 27 | Lower stem fresh weight (HD) | 27 |
| Leaves temperature (GF) | 28 | Lower stem length (H) | 28 |
| Lower stem fresh weight (GF) [g] | 29 | Lower stem length (HD) | 29 |
| Lower stem fresh weight (H) [g] | 30 | Lower stem width (H) | 30 |
| Lower stem fresh weight (HD) [g] | 31 | Lower stem width (HD) | 31 |
| Lower stem length (GF) [cm] | 32 | Node number | 32 |
| Lower stem length (H) [cm] | 33 | Plant height | 33 |
| Lower stem length (HD) [cm] | 34 | Plant height growth | 34 |
| Lower stem width (GF) [mm] | 35 | SPAD (GF) | 35 |
| Lower stem width (H) | 36 | Stem fresh weight (HD) | 36 |
| Lower stem width (HD) [mm] | 37 | Total dry matter | 37 |
| Node_number | 38 | Upper stem fresh weight (H) | 38 |
| Plant height [cm] | 39 | Upper stem length (H) | 39 |
| Plant height growth [cm/day] | 40 | Upper stem width (H) | 40 |
| SPAD (GF) [value] | 41 | Vegetative dry weight | 41 |
| Stem fresh weight (GF) [g] | 42 | Vegetative fresh weight | 42 |
| Stem fresh weight (HD) [g] | 43 | | |
| Total dry matter [kg] | 44 | | |
| Upper stem fresh weight (GF) [g] | 45 | | |
| Upper stem fresh weight (H) [g] | 46 | | |
| Upper stem length (GF) [cm] | 47 | | |
| Upper stem length (H) [cm] | 48 | | |
| Upper stem width (GF) [mm] | 49 | | |
| Upper stem width (H) [mm] | 50 | | |
| Vegetative dry weight [kg] | 51 | | |
| Vegetative fresh weight [kg] | 52 | | |

Table 104.

Thirteen maize varieties were grown, and characterized for parameters, as described above. The average for each parameter was calculated using the JMP software, and values are summarized in Tables 105-108 below. Subsequent correlation between the various transcriptome sets for all or sub set of lines was done by the bioinformatic unit and results were integrated into the database (Tables 109 and 110 below).

TABLE 105

Measured parameters in Maize Hybrid under normal conditions

| Ecotype/Treatment | Line-1 | Line-2 | Line-3 | Line-4 | Line-5 | Line-6 | Line-7 |
|---|---|---|---|---|---|---|---|
| 1 | 296.50 | 263.25 | 303.61 | 304.70 | 281.18 | 330.45 | 290.88 |
| 2 | 17.44 | 17.61 | 18.55 | 19.18 | 18.66 | 19.52 | 17.11 |
| 3 | 24.63 | 25.11 | 23.21 | 23.69 | 22.81 | 22.40 | 23.18 |
| 4 | 82.30 | 74.63 | 77.00 | 90.15 | 83.80 | 96.63 | 78.36 |
| 5 | 80.89 | 72.42 | 73.43 | 85.96 | 80.64 | 95.03 | 74.41 |
| 6 | 4.66 | 4.79 | 4.96 | 5.00 | 4.65 | 4.80 | 4.79 |
| 7 | 209.50 | 164.63 | 177.44 | 218.53 | 205.58 | 135.77 | 147.49 |
| 8 | 121.67 | 134.24 | 149.64 | 152.14 | 143.83 | 133.65 | 118.39 |
| 9 | 22.09 | 19.62 | 20.02 | 23.21 | 22.63 | 23.74 | 20.31 |
| 10 | 13.00 | 14.94 | 14.56 | 14.56 | 13.56 | 13.06 | 16.12 |
| 11 | 351.26 | 323.08 | 307.87 | 330.60 | 320.51 | 434.60 | 325.08 |
| 12 | 1.26 | 1.09 | 1.06 | 1.31 | 1.23 | 1.35 | 1.16 |
| 13 | 1.69 | 1.46 | 1.41 | 1.70 | 1.52 | 1.74 | 1.80 |
| 14 | 1.000 | 1.111 | 1.000 | 1.000 | 1.000 | 1.056 | 1.000 |
| 15 | 0.982 | 0.969 | 0.953 | 0.953 | 0.949 | 0.937 | 0.930 |
| 16 | 3.30 | 3.23 | 3.28 | 3.34 | 3.18 | 3.38 | 3.25 |
| 17 | 0.72 | 0.67 | 0.71 | 0.72 | 0.67 | 0.75 | 0.66 |
| 18 | 1.12 | 1.12 | 1.13 | 1.17 | 1.08 | 1.16 | 1.14 |
| 19 | 0.81 | 0.75 | 0.79 | 0.78 | 0.79 | 0.82 | 0.74 |
| 20 | 0.91 | 0.80 | 0.77 | 0.92 | 0.83 | 0.99 | 0.82 |
| 21 | 1.04 | 0.91 | 0.87 | 1.06 | 0.95 | 1.12 | 0.94 |
| 22 | 0.15 | 0.13 | 0.13 | 0.15 | 0.14 | 0.16 | 0.14 |
| 23 | 0.35 | 0.39 | 0.33 | 0.38 | 0.35 | 0.39 | 0.36 |
| 24 | 230.13 | 197.64 | 201.03 | 205.53 | 224.81 | 204.49 | 212.41 |
| 25 | 110.97 | 80.57 | 157.21 | 128.83 | 100.57 | 111.80 | 116.75 |
| 26 | 7034.60 | 6402.80 | 6353.07 | 6443.92 | 6835.50 | 6507.33 | 7123.48 |

TABLE 105-continued

Measured parameters in Maize Hybrid under normal conditions

| Ecotype/Treatment | Line-1 | Line-2 | Line-3 | Line-4 | Line-5 | Line-6 | Line-7 |
|---|---|---|---|---|---|---|---|
| 27 | 4341.25 | 3171.00 | 4205.50 | 4347.50 | 3527.00 | 4517.33 | 3984.78 |
| 28 | 33.11 | 33.52 | 33.87 | 34.18 | 33.78 | 32.85 | 33.19 |
| 29 | 35.40 | 25.03 | 26.51 | 21.74 | 26.13 | 34.44 | 27.61 |
| 30 | 23.52 | 20.34 | 25.08 | 14.18 | 17.53 | 25.74 | 20.60 |
| 31 | 72.99 | 59.90 | 74.72 | 90.48 | 69.52 | 66.91 | 60.36 |
| 32 | 19.35 | 20.40 | 20.93 | 21.38 | 20.03 | 20.31 | 18.08 |
| 33 | 16.76 | 20.02 | 22.59 | 21.68 | 22.34 | 21.39 | 17.07 |
| 34 | 14.50 | 17.75 | 20.00 | 19.35 | 20.33 | 20.75 | 15.00 |
| 35 | 19.86 | 16.84 | 16.14 | 16.37 | 17.01 | 17.53 | 18.11 |
| 36 | 19.42 | 17.19 | 16.09 | 16.92 | 17.52 | 17.88 | 17.96 |
| 37 | 24.14 | 20.53 | 20.97 | 24.43 | 21.70 | 19.49 | 23.47 |
| 38 | 15.22 | 14.56 | 14.61 | 14.83 | 15.00 | 13.83 | 14.28 |
| 39 | 265.11 | 255.94 | 271.11 | 283.89 | 279.72 | 268.78 | 244.25 |
| 40 | 5.43 | 5.59 | 6.15 | 5.99 | 6.37 | 6.47 | 4.82 |
| 41 | 59.77 | 53.17 | 53.21 | 54.95 | 53.99 | 55.24 | 55.38 |
| 42 | 649.03 | 489.32 | 524.06 | 512.66 | 542.16 | 627.76 | 507.78 |
| 43 | 758.61 | 587.88 | 801.32 | 794.80 | 721.87 | 708.38 | 660.70 |
| 44 | 2.57 | 2.06 | 2.32 | 2.44 | 2.36 | 2.57 | 2.23 |
| 45 | 19.61 | 15.54 | 17.82 | 10.79 | 14.41 | 20.31 | 15.85 |
| 46 | 12.94 | 11.21 | 12.98 | 6.50 | 7.99 | 12.08 | 9.72 |
| 47 | 16.63 | 18.75 | 18.38 | 17.92 | 17.60 | 18.79 | 17.07 |
| 48 | 16.93 | 18.76 | 18.72 | 20.01 | 19.40 | 19.65 | 16.42 |
| 49 | 16.00 | 14.11 | 13.50 | 11.89 | 13.08 | 14.34 | 15.04 |
| 50 | 14.93 | 13.00 | 12.44 | 12.04 | 12.89 | 13.28 | 13.10 |
| 51 | 1.31 | 0.97 | 1.25 | 1.13 | 1.13 | 1.21 | 1.07 |
| 52 | 3.16 | 2.25 | 2.61 | 2.60 | 2.42 | 2.64 | 2.22 |

Table 105.

TABLE 106

Measured parameters in Maize Hybrid under normal conditions, additional maize lines

| Ecotype/Treatment | Line-8 | Line-9 | Line-10 | Line-11 | Line-12 | Line-13 |
|---|---|---|---|---|---|---|
| 1 | 250.26 | 306.20 | 253.19 | 277.03 | 269.53 | 274.81 |
| 2 | 18.59 | 17.72 | 20.63 | 17.96 | 17.36 | 19.28 |
| 3 | 24.88 | 26.47 | 23.09 | 22.69 | 23.55 | 26.31 |
| 4 | 93.91 | 96.77 | 85.44 | 76.77 | NA | 97.99 |
| 5 | 92.31 | 95.43 | 83.28 | 74.35 | NA | 96.88 |
| 6 | 5.18 | 5.00 | 4.95 | 4.79 | NA | 5.43 |
| 7 | 207.11 | 228.44 | 215.92 | 198.69 | 188.50 | 254.42 |
| 8 | 145.24 | 133.78 | 143.71 | 134.17 | 143.00 | 147.78 |
| 9 | 22.60 | 23.84 | 21.74 | 20.04 | NA | 22.41 |
| 10 | 15.89 | 14.00 | 15.44 | 14.89 | 14.94 | 16.78 |
| 11 | 327.15 | 363.70 | 405.72 | 338.24 | 345.32 | 369.69 |
| 12 | 1.29 | 1.37 | 1.30 | 1.19 | 1.13 | 1.53 |
| 13 | 1.60 | 1.74 | 1.68 | 1.56 | 1.42 | 1.89 |
| 14 | 1.056 | 1.000 | 1.000 | 1.000 | 1.000 | 1.000 |
| 15 | 0.982 | 0.986 | 0.974 | 0.966 | NA | 0.989 |
| 16 | 3.18 | 3.29 | 3.27 | 3.22 | 3.15 | 3.38 |
| 17 | 0.65 | 0.70 | 0.68 | 0.67 | 0.65 | 0.72 |
| 18 | 1.12 | 1.15 | 1.16 | 1.12 | 1.09 | 1.21 |
| 19 | 0.73 | 0.77 | 0.74 | 0.76 | 0.76 | 0.76 |
| 20 | 0.92 | 1.02 | 0.94 | 0.85 | 0.81 | 1.14 |
| 21 | 1.05 | 1.15 | 1.08 | 0.97 | 0.92 | 1.29 |
| 22 | 0.15 | 0.17 | 0.16 | 0.14 | 0.14 | 0.19 |
| 23 | 0.33 | 0.44 | 0.39 | 0.39 | 0.39 | 0.40 |
| 24 | 181.43 | 199.22 | 206.91 | 168.54 | 199.42 | 200.12 |
| 25 | 106.95 | 85.97 | 102.71 | 105.73 | 102.12 | 143.06 |
| 26 | 6075.21 | 6597.67 | 6030.40 | 6307.06 | 6617.65 | 6848.03 |
| 27 | 3696.75 | 3926.67 | 3127.67 | 3942.75 | 3955.00 | 4854.00 |
| 28 | 33.66 | 33.78 | 32.64 | 33.95 | 33.28 | 33.90 |
| 29 | 25.26 | 26.18 | 34.31 | 25.50 | 23.06 | 25.59 |
| 30 | 16.35 | 18.90 | 27.30 | 22.35 | 19.26 | 22.82 |
| 31 | 63.07 | 55.89 | 82.13 | 60.02 | 58.70 | 116.12 |
| 32 | 20.18 | 19.81 | 22.89 | 19.81 | 19.53 | 21.40 |
| 33 | 20.69 | 18.48 | 23.31 | 19.39 | 19.66 | 19.97 |
| 34 | 18.68 | 20.50 | 22.57 | 19.83 | 14.50 | 20.33 |
| 35 | 17.09 | 16.87 | 17.49 | 16.62 | 17.10 | 17.38 |
| 36 | 18.42 | 17.43 | 18.07 | 17.68 | 17.61 | 18.93 |
| 37 | 20.97 | 21.46 | 21.41 | 22.12 | 23.25 | 24.31 |
| 38 | 14.72 | 15.44 | 14.33 | 14.44 | 14.89 | 14.39 |
| 39 | 273.56 | 273.22 | 295.33 | 259.25 | 257.89 | 277.19 |

TABLE 106-continued

Measured parameters in Maize Hybrid under normal conditions, additional maize lines

| Ecotype/Treatment | Line-8 | Line-9 | Line-10 | Line-11 | Line-12 | Line-13 |
|---|---|---|---|---|---|---|
| 40 | 6.01 | 5.99 | 6.66 | 5.99 | 5.62 | 6.53 |
| 41 | 56.76 | 55.81 | 58.54 | 51.68 | 55.16 | 54.16 |
| 42 | 549.34 | 509.74 | 662.13 | 527.43 | 474.68 | 544.03 |
| 43 | 724.58 | 618.46 | 837.56 | 612.81 | 728.00 | 950.29 |
| 44 | 2.73 | 2.33 | 2.40 | 2.20 | 2.08 | 2.84 |
| 45 | 14.39 | 17.85 | 20.42 | 13.93 | 13.05 | 16.45 |
| 46 | 6.98 | 9.40 | 13.58 | 9.20 | 7.69 | 10.17 |
| 47 | 17.52 | 18.15 | 18.61 | 17.69 | 18.15 | 18.64 |
| 48 | 18.34 | 16.63 | 19.38 | 16.71 | 16.27 | 15.92 |
| 49 | 13.63 | 14.73 | 14.61 | 13.17 | 12.77 | 14.15 |
| 50 | 13.48 | 13.42 | 13.27 | 13.14 | 12.53 | 13.79 |
| 51 | 1.44 | 0.96 | 1.10 | 1.01 | 0.95 | 1.31 |
| 52 | 2.90 | 2.22 | 2.83 | 2.29 | 2.15 | 2.90 |

Table 106.

TABLE 107

Measured parameters in Maize Hybrid under defoliation

| Ecotype/Treatment | Line-1 | Line-2 | Line-3 | Line-4 | Line-5 | Line-6 | Line-7 |
|---|---|---|---|---|---|---|---|
| 1 | 280.03 | 251.86 | 294.29 | 295.36 | 288.40 | 308.25 | 230.12 |
| 2 | 16.60 | 17.30 | 17.91 | 18.88 | 19.27 | 18.41 | 17.72 |
| 3 | 19.03 | 22.12 | 16.31 | 21.54 | 19.84 | 18.21 | 19.77 |
| 4 | 53.60 | 45.50 | 38.31 | 58.47 | 53.89 | 63.54 | 39.83 |
| 5 | 51.50 | 42.95 | 34.59 | 55.67 | 51.36 | 61.44 | 36.31 |
| 6 | 4.18 | 4.21 | 3.92 | 4.77 | 4.51 | 4.61 | 4.10 |
| 7 | 89.20 | 100.75 | 73.39 | 129.84 | 129.78 | 115.06 | 85.04 |
| 8 | 119.44 | 131.56 | 145.53 | 156.06 | 145.28 | 129.53 | 123.38 |
| 9 | 16.34 | 13.63 | 12.89 | 15.94 | 15.34 | 17.53 | 13.21 |
| 10 | 12.71 | 14.36 | 13.00 | 14.12 | 13.47 | 13.07 | 14.06 |
| 11 | 0.75 | 0.58 | 0.44 | 0.74 | 0.78 | 0.58 | 0.45 |
| 12 | 0.97 | 0.83 | 0.63 | 0.98 | 1.01 | 0.80 | 0.65 |
| 13 | 1.00 | 0.94 | 1.00 | 0.94 | 1.00 | 0.94 | 0.89 |
| 14 | 0.954 | 0.915 | 0.873 | 0.950 | 0.948 | 0.961 | 0.905 |
| 15 | 3.109 | 3.144 | 3.179 | 3.207 | 3.196 | 3.230 | 3.130 |
| 16 | 0.649 | 0.632 | 0.669 | 0.675 | 0.677 | 0.683 | 0.631 |
| 17 | 1.052 | 1.080 | 1.079 | 1.110 | 1.087 | 1.094 | 1.066 |
| 18 | 0.777 | 0.740 | 0.781 | 0.765 | 0.786 | 0.788 | 0.750 |
| 19 | 0.52 | 0.40 | 0.29 | 0.52 | 0.55 | 0.40 | 0.30 |
| 20 | 0.60 | 0.46 | 0.33 | 0.59 | 0.62 | 0.46 | 0.35 |
| 21 | 0.09 | 0.07 | 0.05 | 0.09 | 0.09 | 0.08 | 0.06 |
| 22 | 0.34 | 0.28 | 0.21 | 0.33 | 0.35 | 0.26 | 0.22 |
| 23 | 112.27 | 94.99 | 125.14 | 144.48 | 112.50 | 116.16 | 113.78 |
| 24 | 3914.00 | 3480.00 | 4276.50 | 4985.50 | 4643.50 | 4223.00 | 3436.00 |
| 25 | 32.47 | 33.09 | 33.64 | 32.29 | 32.87 | 33.40 | 33.43 |
| 26 | 23.02 | 26.50 | 26.98 | 15.24 | 18.19 | 37.21 | 27.88 |
| 27 | 64.16 | 53.81 | 56.41 | 80.95 | 71.27 | 66.69 | 64.19 |
| 28 | 16.29 | 21.44 | 20.85 | 22.58 | 22.94 | 21.62 | 18.76 |
| 29 | 15.15 | 18.50 | 16.67 | 18.07 | 18.00 | 19.83 | 16.10 |
| 30 | 19.54 | 16.90 | 15.79 | 17.01 | 17.12 | 18.17 | 18.21 |
| 31 | 24.30 | 20.57 | 21.06 | 24.87 | 20.85 | 20.46 | 20.96 |
| 32 | 15.17 | 14.39 | 15.00 | 15.11 | 14.50 | 14.22 | 14.39 |
| 33 | 251.42 | 248.64 | 268.06 | 285.11 | 278.83 | 261.88 | 254.64 |
| 34 | 6.38 | 6.32 | 6.31 | 6.93 | 6.83 | 7.14 | 6.48 |
| 35 | 61.21 | 57.36 | 58.02 | 62.36 | 60.72 | 62.22 | 59.65 |
| 36 | 713.54 | 538.04 | 705.53 | 803.33 | 703.36 | 664.23 | 673.24 |
| 37 | 1.54 | 1.37 | 1.44 | 1.53 | 1.57 | 1.57 | 1.34 |
| 38 | 8.68 | 11.08 | 14.10 | 4.89 | 6.04 | 13.95 | 10.93 |
| 39 | 16.24 | 18.83 | 17.74 | 19.64 | 20.74 | 20.14 | 17.18 |
| 40 | 14.27 | 12.82 | 12.69 | 11.09 | 12.00 | 13.03 | 14.25 |
| 41 | 0.79 | 0.78 | 1.00 | 0.79 | 0.79 | 1.00 | 0.88 |
| 42 | 2.51 | 1.96 | 2.80 | 2.11 | 2.20 | 2.79 | 2.54 |

Table 107.

TABLE 108

Measured parameters in Maize Hybrid under defoliation, additional maize lines

| Ecotype/Treatment | Line-8 | Line-9 | Line-10 | Line-11 | Line-12 | Line-13 |
|---|---|---|---|---|---|---|
| 1 | 271.25 | 259.43 | 243.98 | 262.41 | 248.64 | 244.16 |
| 2 | 17.88 | 17.26 | 18.94 | 18.69 | 18.25 | 19.97 |
| 3 | 22.44 | 20.28 | 19.64 | 22.32 | 23.31 | 27.78 |
| 4 | 47.33 | 65.90 | 43.83 | 43.28 | 52.30 | 58.31 |
| 5 | 43.34 | 64.80 | 39.56 | 40.43 | 49.28 | 55.69 |
| 6 | 4.20 | 4.66 | 4.06 | 4.01 | 4.41 | 4.98 |
| 7 | 33.10 | 161.76 | 89.36 | 87.68 | 88.18 | 124.58 |
| 8 | 135.00 | 136.50 | 136.39 | 130.32 | 139.71 | 143.44 |
| 9 | 14.82 | 17.60 | 13.78 | 13.75 | 15.53 | 14.87 |
| 10 | 13.75 | 13.94 | 12.79 | 13.00 | 14.29 | 15.83 |
| 11 | 0.63 | 0.80 | 0.54 | 0.55 | 0.51 | 0.75 |
| 12 | 0.82 | 1.15 | 0.88 | 0.79 | 0.69 | 0.99 |
| 13 | 1.00 | 0.88 | 1.00 | 1.06 | 0.94 | 1.00 |
| 14 | 0.905 | 0.983 | 0.890 | 0.918 | 0.940 | 0.950 |
| 15 | 3.016 | 3.117 | 3.086 | 3.030 | 2.976 | 3.153 |
| 16 | 0.610 | 0.623 | 0.619 | 0.600 | 0.583 | 0.631 |
| 17 | 1.024 | 1.084 | 1.054 | 1.025 | 0.995 | 1.095 |
| 18 | 0.750 | 0.724 | 0.741 | 0.738 | 0.733 | 0.725 |
| 19 | 0.44 | 0.67 | 0.36 | 0.38 | 0.34 | 0.53 |
| 20 | 0.50 | 0.77 | 0.41 | 0.43 | 0.39 | 0.61 |
| 21 | 0.07 | 0.12 | 0.06 | 0.06 | 0.06 | 0.09 |
| 22 | 0.28 | 0.38 | 0.24 | 0.29 | 0.23 | 0.31 |
| 23 | 93.74 | 89.86 | 86.98 | 117.27 | 150.68 | 161.65 |
| 24 | 4593.00 | 4315.50 | 4020.50 | 4154.00 | 4851.50 | 3750.00 |
| 25 | 33.42 | 33.98 | 33.12 | 32.64 | 33.55 | 33.27 |
| 26 | 17.33 | 20.51 | 25.36 | 28.41 | 23.16 | 38.80 |
| 27 | 76.23 | 57.85 | 69.98 | 67.30 | 72.90 | 83.58 |
| 28 | 20.88 | 17.83 | 20.70 | 20.43 | 20.11 | 24.13 |
| 29 | 14.83 | 17.50 | 23.67 | 19.00 | 16.45 | 20.60 |
| 30 | 17.23 | 17.88 | 17.12 | 17.53 | 18.63 | 19.87 |
| 31 | 22.47 | 21.23 | 19.85 | 21.29 | 23.58 | 21.37 |
| 32 | 14.67 | 15.61 | 14.39 | 14.06 | 14.61 | 14.00 |
| 33 | 261.94 | 268.88 | 272.71 | 262.50 | 266.33 | 279.14 |
| 34 | 6.28 | 7.04 | 7.20 | 7.34 | 6.94 | 7.27 |
| 35 | 59.99 | 56.76 | 65.70 | 57.94 | 60.31 | 57.71 |
| 36 | 738.37 | 692.23 | 619.79 | 729.23 | 794.64 | 847.52 |
| 37 | 1.47 | 1.66 | 1.48 | 1.31 | 1.48 | 1.71 |
| 38 | 6.48 | 9.01 | 10.69 | 10.38 | 8.49 | 12.29 |
| 39 | 19.12 | 16.74 | 15.96 | 17.31 | 18.19 | 17.77 |
| 40 | 12.77 | 13.52 | 13.08 | 13.43 | 13.21 | 14.72 |
| 41 | 0.84 | 0.86 | 0.94 | 0.76 | 0.96 | 0.97 |
| 42 | 2.48 | 2.35 | 2.59 | 2.41 | 2.70 | 2.72 |

Table 108.

Tables 109 and 110 hereinbelow provide the correlations (R) between the expression levels yield improving genes and their homologs in various tissues [Expression (Exp) sets] and the phenotypic performance [yield, biomass, growth rate and/or vigor components (Correlation vector (Corr.))] under normal and defoliation conditions across maize varieties. P=p value.

TABLE 109

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. ID |
|---|---|---|---|---|---|---|---|---|---|
| LGP25 | 0.75 | 3.33E−03 | 1 | 45 | LGP25 | 0.72 | 5.13E−03 | 1 | 11 |
| LGP25 | 0.74 | 5.65E−03 | 3 | 21 | LGP25 | 0.75 | 5.40E−03 | 3 | 12 |
| LGP25 | 0.83 | 9.13E−04 | 3 | 43 | LGP25 | 0.80 | 1.68E−03 | 3 | 31 |
| LGP25 | 0.75 | 5.38E−03 | 3 | 22 | LGP25 | 0.75 | 5.38E−03 | 3 | 20 |
| LGP25 | 0.72 | 1.30E−02 | 4 | 21 | LGP25 | 0.70 | 1.57E−02 | 4 | 43 |
| LGP25 | 0.73 | 1.02E−02 | 4 | 45 | LGP25 | 0.86 | 6.67E−04 | 4 | 11 |
| LGP25 | 0.72 | 1.29E−02 | 4 | 22 | LGP25 | 0.72 | 1.29E−02 | 4 | 20 |
| LGP25 | 0.71 | 1.48E−02 | 2 | 11 | LGP27 | 0.72 | 7.70E−03 | 3 | 29 |
| LGP27 | 0.80 | 1.84E−03 | 3 | 45 | LGP27 | 0.84 | 6.86E−04 | 3 | 46 |
| LGP27 | 0.75 | 7.62E−03 | 2 | 45 | LGP27 | 0.74 | 9.39E−03 | 2 | 17 |
| LGP27 | 0.73 | 1.09E−02 | 2 | 16 | LGP27 | 0.83 | 1.56E−03 | 2 | 11 |
| LGP72 | 0.72 | 1.21E−02 | 4 | 34 | LGP72 | 0.75 | 7.83E−03 | 4 | 33 |

TABLE 109-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. ID |
|---|---|---|---|---|---|---|---|---|---|
| LGP72 | 0.83 | 1.50E−03 | 4 | 48 | LGP73 | 0.72 | 8.51E−03 | 3 | 40 |
| LGP73 | 0.71 | 1.02E−02 | 3 | 34 | LGP73 | 0.80 | 1.87E−03 | 3 | 39 |
| LGP73 | 0.71 | 1.48E−02 | 4 | 10 | LGP73 | 0.90 | 1.49E−04 | 4 | 3 |
| LGP73 | 0.71 | 1.52E−02 | 4 | 32 | LGP73 | 0.73 | 1.09E−02 | 4 | 2 |
| LGP73 | 0.76 | 6.28E−03 | 2 | 47 | LGP73 | 0.71 | 1.41E−02 | 2 | 11 |
| LGP74 | 0.75 | 3.29E−03 | 1 | 3 | LGP74 | 0.87 | 9.50E−05 | 1 | 7 |
| LGP74 | 0.81 | 1.32E−03 | 1 | 15 | LGP74 | 0.72 | 1.28E−02 | 4 | 21 |
| LGP74 | 0.72 | 1.19E−02 | 4 | 31 | LGP74 | 0.76 | 6.92E−03 | 4 | 18 |
| LGP74 | 0.73 | 1.56E−02 | 4 | 6 | LGP74 | 0.73 | 1.06E−02 | 4 | 22 |
| LGP74 | 0.73 | 1.06E−02 | 4 | 20 | LGP74 | 0.73 | 1.64E−02 | 2 | 9 |
| LGP74 | 0.74 | 1.38E−02 | 2 | 6 | LGP75 | 0.74 | 5.59E−03 | 3 | 2 |
| LGP82 | 0.78 | 4.80E−03 | 4 | 32 | LGP86 | 0.75 | 7.37E−03 | 4 | 43 |
| LGP86 | 0.84 | 1.07E−03 | 2 | 45 | LGP86 | 0.76 | 7.16E−03 | 2 | 30 |
| LGP86 | 0.81 | 2.48E−03 | 2 | 11 | LGP86 | 0.74 | 9.22E−03 | 2 | 46 |
| LGP87 | 0.75 | 4.72E−03 | 3 | 33 | LGP87 | 0.72 | 8.91E−03 | 3 | 47 |
| LGP87 | 0.71 | 9.32E−03 | 3 | 48 | LGP87 | 0.80 | 1.77E−03 | 3 | 32 |
| LGP87 | 0.75 | 5.20E−03 | 3 | 2 | LGP87 | 0.84 | 1.29E−03 | 4 | 10 |
| LGP87 | 0.75 | 7.96E−03 | 2 | 21 | LGP87 | 0.72 | 1.97E−02 | 2 | 5 |
| LGP87 | 0.76 | 7.10E−03 | 2 | 22 | LGP87 | 0.76 | 7.10E−03 | 2 | 20 |
| LGP88 | 0.75 | 4.89E−03 | 3 | 43 | LGP88 | 0.74 | 8.97E−03 | 3 | 6 |
| LGP88 | 0.75 | 7.64E−03 | 4 | 11 | LGP89 | 0.73 | 1.08E−02 | 4 | 21 |
| LGP89 | 0.73 | 1.02E−02 | 4 | 43 | LGP89 | 0.78 | 5.03E−03 | 4 | 31 |
| LGP89 | 0.81 | 2.29E−03 | 4 | 18 | LGP89 | 0.72 | 1.29E−02 | 4 | 2 |
| LGP89 | 0.73 | 1.05E−02 | 4 | 11 | LGP89 | 0.73 | 1.05E−02 | 4 | 22 |
| LGP89 | 0.73 | 1.05E−02 | 4 | 20 | LGP90 | 0.91 | 3.04E−05 | 3 | 21 |
| LGP90 | 0.90 | 5.43E−05 | 3 | 12 | LGP90 | 0.72 | 8.49E−03 | 3 | 39 |
| LGP90 | 0.72 | 8.14E−03 | 3 | 43 | LGP90 | 0.77 | 5.82E−03 | 3 | 5 |
| LGP90 | 0.75 | 4.93E−03 | 3 | 31 | LGP90 | 0.84 | 6.59E−04 | 3 | 18 |
| LGP90 | 0.77 | 5.45E−03 | 3 | 4 | LGP90 | 0.76 | 4.40E−03 | 3 | 16 |
| LGP90 | 0.70 | 1.09E−02 | 3 | 32 | LGP90 | 0.72 | 8.41E−03 | 3 | 2 |
| LGP90 | 0.91 | 4.16E−05 | 3 | 22 | LGP90 | 0.91 | 4.16E−05 | 3 | 20 |
| LGP91 | 0.71 | 9.82E−03 | 3 | 43 | LGP91 | 0.75 | 5.23E−03 | 3 | 25 |
| LGP91 | 0.78 | 4.45E−03 | 4 | 43 | LGP91 | 0.74 | 9.48E−03 | 4 | 31 |
| LGP92 | 0.77 | 5.88E−03 | 3 | 15 | LGP92 | 0.79 | 2.22E−03 | 3 | 52 |
| LGP94 | 0.72 | 1.22E−02 | 4 | 43 | LGP95 | 0.72 | 8.44E−03 | 3 | 48 |
| LGP95 | 0.88 | 3.26E−04 | 4 | 14 | LGP95 | 0.77 | 9.60E−03 | 2 | 5 |
| LGP95 | 0.78 | 4.38E−03 | 2 | 47 | LGP95 | 0.76 | 1.04E−02 | 2 | 9 |
| LGP95 | 0.76 | 1.00E−02 | 2 | 4 | LGP95 | 0.78 | 7.60E−03 | 2 | 6 |

Table 109.

TABLE 110

Correlation between the expression level of selected genes of some embodiments of the invention in various tissues and the phenotypic performance under normal defoliation across maize varieties

| Gene Name | R | P value | Exp. set | Corr. Set ID | Gene Name | R | P value | Exp. set | Corr. Set ID |
|---|---|---|---|---|---|---|---|---|---|
| LGP25 | 0.77 | 5.16E−03 | 4 | 30 | LGP25 | 0.72 | 1.24E−02 | 4 | 42 |
| LGP27 | 0.74 | 6.01E−03 | 2 | 38 | LGP27 | 0.78 | 3.07E−03 | 2 | 26 |
| LGP27 | 0.76 | 6.58E−03 | 4 | 30 | LGP72 | 0.80 | 1.68E−03 | 1 | 21 |
| LGP72 | 0.72 | 7.96E−03 | 1 | 20 | LGP72 | 0.71 | 9.99E−03 | 1 | 11 |
| LGP72 | 0.73 | 6.65E−03 | 1 | 22 | LGP72 | 0.72 | 8.14E−03 | 1 | 19 |
| LGP72 | 0.81 | 1.30E−03 | 3 | 39 | LGP72 | 0.79 | 2.27E−03 | 3 | 28 |
| LGP72 | 0.75 | 5.19E−03 | 3 | 1 | LGP72 | 0.71 | 9.03E−03 | 3 | 2 |
| LGP73 | 0.71 | 9.34E−03 | 1 | 42 | LGP73 | 0.74 | 5.68E−03 | 1 | 41 |
| LGP73 | 0.74 | 5.87E−03 | 1 | 34 | LGP73 | 0.71 | 9.06E−03 | 3 | 16 |
| LGP73 | 0.74 | 5.85E−03 | 3 | 18 | LGP73 | 0.78 | 2.88E−03 | 2 | 3 |
| LGP74 | 0.70 | 1.07E−02 | 2 | 17 | LGP74 | 0.75 | 7.38E−03 | 4 | 38 |
| LGP74 | 0.74 | 8.95E−03 | 4 | 40 | LGP74 | 0.90 | 1.43E−04 | 4 | 30 |
| LGP74 | 0.88 | 3.82E−04 | 4 | 26 | LGP82 | 0.71 | 1.00E−02 | 3 | 39 |
| LGP82 | 0.73 | 7.37E−03 | 3 | 28 | LGP82 | 0.84 | 1.14E−03 | 4 | 3 |
| LGP82 | 0.78 | 4.59E−03 | 4 | 10 | LGP82 | 0.75 | 7.39E−03 | 4 | 26 |
| LGP86 | 0.73 | 6.72E−03 | 3 | 39 | LGP86 | 0.81 | 2.66E−03 | 4 | 31 |
| LGP87 | 0.77 | 3.63E−03 | 2 | 26 | LGP87 | 0.71 | 1.40E−02 | 4 | 11 |
| LGP88 | 0.70 | 1.64E−02 | 4 | 37 | LGP88 | 0.74 | 9.78E−03 | 4 | 41 |
| LGP89 | 0.79 | 2.02E−03 | 3 | 35 | LGP90 | 0.80 | 1.98E−03 | 1 | 3 |
| LGP91 | 0.78 | 3.00E−03 | 3 | 23 | LGP91 | 0.78 | 2.97E−03 | 3 | 36 |
| LGP91 | 0.73 | 7.20E−03 | 3 | 27 | LGP91 | 0.77 | 5.40E−03 | 4 | 36 |

TABLE 110-continued

Correlation between the expression level of selected genes of some embodiments of the invention in various tissues and the phenotypic performance under normal defoliation across maize varieties

| Gene Name | R | P value | Exp. set | Corr. Set ID | Gene Name | R | P value | Exp. set | Corr. Set ID |
|---|---|---|---|---|---|---|---|---|---|
| LGP91 | 0.91 | 1.11E−04 | 4 | 30 | LGP91 | 0.76 | 7.22E−03 | 4 | 42 |
| LGP94 | 0.71 | 9.99E−03 | 3 | 23 | LGP94 | 0.76 | 4.11E−03 | 2 | 30 |
| LGP94 | 0.85 | 9.61E−04 | 4 | 30 | LGP94 | 0.71 | 1.48E−02 | 4 | 31 |
| LGP95 | 0.83 | 9.53E−04 | 1 | 29 | LGP95 | 0.82 | 1.18E−03 | 2 | 29 |
| LGP95 | 0.85 | 4.31E−04 | 2 | 26 | | | | | |

Table 110.

Example 14

Production of Maize Transcriptome and High Throughput Correlation Analysis with Yield and NUE Related Parameters Using 60K Maize Oligonucleotide Micro-Arrays In order to produce a high throughput correlation analysis between plant phenotype and gene expression level, the present inventors utilized a maize oligonucleotide micro-array, produced by Agilent Technologies [chem. (dot) agilent (dot) com/Scripts/PDS (dot) asp?1Page=50879]. The array oligonucleotide represents about 60,000 maize genes and transcripts.

Correlation of Maize Hybrids Across Ecotypes Grown Under Low Nitrogen Conditions Experimental Procedures 12 Maize hybrids were grown in 3 repetitive plots in field. Maize seeds were planted and plants were grown in the field using commercial fertilization and irrigation protocols, which included 485 m³ water per dunam per entire growth period and fertilization of 30 units of nitrogen (using URAN® 21% fertilization) per dunam per entire growth period (normal conditions) or under low nitrogen conditions which included 50% percent less Nitrogen as compared to the amount of nitrogen provided under the normal conditions. In order to define correlations between the levels of RNA expression with NUE and yield components or vigor related parameters the 12 different maize hybrids were analyzed. Among them, 11 hybrids encompassing the observed variance were selected for RNA expression analysis. The correlation between the RNA levels and the characterized parameters was analyzed using Pearson correlation test [davidmlane (dot) com/hyperstat/A34739 (dot) html].

Analyzed Maize tissues—All 10 selected maize hybrids were sampled per each treatment (low N and normal conditions), in three time points (TP2=V6-V8 (six to eight collar leaf are visible, rapid growth phase and kernel row determination begins), TP5=R1-R2 (silking-blister), TP6=R3-R4 (milk-dough). Four types of plant tissues [Ear, flag leaf indicated in Table as leaf, grain distal part, and internode] were sampled and RNA was extracted as described above. Each micro-array expression information tissue type has received a Set ID as summarized in Tables 111-112 below.

TABLE 111

Maize transcriptome expression sets under low nitrogen conditions

| Expression Set | Set ID |
|---|---|
| Maize field Low N/Ear/TP5 | 1 |
| Maize field Low N/Ear/TP6 | 2 |
| Maize field Low N/Internodes/TP2 | 3 |
| Maize field Low N/Internodes/TP5 | 4 |
| Maize field Low N/Internodes/TP6 | 5 |
| Maize field Low N/Leaf/TP2 | 6 |
| Maize field Low N/Leaf/TP5 | 7 |
| Maize field Low N/Leaf/TP6 | 8 |

Table 111: Provided are the maize transcriptome expression sets under low nitrogen conditions Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant.

TABLE 112

Maize transcriptome expression sets under normal growth conditions

| Expression Set | Set ID |
|---|---|
| Maize field Normal/Ear/R1-R2 | 1 |
| Maize field Normal/Grain Distal/R4-R5 | 2 |
| Maize field Normal/Internode/R3-R4 | 3 |
| Maize field Normal/Leaf/R1-R2 | 4 |
| Maize field Normal/Ear/R3-R4 | 5 |
| Maize field Normal/Internode/R1-R2 | 6 |
| Maize field Normal/Internode/V6-V8 | 7 |
| Maize field Normal/Leaf/V6-V8 | 8 |

Table 112: Provided are the maize transcriptome expression sets under normal growth conditions. Leaf = the leaf below the main ear; Flower meristem = Apical meristem following male flower initiation; Ear = the female flower at the anthesis day. Grain Distal = maize developing grains from the cob extreme area, Grain Basal = maize developing grains from the cob basal area; Internodes = internodes located above and below the main ear in the plant.

The following parameters were collected using digital imaging system:

Grain Area ($cm^2$)—At the end of the growing period the grains were separated from the ear. A sample of ~200 grains were weighted, photographed and images were processed using the below described image processing system. The grain area was measured from those images and was divided by the number of grains.

Grain Length and Grain width (cm)—At the end of the growing period the grains were separated from the ear. A sample of ~200 grains were weighted, photographed and images were processed using the below described image processing system. The sum of grain lengths/or width (longest axis) was measured from those images and was divided by the number of grains.

Ear Area ($cm^2$)—At the end of the growing period 5 ears were photographed and images were processed using the below described image processing system. The Ear area was measured from those images and was divided by the number of Ears.

Ear Length and Ear Width (cm)—At the end of the growing period 5 ears were photographed and images were processed using the below described image processing system. The Ear length and width (longest axis) was measured from those images and was divided by the number of ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.)—At the end of the experiment all ears from plots within blocks A-C were collected. Six ears were separately threshed and grains were weighted, all additional ears were threshed together and weighted as well. The average grain weight per ear was calculated by dividing the total grain weight by number of total ears per plot (based on plot). In case of 6 ears, the total grains weight of 6 ears was divided by 6.

Ear FW (gr.)—At the end of the experiment (when ears were harvested) total and 6 selected ears per plots within blocks A-C were collected separately. The plants (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located.

Leaf number per plant—Plants were characterized for leaf number during growing period at 5 time points. In each measure, plants were measured for their leaf number by counting all the leaves of 3 selected plants per plot.

Relative Growth Rate was calculated using Formulas II-XIII, XXVIII, and/or XXXIV (described above).

SPAD—Chlorophyll content was determined using a Minolta SPAD 502 chlorophyll meter and measurement was performed at early stages of grain filling (R1-R2) and late stage of grain filling (R3-R4). SPAD meter readings were done on young fully developed leaf. Three measurements per leaf were taken per plot. Data were taken after 46 and 54 days after sowing (DPS).

Dry weight per plant—At the end of the experiment (when inflorescence were dry) all vegetative material from plots within blocks A-C were collected.

Dry weight=total weight of the vegetative portion above ground (excluding roots) after drying at 70° C. in oven for 48 hours.

Harvest Index (HI) (Maize)—The harvest index per plant was calculated using Formula XVII above.

Percent Filled Ear [%]—it was calculated as the percentage of the Ear area with grains out of the total ear.

Cob diameter [cm]—The diameter of the cob without grains was measured using a ruler.

Kernel Row Number per Ear—The number of rows in each ear was counted.

Experimental Results 11 different maize hybrids were grown and characterized for different parameters. Tables 111-112 describe the Maize expression sets, and Tables 113-114 below describe the Maize correlated parameters. The average for each of the measured parameters was calculated using the JMP software (Tables 115-118) and a subsequent correlation analysis was performed (Table 119-120). Results were then integrated to the database.

TABLE 113

Maize correlated parameters (vectors) under low nitrogen conditions

| Correlated parameter with | Correlation ID |
|---|---|
| Ear Length [cm] Low N | 1 |
| Ear Length of filled area [cm] Low N | 2 |
| Ear width [mm] Low N | 3 |
| Final Leaf Number [number] Low N | 4 |
| Final Main Ear Height [cm] Low N | 5 |
| Final Plant Height [cm] Low N | 6 |
| No of rows per ear [number] Low N | 7 |
| SPAD at R1-R2 [number] Low N | 8 |
| SPAD at R3-R4 [number] Low N | 9 |
| Stalk width at TP5 [cm] Low N | 10 |
| Ears weight per plot [kg] Low N | 11 |
| Final Plant DW [kg] Low N | 12 |
| Final Leaf Area [number] Low N | 13 |
| NUE yield kg/N applied in soil kg Low N | 14 |
| NUE at early grain filling [R1-R2] yield kg/N in plant per SPAD Low N | 15 |
| NUE at grain filling [R3-R4] yield kg/N in plant per SPAD Low N | 16 |
| NUpE [biomass/N applied] Low N | 17 |
| Seed yield per dunam [kg] Low N | 18 |
| Yield/LAI [Kg/cm$^2$] Low N | 19 |
| Yield/stalk width [Kg/cm] Low N | 20 |
| seed yield per plant [kg] Low N | 21 |

Table 113. "cm" = centimeters' "mm" = millimeters; "kg" = kilograms; SPAD at R1-R2 and SPAD R3-R4: Chlorophyll level after early and late stages of grain filling; "NUE" = nitrogen use efficiency; "NUpE" = nitrogen uptake efficiency; "LAI" = leaf area; "N" = nitrogen; Low N = under low Nitrogen conditions; "Normal" = under normal conditions; "dunam" = 1000 m$^2$.

TABLE 114

Maize correlated parameters (vectors) under normal conditions

| Correlated parameter with | Correlation ID |
|---|---|
| Final Plant DW [kg] Normal | 1 |
| Ear Length [cm] Normal | 2 |
| Ear Length of filled area [cm] Normal | 3 |
| Ear width [mm] Normal | 4 |
| Final Leaf Number [number] Normal | 5 |
| Final Main Ear Height [cm] Normal | 6 |
| Final Plant Height [cm] Normal | 7 |
| No of rows per ear [number] Normal | 8 |
| SPAD at R1-R2 [number] Normal | 9 |
| SPAD at R3-R4 [number] Normal | 10 |
| Stalk width at TP5 Normal | 11 |
| Ears weight per plot [kg] Normal | 12 |
| Final Leaf Area [number] Normal | 13 |
| NUE yield kg/N applied in soil kg Normal | 14 |
| NUE at early grain filling [R1-R2] yield kg/N in plant per SPAD Normal | 15 |
| NUE at grain filling [R3-R4] yield kg/N in plant per SPAD Normal | 16 |
| NUpE [biomass/N applied] Normal | 17 |
| Seed yield per dunam [kg] Normal | 18 |
| Yield/LAI Normal | 19 |
| Yield/stalk width Normal | 20 |
| seed yield per plant [kg] Normal | 21 |

Table 114. "cm" = centimeters' "mm" = millimeters; "kg" = kilograms; SPAD at R1-R2 and SPAD R3-R4: Chlorophyll level after early and late stages of grain filling; "NUE" = nitrogen use efficiency; "NUpE" = nitrogen uptake efficiency; "LAI" = leaf area; "N" = nitrogen; Low N = under low Nitrogen conditions; "Normal" = under normal conditions; "dunam" = 1000 m$^2$.

TABLE 115

Measured parameters in Maize accessions under Low nitrogen conditions

| Ecotype/Treatment | Line-1 | Line-2 | Line-3 | Line-4 | Line-5 | Line-6 |
|---|---|---|---|---|---|---|
| 1 | 20.61 | 20.98 | 20.22 | 20.11 | 20.11 | 18.50 |
| 2 | 18.40 | 18.42 | 19.78 | 18.83 | 16.22 | 16.00 |
| 3 | 46.71 | 48.22 | 48.32 | 49.86 | 52.87 | 47.44 |
| 4 | 15.02 | 11.64 | 13.50 | 11.61 | 11.83 | 11.89 |
| 5 | 158.08 | 136.24 | 128.39 | 133.06 | 137.83 | 99.56 |
| 6 | 305.84 | 270.93 | 290.61 | 252.17 | 260.22 | 227.22 |
| 7 | 14.18 | 15.21 | 15.00 | 15.67 | 16.00 | 15.94 |
| 8 | 60.24 | 57.94 | 58.76 | 59.48 | 58.50 | 64.04 |
| 9 | 59.29 | 57.62 | 58.40 | 59.19 | 58.19 | 62.67 |
| 10 | 2.76 | 2.42 | 2.65 | 2.77 | 2.67 | 2.59 |
| 11 | 6.61 | 7.97 | 9.63 | 9.22 | 7.63 | 7.21 |
| 12 | 1.59 | 1.43 | 1.53 | 1.95 | 1.48 | 1.60 |
| 14 | 7.22 | 8.41 | 10.33 | 9.99 | 7.63 | 7.73 |
| 15 | 18.02 | 21.79 | 26.33 | 25.14 | 19.55 | 18.05 |
| 16 | 18.35 | 21.92 | 26.48 | 25.33 | 19.69 | 18.54 |
| 17 | 0.011 | 0.010 | 0.010 | 0.013 | 0.010 | 0.011 |
| 18 | 1083.75 | 1261.63 | 1549.24 | 1497.86 | 1143.85 | 1159.26 |
| 20 | 416.53 | 528.38 | 583.46 | 541.02 | 428.09 | 444.29 |
| 21 | 0.14 | 0.16 | 0.19 | 0.19 | 0.14 | 0.14 |
| 13 | 2.92 | 3.15 | 3.33 | 2.87 | 2.79 | 3.76 |
| 19 | 341.50 | 408.09 | 464.77 | 522.26 | 439.53 | 312.58 |

Table 115. Provided are the values of each of the parameters (as described above) measured in maize accessions (line) under low nitrogen growth conditions. Growth conditions are specified in the experimental procedure section.

TABLE 116

Additional parameters in Maize accessions under Low nitrogen conditions

| Ecotype/Treatment | Line-7 | Line-8 | Line-9 | Line-10 | Line-11 |
|---|---|---|---|---|---|
| 1 | 19.06 | 18.25 | 20.10 | 17.81 | 21.25 |
| 2 | 15.28 | 15.69 | 16.77 | 14.06 | 19.56 |
| 3 | 49.61 | 48.57 | 52.41 | 42.63 | 50.00 |
| 4 | 12.56 | 11.67 | 12.44 | 9.28 | 13.17 |
| 5 | 130.17 | 114.61 | 143.86 | 61.61 | 114.44 |
| 6 | 271.72 | 248.61 | 279.33 | 171.28 | 269.78 |
| 7 | 15.56 | 14.50 | 16.41 | 14.37 | 15.74 |
| 8 | 56.42 | 60.00 | 58.32 | 53.06 | 61.72 |
| 9 | 61.04 | 59.87 | 57.47 | 49.61 | 61.87 |
| 10 | 2.98 | 2.61 | 2.65 | 2.28 | 2.82 |
| 11 | 7.92 | 28.96 | 7.80 | 2.41 | 9.78 |
| 12 | 1.58 | 1.28 | 1.51 | 0.43 | 1.52 |
| 14 | 8.05 | 8.33 | 7.64 | 2.55 | 10.60 |
| 15 | 21.39 | 20.79 | 19.68 | 7.21 | 25.70 |
| 16 | 19.78 | 20.92 | 19.94 | 7.72 | 25.90 |
| 17 | 0.011 | 0.009 | 0.010 | 0.003 | 0.010 |
| 18 | 1207.42 | 1250.05 | 1146.04 | 383.22 | 1589.91 |
| 20 | 407.20 | 477.44 | 445.60 | 167.90 | 562.29 |
| 21 | 0.15 | 0.16 | 0.14 | 0.05 | 0.20 |
| 13 | 3.50 | 5.02 | | | 3.16 |
| 19 | 345.90 | 287.73 | | | 501.24 |

Table 116. Provided are the values of each of the parameters (as described above) measured in maize accessions (line) under low nitrogen growth conditions. Growth conditions are specified in the experimental procedure section.

TABLE 117

Measured parameters in Maize accessions under normal growth conditions

| Ecotype/Treatment | Line-1 | Line-2 | Line-3 | Line-4 | Line-5 | Line-6 |
|---|---|---|---|---|---|---|
| 1 | 1.27 | 1.30 | 1.33 | 1.50 | 1.30 | 1.58 |
| 2 | 19.94 | 20.17 | 18.11 | 19.89 | 19.50 | 17.72 |
| 3 | 16.23 | 17.50 | 17.72 | 18.44 | 15.67 | 14.67 |
| 4 | 51.08 | 46.29 | 45.92 | 47.63 | 51.41 | 47.42 |
| 5 | 11.80 | 11.11 | 13.28 | 11.78 | 11.94 | 12.33 |
| 6 | 130.31 | 122.33 | 127.67 | 113.02 | 135.28 | 94.28 |
| 7 | 273.46 | 260.50 | 288.00 | 238.50 | 286.94 | 224.83 |

TABLE 117-continued

Measured parameters in Maize accessions under normal growth conditions

| Ecotype/Treatment | Line-1 | Line-2 | Line-3 | Line-4 | Line-5 | Line-6 |
|---|---|---|---|---|---|---|
| 8 | 16.11 | 14.67 | 15.44 | 15.89 | 16.17 | 15.17 |
| 9 | 56.89 | 57.16 | 59.27 | 61.61 | 58.63 | 61.23 |
| 10 | 59.93 | 60.90 | 56.89 | 58.70 | 58.70 | 63.16 |
| 11 | 2.91 | 2.64 | 2.71 | 2.90 | 2.70 | 2.62 |
| 12 | 8.94 | 7.02 | 7.53 | 7.99 | 8.48 | 5.63 |
| 14 | 4.45 | 3.62 | 4.01 | 4.24 | 4.01 | 3.12 |
| 15 | 23.43 | 19.05 | 20.29 | 20.72 | 20.49 | 15.36 |
| 16 | 24.98 | 17.81 | 20.33 | 19.96 | 19.03 | 13.90 |
| 17 | 0.008 | 0.009 | 0.009 | 0.010 | 0.009 | 0.011 |
| 18 | 1335.63 | 1087.06 | 1202.53 | 1271.20 | 1202.97 | 937.08 |
| 20 | 456.71 | 412.44 | 443.37 | 438.70 | 446.66 | 356.95 |
| 21 | 0.167 | 0.136 | 0.150 | 0.159 | 0.150 | 0.117 |
| 13 | 3.21 | 3.95 | 3.33 | 4.01 | 3.86 | 4.19 |
| 19 | 426.09 | 312.97 | 307.28 | 362.44 | 314.14 | 224.58 |

Table 117. Provided are the values of each of the parameters (as described above) measured in maize accessions (line) under normal growth conditions. Growth conditions are specified in the experimental procedure section.

20

TABLE 118

Additional measured parameters in Maize accessions under normal growth conditions

| Ecotype/Treatment | Line-7 | Line-8 | Line-9 | Line-10 | Line-11 |
|---|---|---|---|---|---|
| 1 | 1.42 | 1.37 | 11.38 | 1.70 | 0.42 |
| 2 | 17.67 | 17.28 | 20.50 | 17.50 | 19.86 |
| 3 | 12.94 | 14.03 | 18.78 | 12.33 | 16.07 |
| 4 | 47.25 | 46.85 | 49.28 | 48.28 | 41.84 |
| 5 | 12.44 | 12.22 | 12.56 | 11.67 | 9.28 |
| 6 | 120.94 | 107.72 | 112.50 | 139.67 | 60.44 |
| 7 | 264.44 | 251.61 | 278.44 | 279.00 | 163.78 |
| 8 | 16.00 | 14.83 | 15.39 | 17.67 | 14.27 |
| 9 | 60.17 | 61.09 | 62.20 | 57.51 | 52.04 |
| 10 | 59.75 | 62.35 | 61.93 | 57.23 | 49.34 |
| 11 | 2.92 | 2.72 | 2.84 | 2.66 | 2.26 |
| 12 | 6.10 | 6.66 | 8.40 | 8.21 | 1.88 |
| 14 | 3.29 | 3.50 | 4.55 | 4.09 | 1.00 |
| 15 | 16.38 | 17.19 | 21.96 | 20.99 | 5.72 |
| 16 | 16.23 | 17.21 | 21.02 | 21.53 | 5.52 |
| 17 | 0.009 | 0.009 | 0.076 | 0.004 | 0.003 |
| 18 | 985.89 | 1050.13 | 1365.29 | 1226.08 | 300.93 |
| 20 | 337.49 | 385.79 | 481.94 | 471.57 | 139.73 |
| 21 | 0.123 | 0.131 | 0.171 | 0.15 | 0.04 |
| 13 | 3.97 | 4.32 | 2.89 | 4.31 | |
| 19 | 266.44 | 261.66 | 482.33 | | |

Table 118. Provided are the values of each of the parameters (as described above) measured in maize accessions (line) under normal growth conditions. Growth conditions are specified in the experimental procedure section.

TABLE 119

Correlation between the expression level of selected genes of some embodiments of the invention in various tissues and the phenotypic performance under low nitrogen conditions across maize accession

| Gene Name | R | P value | Exp. set | Corr. Set ID | Gene Name | R | P value | Exp. set | Corr. Set ID |
|---|---|---|---|---|---|---|---|---|---|
| LGP25 | 0.93 | 7.80E−03 | 1 | 19 | LGP25 | 0.71 | 7.10E−02 | 4 | 17 |
| LGP25 | 0.71 | 7.10E−02 | 4 | 12 | LGP27 | 0.73 | 6.25E−02 | 1 | 18 |
| LGP27 | 0.73 | 6.25E−02 | 1 | 14 | LGP27 | 0.75 | 5.31E−02 | 1 | 20 |
| LGP27 | 0.89 | 8.05E−03 | 1 | 2 | LGP27 | 0.73 | 6.25E−02 | 1 | 21 |
| LGP27 | 0.74 | 5.58E−02 | 1 | 16 | LGP27 | 0.81 | 4.96E−02 | 6 | 10 |
| LGP27 | 0.81 | 5.19E−02 | 6 | 3 | LGP27 | 0.72 | 4.59E−02 | 8 | 4 |
| LGP27 | 0.74 | 5.64E−02 | 4 | 13 | LGP27 | 0.89 | 6.55E−03 | 4 | 11 |
| LGP72 | 0.73 | 2.43E−02 | 5 | 4 | LGP72 | 0.85 | 3.01E−02 | 6 | 9 |
| LGP72 | 0.79 | 6.10E−02 | 6 | 8 | LGP72 | 0.83 | 1.15E−02 | 8 | 4 |
| LGP72 | 0.86 | 6.28E−03 | 8 | 5 | LGP72 | 0.86 | 5.85E−03 | 8 | 6 |
| LGP72 | 0.78 | 2.29E−02 | 7 | 18 | LGP72 | 0.84 | 9.09E−03 | 7 | 17 |
| LGP72 | 0.77 | 2.50E−02 | 7 | 9 | LGP72 | 0.70 | 5.24E−02 | 7 | 4 |

TABLE 119-continued

Correlation between the expression level of selected genes of some embodiments of the invention in various tissues and the phenotypic performance under low nitrogen conditions across maize accession

| Gene Name | R | P value | Exp. set | Corr. Set ID | Gene Name | R | P value | Exp. set | Corr. Set ID |
|---|---|---|---|---|---|---|---|---|---|
| LGP72 | 0.87 | 4.65E−03 | 7 | 3 | LGP72 | 0.84 | 9.82E−03 | 7 | 5 |
| LGP72 | 0.79 | 1.94E−02 | 7 | 7 | LGP72 | 0.78 | 2.29E−02 | 7 | 14 |
| LGP72 | 0.75 | 3.21E−02 | 7 | 20 | LGP72 | 0.78 | 2.16E−02 | 7 | 6 |
| LGP72 | 0.78 | 2.11E−02 | 7 | 15 | LGP72 | 0.84 | 9.09E−03 | 7 | 12 |
| LGP72 | 0.74 | 3.49E−02 | 7 | 1 | LGP72 | 0.78 | 2.29E−02 | 7 | 21 |
| LGP72 | 0.75 | 3.11E−02 | 7 | 16 | LGP72 | 0.70 | 5.24E−02 | 2 | 9 |
| LGP72 | 0.78 | 3.76E−02 | 4 | 5 | LGP72 | 0.78 | 3.94E−02 | 4 | 1 |
| LGP73 | 0.88 | 2.15E−02 | 6 | 5 | LGP73 | 0.82 | 4.77E−02 | 6 | 6 |
| LGP73 | 0.82 | 2.40E−02 | 8 | 19 | LGP73 | 0.92 | 3.47E−03 | 7 | 13 |
| LGP73 | 0.93 | 8.17E−04 | 7 | 11 | LGP73 | 0.73 | 6.33E−02 | 4 | 9 |
| LGP73 | 0.72 | 6.94E−02 | 4 | 4 | LGP73 | 0.83 | 2.20E−02 | 4 | 8 |
| LGP73 | 0.80 | 3.19E−02 | 4 | 6 | LGP74 | 0.87 | 2.35E−02 | 1 | 13 |
| LGP74 | 0.93 | 6.50E−03 | 6 | 17 | LGP74 | 0.79 | 6.27E−02 | 6 | 4 |
| LGP74 | 0.73 | 1.02E−01 | 6 | 7 | LGP74 | 0.81 | 5.11E−02 | 6 | 6 |
| LGP74 | 0.93 | 6.50E−03 | 6 | 12 | LGP74 | 0.72 | 4.54E−02 | 8 | 7 |
| LGP74 | 0.80 | 3.19E−02 | 8 | 19 | LGP74 | 0.98 | 1.44E−04 | 2 | 13 |
| LGP74 | 0.77 | 4.50E−02 | 4 | 8 | LGP75 | 0.79 | 3.33E−02 | 1 | 5 |
| LGP75 | 0.71 | 7.67E−02 | 1 | 1 | LGP75 | 0.71 | 3.16E−02 | 5 | 18 |
| LGP75 | 0.71 | 3.16E−02 | 5 | 14 | LGP75 | 0.71 | 3.16E−02 | 5 | 21 |
| LGP75 | 0.89 | 1.61E−02 | 6 | 18 | LGP75 | 0.82 | 4.52E−02 | 6 | 4 |
| LGP75 | 0.74 | 9.56E−02 | 6 | 3 | LGP75 | 0.83 | 3.91E−02 | 6 | 5 |
| LGP75 | 0.89 | 1.61E−02 | 6 | 14 | LGP75 | 0.85 | 3.38E−02 | 6 | 6 |
| LGP75 | 0.96 | 2.34E−03 | 6 | 15 | LGP75 | 0.88 | 2.24E−02 | 6 | 19 |
| LGP75 | 0.74 | 9.43E−02 | 6 | 2 | LGP75 | 0.74 | 9.16E−02 | 6 | 1 |
| LGP75 | 0.89 | 1.61E−02 | 6 | 21 | LGP75 | 0.89 | 1.76E−02 | 6 | 16 |
| LGP75 | 0.76 | 4.85E−02 | 8 | 19 | LGP75 | 0.74 | 3.67E−02 | 7 | 18 |
| LGP75 | 0.71 | 4.78E−02 | 7 | 8 | LGP75 | 0.74 | 3.67E−02 | 7 | 14 |
| LGP75 | 0.71 | 4.90E−02 | 7 | 20 | LGP75 | 0.73 | 3.91E−02 | 7 | 11 |
| LGP75 | 0.74 | 3.67E−02 | 7 | 21 | LGP75 | 0.71 | 4.73E−02 | 7 | 16 |
| LGP75 | 0.90 | 2.39E−03 | 2 | 17 | LGP75 | 0.77 | 2.48E−02 | 2 | 5 |
| LGP75 | 0.90 | 2.39E−03 | 2 | 12 | LGP75 | 0.71 | 7.62E−02 | 4 | 20 |
| LGP75 | 0.95 | 1.12E−03 | 4 | 6 | LGP75 | 0.71 | 7.47E−02 | 4 | 2 |
| LGP75 | 0.78 | 3.77E−02 | 4 | 1 | LGP82 | 0.88 | 1.99E−02 | 1 | 19 |
| LGP82 | 0.83 | 2.06E−02 | 1 | 2 | LGP82 | 0.70 | 7.74E−02 | 1 | 1 |
| LGP82 | 0.87 | 2.45E−02 | 6 | 5 | LGP82 | 0.80 | 5.53E−02 | 6 | 6 |
| LGP82 | 0.71 | 2.14E−02 | 3 | 17 | LGP82 | 0.71 | 2.14E−02 | 3 | 12 |
| LGP82 | 0.89 | 7.76E−03 | 4 | 17 | LGP82 | 0.78 | 3.81E−02 | 4 | 3 |
| LGP82 | 0.89 | 7.76E−03 | 4 | 12 | LGP82 | 0.72 | 6.74E−02 | 4 | 19 |
| LGP86 | 0.90 | 5.23E−03 | 1 | 18 | LGP86 | 0.80 | 2.93E−02 | 1 | 4 |
| LGP86 | 0.82 | 2.39E−02 | 1 | 3 | LGP86 | 0.87 | 1.00E−02 | 1 | 5 |
| LGP86 | 0.90 | 5.23E−03 | 1 | 14 | LGP86 | 0.87 | 1.03E−02 | 1 | 20 |
| LGP86 | 0.91 | 4.96E−03 | 1 | 6 | LGP86 | 0.94 | 1.73E−03 | 1 | 15 |
| LGP86 | 0.76 | 4.64E−02 | 1 | 2 | LGP86 | 0.90 | 5.23E−03 | 1 | 21 |
| LGP86 | 0.93 | 2.57E−03 | 1 | 16 | LGP86 | 0.74 | 1.35E−02 | 3 | 18 |
| LGP86 | 0.72 | 1.84E−02 | 3 | 10 | LGP86 | 0.74 | 1.36E−02 | 3 | 17 |
| LGP86 | 0.81 | 4.17E−03 | 3 | 4 | LGP86 | 0.73 | 1.55E−02 | 3 | 3 |
| LGP86 | 0.87 | 1.04E−03 | 3 | 5 | LGP86 | 0.74 | 1.35E−02 | 3 | 14 |
| LGP86 | 0.92 | 1.89E−04 | 3 | 6 | LGP86 | 0.77 | 8.94E−03 | 3 | 15 |
| LGP86 | 0.74 | 1.36E−02 | 3 | 12 | LGP86 | 0.75 | 1.29E−02 | 3 | 1 |
| LGP86 | 0.74 | 1.35E−02 | 3 | 21 | LGP86 | 0.76 | 1.14E−02 | 3 | 16 |
| LGP86 | 0.88 | 4.39E−03 | 8 | 4 | LGP86 | 0.87 | 4.51E−03 | 8 | 5 |
| LGP86 | 0.87 | 5.13E−03 | 8 | 6 | LGP86 | 0.77 | 2.41E−02 | 7 | 18 |
| LGP86 | 0.71 | 4.95E−02 | 7 | 4 | LGP86 | 0.77 | 2.41E−02 | 7 | 14 |
| LGP86 | 0.75 | 3.29E−02 | 7 | 20 | LGP86 | 0.79 | 2.01E−02 | 7 | 15 |
| LGP86 | 0.79 | 1.87E−02 | 7 | 2 | LGP86 | 0.77 | 2.41E−02 | 7 | 21 |
| LGP86 | 0.80 | 1.63E−02 | 7 | 16 | LGP86 | 0.78 | 2.33E−02 | 2 | 17 |
| LGP86 | 0.85 | 7.01E−03 | 2 | 5 | LGP86 | 0.74 | 3.54E−02 | 2 | 6 |
| LGP86 | 0.78 | 2.33E−02 | 2 | 12 | LGP86 | 0.71 | 4.72E−02 | 2 | 2 |
| LGP86 | 0.72 | 6.85E−02 | 4 | 10 | LGP86 | 0.76 | 4.72E−02 | 4 | 3 |
| LGP87 | 0.83 | 4.32E−02 | 1 | 19 | LGP87 | 0.78 | 3.89E−02 | 1 | 1 |
| LGP87 | 0.85 | 3.24E−02 | 6 | 10 | LGP87 | 0.86 | 2.86E−02 | 6 | 4 |
| LGP87 | 0.78 | 6.45E−02 | 6 | 3 | LGP87 | 0.76 | 7.79E−02 | 6 | 6 |
| LGP87 | 0.73 | 1.56E−02 | 3 | 18 | LGP87 | 0.77 | 8.80E−03 | 3 | 10 |
| LGP87 | 0.75 | 1.18E−02 | 3 | 17 | LGP87 | 0.73 | 1.56E−02 | 3 | 9 |
| LGP87 | 0.91 | 2.63E−04 | 3 | 3 | LGP87 | 0.73 | 1.56E−02 | 3 | 14 |
| LGP87 | 0.76 | 1.04E−02 | 3 | 15 | LGP87 | 0.75 | 1.18E−02 | 3 | 12 |
| LGP87 | 0.73 | 1.56E−02 | 3 | 21 | LGP87 | 0.71 | 2.13E−02 | 3 | 16 |
| LGP87 | 0.70 | 7.70E−02 | 7 | 13 | LGP87 | 0.78 | 2.26E−02 | 7 | 18 |
| LGP87 | 0.73 | 3.81E−02 | 7 | 17 | LGP87 | 0.84 | 8.72E−03 | 7 | 9 |
| LGP87 | 0.73 | 4.07E−02 | 7 | 3 | LGP87 | 0.91 | 1.45E−03 | 7 | 8 |
| LGP87 | 0.90 | 2.56E−03 | 7 | 7 | LGP87 | 0.78 | 2.26E−02 | 7 | 14 |
| LGP87 | 0.76 | 2.84E−02 | 7 | 20 | LGP87 | 0.71 | 5.07E−02 | 7 | 15 |
| LGP87 | 0.73 | 3.81E−02 | 7 | 12 | LGP87 | 0.78 | 2.26E−02 | 7 | 21 |

TABLE 119-continued

Correlation between the expression level of selected genes of some embodiments of the invention in various tissues and the phenotypic performance under low nitrogen conditions across maize accession

| Gene Name | R | P value | Exp. set | Corr. Set ID | Gene Name | R | P value | Exp. set | Corr. Set ID |
|---|---|---|---|---|---|---|---|---|---|
| LGP87 | 0.73 | 3.78E−02 | 7 | 16 | LGP87 | 0.80 | 3.02E−02 | 4 | 8 |
| LGP88 | 0.70 | 7.94E−02 | 1 | 8 | LGP88 | 0.77 | 7.19E−02 | 1 | 19 |
| LGP88 | 0.76 | 2.86E−02 | 5 | 19 | LGP88 | 0.71 | 1.14E−01 | 6 | 8 |
| LGP88 | 0.71 | 1.17E−01 | 6 | 1 | LGP88 | 0.81 | 2.79E−02 | 2 | 13 |
| LGP88 | 0.72 | 4.38E−02 | 2 | 11 | LGP88 | 0.74 | 5.49E−02 | 4 | 18 |
| LGP88 | 0.74 | 5.49E−02 | 4 | 14 | LGP88 | 0.78 | 3.69E−02 | 4 | 6 |
| LGP88 | 0.80 | 2.95E−02 | 4 | 15 | LGP88 | 0.81 | 2.85E−02 | 4 | 19 |
| LGP88 | 0.78 | 3.86E−02 | 4 | 2 | LGP88 | 0.92 | 3.79E−03 | 4 | 1 |
| LGP88 | 0.74 | 5.49E−02 | 4 | 21 | LGP88 | 0.74 | 5.50E−02 | 4 | 16 |
| LGP89 | 0.99 | 3.02E−04 | 6 | 18 | LGP89 | 0.76 | 7.65E−02 | 6 | 10 |
| LGP89 | 0.83 | 4.13E−02 | 6 | 4 | LGP89 | 0.75 | 8.65E−02 | 6 | 3 |
| LGP89 | 0.99 | 3.02E−04 | 6 | 14 | LGP89 | 0.80 | 5.55E−02 | 6 | 20 |
| LGP89 | 0.96 | 2.89E−03 | 6 | 15 | LGP89 | 0.86 | 2.90E−02 | 6 | 19 |
| LGP89 | 0.80 | 5.50E−02 | 6 | 2 | LGP89 | 0.99 | 3.02E−04 | 6 | 21 |
| LGP89 | 0.96 | 2.69E−03 | 6 | 16 | LGP89 | 0.84 | 9.63E−03 | 2 | 2 |
| LGP89 | 0.77 | 4.23E−02 | 4 | 9 | LGP89 | 0.91 | 4.56E−03 | 4 | 8 |
| LGP90 | 0.76 | 4.92E−02 | 1 | 5 | LGP90 | 0.73 | 6.36E−02 | 1 | 6 |
| LGP90 | 0.73 | 9.83E−02 | 6 | 5 | LGP90 | 0.80 | 5.80E−02 | 6 | 6 |
| LGP90 | 0.71 | 7.56E−02 | 8 | 19 | LGP90 | 0.77 | 2.56E−02 | 2 | 17 |
| LGP90 | 0.72 | 4.41E−02 | 2 | 5 | LGP90 | 0.77 | 2.56E−02 | 2 | 12 |
| LGP90 | 0.80 | 3.10E−02 | 4 | 9 | LGP91 | 0.83 | 3.87E−02 | 6 | 18 |
| LGP91 | 0.83 | 3.87E−02 | 6 | 14 | LGP91 | 0.78 | 6.64E−02 | 6 | 20 |
| LGP91 | 0.75 | 8.53E−02 | 6 | 15 | LGP91 | 0.77 | 7.25E−02 | 6 | 19 |
| LGP91 | 0.76 | 7.95E−02 | 6 | 2 | LGP91 | 0.74 | 9.26E−02 | 6 | 1 |
| LGP91 | 0.83 | 3.87E−02 | 6 | 21 | LGP91 | 0.80 | 5.45E−02 | 6 | 16 |
| LGP91 | 0.85 | 7.35E−03 | 8 | 8 | LGP91 | 0.88 | 8.62E−03 | 7 | 13 |
| LGP91 | 0.97 | 8.43E−05 | 7 | 11 | LGP92 | 0.93 | 7.17E−03 | 1 | 13 |
| LGP92 | 0.70 | 7.72E−02 | 1 | 9 | LGP92 | 0.71 | 7.41E−02 | 1 | 8 |
| LGP92 | 0.86 | 1.34E−02 | 1 | 11 | LGP92 | 0.70 | 7.78E−02 | 1 | 1 |
| LGP92 | 0.71 | 4.87E−02 | 5 | 19 | LGP92 | 0.79 | 6.19E−02 | 6 | 5 |
| LGP92 | 0.88 | 1.99E−02 | 6 | 6 | LGP92 | 0.73 | 1.72E−02 | 3 | 1 |
| LGP92 | 0.82 | 1.28E−02 | 8 | 7 | LGP92 | 0.90 | 6.33E−03 | 7 | 13 |
| LGP92 | 0.84 | 9.32E−03 | 7 | 11 | LGP92 | 0.94 | 1.41E−03 | 2 | 13 |
| LGP92 | 0.77 | 4.34E−02 | 4 | 8 | LGP94 | 0.81 | 1.57E−02 | 5 | 13 |
| LGP94 | 0.93 | 6.59E−03 | 6 | 13 | LGP94 | 0.85 | 3.09E−02 | 6 | 11 |
| LGP94 | 0.72 | 2.81E−02 | 3 | 13 | LGP94 | 0.94 | 1.68E−03 | 8 | 13 |
| LGP94 | 0.82 | 1.36E−02 | 8 | 11 | LGP94 | 0.89 | 7.44E−03 | 7 | 13 |
| LGP94 | 0.86 | 5.67E−03 | 7 | 11 | LGP94 | 0.80 | 3.08E−02 | 2 | 13 |
| LGP94 | 0.78 | 2.15E−02 | 2 | 17 | LGP94 | 0.71 | 5.03E−02 | 2 | 5 |
| LGP94 | 0.79 | 1.94E−02 | 2 | 11 | LGP94 | 0.78 | 2.15E−02 | 2 | 12 |
| LGP94 | 0.84 | 1.91E−02 | 4 | 13 | LGP94 | 0.94 | 1.38E−03 | 4 | 11 |
| LGP95 | 0.92 | 3.68E−03 | 1 | 10 | LGP95 | 0.78 | 3.89E−02 | 1 | 9 |
| LGP95 | 0.72 | 6.80E−02 | 1 | 7 | LGP95 | 0.79 | 5.94E−02 | 6 | 13 |
| LGP95 | 0.78 | 8.28E−03 | 3 | 18 | LGP95 | 0.82 | 3.49E−03 | 3 | 17 |
| LGP95 | 0.82 | 3.51E−03 | 3 | 9 | LGP95 | 0.73 | 1.65E−02 | 3 | 3 |
| LGP95 | 0.78 | 8.28E−03 | 3 | 14 | LGP95 | 0.75 | 1.19E−02 | 3 | 20 |
| LGP95 | 0.75 | 1.27E−02 | 3 | 15 | LGP95 | 0.82 | 3.49E−03 | 3 | 12 |
| LGP95 | 0.78 | 8.28E−03 | 3 | 21 | LGP95 | 0.74 | 1.44E−02 | 3 | 16 |
| LGP95 | 0.75 | 3.27E−02 | 8 | 20 | LGP95 | 0.79 | 3.44E−02 | 2 | 13 |

Table 119. Correlations (R) between the genes expression levels in various tissues and the phenotypic performance under low nitrogen conditions.
"Corr. ID "—correlation set ID according to the correlated parameters Table above.
"Exp. Set"—Expression set.
"R" = Pearson correlation coefficient;
"P" = p value.

TABLE 120

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LGP25 | 0.80 | 5.67E−02 | 5 | 5 | LGP27 | 0.75 | 3.10E−02 | 2 | 4 |
| LGP27 | 0.71 | 7.37E−02 | 4 | 10 | LGP27 | 0.84 | 1.71E−02 | 6 | 5 |
| LGP27 | 0.73 | 6.35E−02 | 6 | 6 | LGP27 | 0.75 | 5.26E−02 | 6 | 8 |
| LGP72 | 0.76 | 7.91E−02 | 5 | 4 | LGP72 | 0.83 | 1.00E−02 | 2 | 4 |
| LGP72 | 0.70 | 5.29E−02 | 2 | 6 | LGP72 | 0.77 | 4.49E−02 | 4 | 8 |
| LGP72 | 0.75 | 3.13E−02 | 3 | 17 | LGP72 | 0.70 | 5.10E−02 | 3 | 4 |

TABLE 120-continued

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LGP72 | 0.73 | 3.78E−02 | 3 | 10 | LGP72 | 0.75 | 3.13E−02 | 3 | 1 |
| LGP72 | 0.73 | 6.48E−02 | 6 | 5 | LGP72 | 0.73 | 6.38E−02 | 6 | 4 |
| LGP72 | 0.77 | 4.15E−02 | 6 | 8 | LGP72 | 0.84 | 5.00E−03 | 7 | 17 |
| LGP72 | 0.84 | 5.00E−03 | 7 | 1 | LGP73 | 0.91 | 1.10E−02 | 5 | 5 |
| LGP73 | 0.72 | 6.81E−02 | 6 | 9 | LGP74 | 0.79 | 5.98E−02 | 1 | 13 |
| LGP74 | 0.74 | 3.76E−02 | 7 | 13 | LGP75 | 0.91 | 4.31E−03 | 1 | 7 |
| LGP75 | 0.90 | 5.66E−03 | 1 | 12 | LGP75 | 0.80 | 2.98E−02 | 1 | 11 |
| LGP75 | 0.86 | 1.29E−02 | 1 | 5 | LGP75 | 0.92 | 3.14E−03 | 1 | 15 |
| LGP75 | 0.91 | 3.97E−03 | 1 | 14 | LGP75 | 0.83 | 2.13E−02 | 1 | 4 |
| LGP75 | 0.90 | 5.76E−03 | 1 | 16 | LGP75 | 0.87 | 1.11E−02 | 1 | 6 |
| LGP75 | 0.91 | 3.97E−03 | 1 | 18 | LGP75 | 0.72 | 7.03E−02 | 1 | 8 |
| LGP75 | 0.91 | 3.97E−03 | 1 | 21 | LGP75 | 0.75 | 5.11E−02 | 1 | 9 |
| LGP75 | 0.94 | 1.89E−03 | 1 | 20 | LGP75 | 0.87 | 2.37E−02 | 5 | 12 |
| LGP75 | 0.74 | 9.57E−02 | 5 | 17 | LGP75 | 0.81 | 4.83E−02 | 5 | 11 |
| LGP75 | 0.84 | 3.46E−02 | 5 | 15 | LGP75 | 0.90 | 1.41E−02 | 5 | 14 |
| LGP75 | 0.79 | 6.06E−02 | 5 | 4 | LGP75 | 0.76 | 7.65E−02 | 5 | 16 |
| LGP75 | 0.90 | 1.41E−02 | 5 | 18 | LGP75 | 0.95 | 3.57E−03 | 5 | 8 |
| LGP75 | 0.90 | 1.41E−02 | 5 | 21 | LGP75 | 0.74 | 9.57E−02 | 5 | 1 |
| LGP75 | 0.97 | 1.57E−03 | 5 | 19 | LGP75 | 0.85 | 3.29E−02 | 5 | 20 |
| LGP75 | 0.94 | 4.77E−03 | 5 | 2 | LGP75 | 0.74 | 1.36E−02 | 8 | 12 |
| LGP75 | 0.76 | 1.09E−02 | 8 | 15 | LGP75 | 0.76 | 1.11E−02 | 8 | 14 |
| LGP75 | 0.76 | 1.01E−02 | 8 | 16 | LGP75 | 0.76 | 1.11E−02 | 8 | 18 |
| LGP75 | 0.76 | 1.11E−02 | 8 | 21 | LGP75 | 0.74 | 1.54E−02 | 8 | 20 |
| LGP75 | 0.93 | 9.88E−04 | 3 | 3 | LGP75 | 0.74 | 3.62E−02 | 3 | 20 |
| LGP75 | 0.71 | 3.09E−02 | 7 | 7 | LGP75 | 0.73 | 2.52E−02 | 7 | 12 |
| LGP75 | 0.79 | 1.06E−02 | 7 | 15 | LGP75 | 0.78 | 1.38E−02 | 7 | 14 |
| LGP75 | 0.75 | 1.93E−02 | 7 | 16 | LGP75 | 0.78 | 1.38E−02 | 7 | 18 |
| LGP75 | 0.78 | 1.38E−02 | 7 | 21 | LGP75 | 0.79 | 1.05E−02 | 7 | 20 |
| LGP80 | 0.97 | 1.07E−03 | 5 | 5 | LGP82 | 0.73 | 2.65E−02 | 7 | 7 |
| LGP82 | 0.83 | 5.88E−03 | 7 | 6 | LGP86 | 0.79 | 3.59E−02 | 1 | 7 |
| LGP86 | 0.94 | 1.60E−03 | 1 | 5 | LGP86 | 0.70 | 7.81E−02 | 1 | 15 |
| LGP86 | 0.71 | 7.61E−02 | 1 | 14 | LGP86 | 0.74 | 5.79E−02 | 1 | 16 |
| LGP86 | 0.74 | 5.72E−02 | 1 | 6 | LGP86 | 0.71 | 7.61E−02 | 1 | 18 |
| LGP86 | 0.70 | 7.88E−02 | 1 | 8 | LGP86 | 0.71 | 7.61E−02 | 1 | 21 |
| LGP86 | 0.72 | 6.62E−02 | 1 | 20 | LGP86 | 0.73 | 9.84E−02 | 5 | 4 |
| LGP86 | 0.80 | 3.03E−02 | 4 | 7 | LGP86 | 0.91 | 4.35E−03 | 4 | 12 |
| LGP86 | 0.84 | 1.73E−02 | 4 | 11 | LGP86 | 0.92 | 3.24E−03 | 4 | 15 |
| LGP86 | 0.90 | 5.84E−03 | 4 | 14 | LGP86 | 0.71 | 7.44E−02 | 4 | 4 |
| LGP86 | 0.91 | 4.82E−03 | 4 | 16 | LGP86 | 0.78 | 3.86E−02 | 4 | 3 |
| LGP86 | 0.87 | 1.19E−02 | 4 | 6 | LGP86 | 0.90 | 5.84E−03 | 4 | 18 |
| LGP86 | 0.73 | 6.27E−02 | 4 | 8 | LGP86 | 0.90 | 5.84E−03 | 4 | 21 |
| LGP86 | 0.78 | 6.87E−02 | 4 | 19 | LGP86 | 0.89 | 6.97E−03 | 4 | 20 |
| LGP86 | 0.70 | 7.88E−02 | 6 | 7 | LGP86 | 0.76 | 4.55E−02 | 6 | 12 |
| LGP86 | 0.71 | 7.23E−02 | 6 | 11 | LGP86 | 0.79 | 3.57E−02 | 6 | 15 |
| LGP86 | 0.76 | 4.62E−02 | 6 | 14 | LGP86 | 0.78 | 3.74E−02 | 6 | 16 |
| LGP86 | 0.82 | 2.54E−02 | 6 | 6 | LGP86 | 0.76 | 4.62E−02 | 6 | 18 |
| LGP86 | 0.82 | 2.35E−02 | 6 | 8 | LGP86 | 0.76 | 4.62E−02 | 6 | 21 |
| LGP86 | 0.77 | 4.40E−02 | 6 | 20 | LGP86 | 0.75 | 1.95E−02 | 7 | 12 |
| LGP86 | 0.71 | 3.22E−02 | 7 | 11 | LGP86 | 0.78 | 1.25E−02 | 7 | 15 |
| LGP86 | 0.73 | 2.61E−02 | 7 | 14 | LGP86 | 0.84 | 4.57E−03 | 7 | 16 |
| LGP86 | 0.79 | 1.17E−02 | 7 | 6 | LGP86 | 0.73 | 2.61E−02 | 7 | 18 |
| LGP86 | 0.73 | 2.61E−02 | 7 | 21 | LGP87 | 0.71 | 1.14E−01 | 5 | 5 |
| LGP87 | 0.81 | 1.59E−02 | 2 | 10 | LGP87 | 0.78 | 6.88E−02 | 6 | 13 |
| LGP87 | 0.75 | 2.06E−02 | 7 | 4 | LGP87 | 0.71 | 3.25E−02 | 7 | 8 |
| LGP88 | 0.86 | 2.67E−02 | 1 | 13 | LGP88 | 0.70 | 1.18E−01 | 5 | 17 |
| LGP88 | 0.70 | 1.18E−01 | 5 | 1 | LGP88 | 0.73 | 2.50E−02 | 8 | 13 |
| LGP89 | 0.87 | 2.60E−02 | 5 | 5 | LGP89 | 0.90 | 2.15E−03 | 2 | 17 |
| LGP89 | 0.90 | 2.15E−03 | 2 | 1 | LGP89 | 0.70 | 7.69E−02 | 6 | 3 |
| LGP89 | 0.86 | 1.26E−02 | 6 | 8 | LGP89 | 0.70 | 5.16E−02 | 7 | 13 |
| LGP90 | 0.85 | 1.51E−02 | 1 | 7 | LGP90 | 0.81 | 2.75E−02 | 1 | 12 |
| LGP90 | 0.83 | 2.19E−02 | 1 | 15 | LGP90 | 0.78 | 3.87E−02 | 1 | 14 |
| LGP90 | 0.82 | 2.42E−02 | 1 | 16 | LGP90 | 0.94 | 1.58E−03 | 1 | 6 |
| LGP90 | 0.78 | 3.87E−02 | 1 | 18 | LGP90 | 0.78 | 3.87E−02 | 1 | 21 |
| LGP90 | 0.82 | 2.33E−02 | 1 | 20 | LGP90 | 0.86 | 2.90E−02 | 5 | 8 |
| LGP90 | 0.75 | 3.15E−02 | 2 | 5 | LGP91 | 0.81 | 2.82E−02 | 1 | 3 |
| LGP91 | 0.70 | 1.18E−01 | 5 | 3 | LGP91 | 0.72 | 1.83E−02 | 8 | 5 |
| LGP91 | 0.76 | 1.02E−02 | 8 | 9 | LGP91 | 0.72 | 6.95E−02 | 4 | 7 |
| LGP91 | 0.75 | 5.46E−02 | 4 | 12 | LGP91 | 0.78 | 3.80E−02 | 4 | 15 |
| LGP91 | 0.73 | 6.09E−02 | 4 | 14 | LGP91 | 0.74 | 5.74E−02 | 4 | 16 |
| LGP91 | 0.84 | 1.79E−02 | 4 | 6 | LGP91 | 0.73 | 6.09E−02 | 4 | 18 |
| LGP91 | 0.73 | 6.09E−02 | 4 | 21 | LGP91 | 0.77 | 4.41E−02 | 4 | 20 |
| LGP91 | 0.73 | 3.85E−02 | 3 | 2 | LGP92 | 0.74 | 5.88E−02 | 1 | 7 |
| LGP92 | 0.72 | 6.69E−02 | 1 | 5 | LGP92 | 0.71 | 7.48E−02 | 1 | 10 |

TABLE 120-continued

Correlation between the expression level of selected genes of some embodiments of the invention in various tissues and the phenotypic performance under normal conditions across maize accessions

| Gene Name | R | P value | Exp. set | Corr. Set ID | Gene Name | R | P value | Exp. set | Corr. Set ID |
|---|---|---|---|---|---|---|---|---|---|
| LGP92 | 0.77 | 7.18E−02 | 5 | 8 | LGP92 | 0.85 | 3.36E−02 | 6 | 13 |
| LGP92 | 0.82 | 6.75E−03 | 7 | 4 | LGP94 | 0.84 | 3.69E−02 | 5 | 10 |
| LGP94 | 0.70 | 7.89E−02 | 4 | 12 | LGP94 | 0.72 | 6.91E−02 | 4 | 15 |
| LGP94 | 0.78 | 3.68E−02 | 4 | 6 | LGP94 | 0.80 | 3.25E−02 | 6 | 7 |
| LGP94 | 0.86 | 1.41E−02 | 6 | 5 | LGP95 | 0.87 | 2.32E−02 | 5 | 5 |
| LGP95 | 0.74 | 3.72E−02 | 2 | 17 | LGP95 | 0.74 | 3.72E−02 | 2 | 1 |
| LGP95 | 0.71 | 2.24E−02 | 8 | 12 | LGP95 | 0.76 | 2.78E−02 | 3 | 5 |

Table 120. Correlations (R) between the genes expression levels in various tissues and the phenotypic performance under low nitrogen conditions.
"Corr. ID "—correlation set ID according to the correlated parameters Table above.
"Exp. Set"—Expression set.
"R" = Pearson correlation coefficient;
"P" = p value.

Example 15

Production of *Brachypodium* Transcriptome and High Throughput Correlation Analysis Using 60K *Brachypodium* Oligonucleotide Micro-Array In order to produce a high throughput correlation analysis comparing between plant phenotype and gene expression level, the present inventors utilized a *brachypodium* oligonucleotide micro-array, produced by Agilent Technologies [chem. (dot) agilent (dot) com/Scripts/PDS (dot) asp?1Page=50879]. The array oligonucleotide represents about 60K *brachypodium* genes and transcripts. In order to define correlations between the levels of RNA expression and yield or vigor related parameters, various plant characteristics of 24 different *brachypodium* accessions were analyzed. Among them, 22 accessions encompassing the observed variance were selected for RNA expression analysis and comparative genomic hybridization (CGH) analysis.

The correlation between the RNA levels and the characterized parameters was analyzed using Pearson correlation test [davidmlane (dot) com/hyperstat/A34739 (dot) html].

Additional correlation analysis was done by comparing plant phenotype and gene copy number. The correlation between the normalized copy number hybridization signal and the characterized parameters was analyzed using Pearson correlation test [davidmlane (dot) com/hyperstat/A34739 (dot) html].

Experimental Procedures

Analyzed *Brachypodium* tissues—two tissues [leaf and spike] were sampled and RNA was extracted as described above. Each micro-array expression information tissue type has received a Set ID as summarized in Table 121 below.

TABLE 121

*Brachypodium* transcriptome expression sets

| Expression Set | Set ID |
|---|---|
| Leaf at flowering stage under normal growth conditions | 1 |
| Spike at flowering stage under normal growth conditions | 2 |
| Leaf at flowering stage under normal growth conditions | 3 |

Table 121. From set ID No. 3 the sample was used to extract DNA; from set ID Nos. 1 and 2 the samples were used to extract RNA.

*Brachypodium* Yield Components and Vigor Related Parameters Assessment—

24 *brachypodium* accessions were grown in 4-6 repetitive plots (8 plants per plot) in a green house. The growing protocol was as follows: *brachypodium* seeds were sown in plots and grown under normal condition (6 mM of Nitrogen as ammonium nitrate) or reduced N level (low N, 35% of normal nitrogen fertilization). Plants were continuously phenotyped during the growth period and at harvest (Table 123-124, below). The image analysis system include d a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

At the end of the growing period the grains were separated from the spikes and the following parameters were measured using digital imaging system and collected:

Number of tillering—all tillers were counted per plant at harvest (mean per plot).

Head number—At the end of the experiment, heads were harvested from each plot and were counted.

Total Grains weight per plot (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Highest number of spikelets—The highest spikelet number per head was calculated per plant (mean per plot).

Mean number of spikelets—The mean spikelet number per head was calculated per plot.

Plant height—Each of the plants was measured for its height using measuring tape. Height was measured from ground level to spike base of the longest spike at harvest.

Vegetative dry weight and spike yield—At the end of the experiment (50% of the spikes were dry) all spikes and vegetative material from plots were collected. The biomass and spikes weight of each plot was separated, measured and divided by the number of plants/plots.

Dry weight—total weight of the vegetative portion above ground (excluding roots) after drying at 70° C. in oven for 48 hours;

Spike yield per plant=total spike weight per plant (gr) after drying at 30° C. in oven for 48 hours. Spikelets weight (gr.)—The biomass and spikes weight of each plot was separated and measured per plot.

Average head weight—calculated by dividing spikelets weight with head number (gr.).

Harvest Index—The harvest index was calculated using Formula XV (described above).

Spikelets Index—The Spikelets index is calculated using Formula XXXI above.

Percent Number of heads with spikelets—The number of heads with more than one spikelet per plant were counted and the percent from all heads per plant was calculated.

Total dry mater per plot—Calculated as Vegetative portion above ground plus all the spikelet dry weight per plot.

1000 grain weight—At the end of the experiment all grains from all plots were collected and weighted and the weight of 1000 grains was calculated.

The following parameters were collected using digital imaging system: At the end of the growing period the grains were separated from the spikes and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length, perimeter and width (cm)—A sample of ~200 grains was weighted, photographed and images were processed using the below described image processing system. The sum of grain lengths and width (longest axis) was measured from those images and was divided by the number of grains.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 122

*Brachypodium* correlated parameters (vectors)

| Correlated parameter with | Correlation ID |
|---|---|
| % Number of heads with spikelets (%) | 1 |
| 1000 grain weight (gr.) | 2 |
| Average head weight (gr.) | 3 |
| Grain area ($cm^2$) | 5 |
| Grain length (cm) | 6 |
| Grain Perimeter (cm) | 4 |
| Grain width (cm) | 7 |
| Grains weight per plant (gr.) | 8 |
| Grains weight per plot (gr.) | 9 |
| Harvest index | 10 |
| Heads per plant | 11 |
| Heads per plot | 12 |
| Highest number of spikelets per plot | 13 |
| Mean number of spikelets per plot | 14 |
| Number of heads with spikelets per plant | 15 |
| Plant height (cm) | 17 |
| Plant Vegetative DW (gr.) | 16 |
| Plants number | 18 |
| Spikelets DW per plant (gr.) | 19 |
| Spikelets weight (gr.) | 20 |
| Spikes index | 21 |
| Tittering (number) | 22 |
| Total dry mater per plant (gr.) | 23 |
| Total dry mater per plot (gr.) | 24 |
| Vegetative DW (gr.) | 25 |

Table 122. Provided are the *Brachypodium* correlated parameters. Correlation IDs 1-21 are identical to correlation IDs 26-46, respectively, and correlation IDs 23-25 are identical to correlation IDs 47-49, respectively.

Experimental Results 24 different *Brachypodium* accessions were grown and characterized for different parameters as described above. The average for each of the measured parameter was calculated using the JMP software and values are summarized in Tables 123-125 below. Subsequent correlation analysis between the various transcriptome sets and the average parameters (Table 126) was conducted. Follow, results were integrated to the database.

TABLE 123

Measured parameters of correlation IDs in Brachypodium accessions under normal conditions

| Ecotype/Treatment | Line-1 | Line-2 | Line-3 | Line-4 | Line-5 | Line-6 | Line-7 | Line-8 |
|---|---|---|---|---|---|---|---|---|
| 1 | 27.61 | 35.33 | 21.67 | 52.40 | 20.84 | 47.73 | 17.55 | 16.51 |
| 2 | 3.75 | 3.78 | 3.35 | 3.70 | 3.90 | 4.87 | 4.82 | 4.76 |
| 3 | 0.06 | 0.04 | 0.05 | 0.09 | 0.04 | 0.09 | 0.06 | 0.06 |
| 4 | 1.67 | 1.62 | 1.62 | 1.65 | 1.60 | 1.90 | 1.80 | 1.82 |
| 5 | 0.10 | 0.10 | 0.09 | 0.09 | 0.09 | 0.11 | 0.10 | 0.11 |
| 6 | 0.73 | 0.72 | 0.72 | 0.75 | 0.72 | 0.87 | 0.79 | 0.79 |
| 7 | 0.18 | 0.17 | 0.17 | 0.15 | 0.15 | 0.16 | 0.17 | 0.18 |
| 8 | 0.14 | 0.06 | 0.08 | 0.35 | 0.27 | 0.44 | 0.32 | 0.07 |
| 9 | 1.05 | 0.44 | 0.61 | 2.58 | 2.03 | 3.40 | 2.58 | 0.39 |
| 10 | 0.13 | 0.14 | 0.15 | 0.21 | 0.17 | 0.18 | 0.15 | 0.11 |
| 11 | 16.29 | 7.08 | 6.59 | 16.11 | 21.40 | 17.05 | 25.88 | 8.02 |
| 12 | 121.75 | 56.60 | 52.75 | 123.50 | 156.83 | 135.00 | 207.00 | 48.60 |
| 13 | 3.00 | 2.60 | 3.00 | 2.83 | 2.33 | 4.50 | 2.60 | 2.00 |
| 14 | 2.10 | 2.10 | 1.72 | 2.17 | 1.85 | 2.85 | 1.93 | 1.56 |
| 15 | 5.27 | 2.50 | 2.06 | 9.44 | 5.02 | 7.72 | 4.90 | 1.87 |
| 16 | 0.42 | 0.12 | 0.13 | 0.82 | 0.67 | 1.05 | 0.87 | 0.31 |
| 17 | 31.65 | 23.44 | 22.75 | 45.35 | 29.41 | 46.74 | 38.39 | 29.15 |
| 18 | 7.50 | 8.00 | 8.00 | 7.50 | 7.33 | 7.88 | 8.00 | 6.40 |
| 19 | 0.96 | 0.31 | 0.33 | 1.46 | 0.96 | 1.42 | 1.56 | 0.45 |
| 20 | 7.18 | 2.50 | 2.68 | 11.31 | 7.16 | 11.05 | 12.44 | 2.66 |
| 21 | 0.71 | 0.72 | 0.73 | 0.68 | 0.60 | 0.57 | 0.65 | 0.60 |

TABLE 123-continued

Measured parameters of correlation IDs in Brachypodium accessions under normal conditions

| Ecotype/Treatment | Line-1 | Line-2 | Line-3 | Line-4 | Line-5 | Line-6 | Line-7 | Line-8 |
|---|---|---|---|---|---|---|---|---|
| 22 | 16.84 | 7.20 | 7.00 | 16.99 | 23.61 | 18.25 | 27.20 | 8.60 |
| 23 | 1.38 | 0.43 | 0.47 | 2.28 | 1.63 | 2.47 | 2.43 | 0.76 |
| 24 | 10.26 | 3.45 | 3.74 | 17.78 | 12.29 | 19.27 | 19.40 | 4.47 |
| 25 | 3.08 | 0.95 | 1.06 | 6.47 | 5.13 | 8.23 | 6.96 | 1.81 |

Table 123. Correlation IDs: 1, 2, 3, 4, 5, . . . etc. refer to those described in Table 122 above [Brachypodium correlated parameters (vectors)].

TABLE 124

Measured parameters of correlation IDs in brachypodium accessions under normal conditions

| Ecotype/Treatment | Line-9 | Line-10 | Line-11 | Line-12 | Line-13 | Line-14 | Line-15 |
|---|---|---|---|---|---|---|---|
| 1 | 5.42 | 15.42 | 14.00 | 6.40 | 4.51 | 15.52 | 20.34 |
| 2 | 5.54 | 4.98 | 4.88 | 4.83 | 5.54 | 4.73 | 5.24 |
| 3 | 0.04 | 0.06 | 0.07 | 0.05 | 0.04 | 0.05 | 0.05 |
| 4 | 1.82 | 1.83 | 1.69 | 1.74 | 1.93 | 1.69 | 1.91 |
| 5 | 0.11 | 0.11 | 0.09 | 0.10 | 0.11 | 0.10 | 0.12 |
| 6 | 0.83 | 0.82 | 0.74 | 0.78 | 0.90 | 0.75 | 0.86 |
| 7 | 0.16 | 0.17 | 0.16 | 0.17 | 0.16 | 0.17 | 0.19 |
| 8 | 0.14 | 0.14 | 0.26 | 0.14 | 0.11 | 0.39 | 0.14 |
| 9 | 1.11 | 1.07 | 1.96 | 1.09 | 0.84 | 3.07 | 1.09 |
| 10 | 0.20 | 0.16 | 0.20 | 0.14 | 0.26 | 0.22 | 0.09 |
| 11 | 10.48 | 9.09 | 11.63 | 14.13 | 5.88 | 23.75 | 16.06 |
| 12 | 82.40 | 70.13 | 83.40 | 110.33 | 47.00 | 185.50 | 125.00 |
| 13 | 2.00 | 2.25 | 2.20 | 1.83 | 2.00 | 2.50 | 2.40 |
| 14 | 1.38 | 1.65 | 1.69 | 1.43 | 1.25 | 1.76 | 1.83 |
| 15 | 0.71 | 1.94 | 2.08 | 1.08 | 0.35 | 4.98 | 3.70 |
| 16 | 0.32 | 0.32 | 0.38 | 0.39 | 0.13 | 0.87 | 0.69 |
| 17 | 34.36 | 28.65 | 31.95 | 28.88 | 24.74 | 37.30 | 45.09 |
| 18 | 7.80 | 7.75 | 7.20 | 7.83 | 8.00 | 7.75 | 8.00 |
| 19 | 0.44 | 0.56 | 0.88 | 0.67 | 0.26 | 1.14 | 0.83 |
| 20 | 3.45 | 4.29 | 6.42 | 5.29 | 2.04 | 8.89 | 6.65 |
| 21 | 0.58 | 0.66 | 0.71 | 0.64 | 0.66 | 0.59 | 0.54 |
| 22 | 10.67 | 9.38 | 11.97 | 14.58 | 6.35 | 25.50 | 16.56 |
| 23 | 0.76 | 0.88 | 1.25 | 1.06 | 0.38 | 2.01 | 1.53 |
| 24 | 6.00 | 6.78 | 9.12 | 8.34 | 3.04 | 15.79 | 12.20 |
| 25 | 2.55 | 2.48 | 2.69 | 3.05 | 1.00 | 6.89 | 5.55 |

Table 124. Correlation IDs: 1, 2, 3, 4, 5, . . . etc. refer to those described in Table 15.2 above [Brachypodium correlated parameters (vectors)].

TABLE 125

Measured parameters of correlation IDs in brachypodium accessions under normal conditions

| Ecotype/Treatment | Line-16 | Line-17 | Line-18 | Line-19 | Line-20 | Line-21 | Line-22 |
|---|---|---|---|---|---|---|---|
| 1 | 8.11 | 53.21 | 55.41 | 47.81 | 42.81 | 59.01 | 34.92 |
| 2 | 4.96 | 4.00 | 3.84 | 4.26 | 5.99 | 3.76 | 4.34 |
| 3 | 0.06 | 0.10 | 0.08 | 0.08 | 0.08 | 0.09 | 0.06 |
| 4 | 1.71 | 1.81 | 1.68 | 1.75 | 1.87 | 1.68 | 1.66 |
| 5 | 0.10 | 0.10 | 0.10 | 0.09 | 0.12 | 0.09 | 0.09 |
| 6 | 0.74 | 0.84 | 0.75 | 0.80 | 0.84 | 0.76 | 0.74 |
| 7 | 0.17 | 0.15 | 0.17 | 0.14 | 0.18 | 0.15 | 0.16 |
| 8 | 0.13 | 0.37 | 0.08 | 0.49 | 0.31 | 0.30 | 0.20 |
| 9 | 1.07 | 2.99 | 0.50 | 3.52 | 2.41 | 1.92 | 1.47 |
| 10 | 0.18 | 0.09 | 0.07 | 0.16 | 0.18 | 0.09 | 0.11 |
| 11 | 9.74 | 22.19 | 11.89 | 24.32 | 13.25 | 25.54 | 19.22 |
| 12 | 80.75 | 177.50 | 81.50 | 172.80 | 98.60 | 177.00 | 143.17 |
| 13 | 2.00 | 3.50 | 3.50 | 3.80 | 2.80 | 3.17 | 2.83 |
| 14 | 1.42 | 2.71 | 2.41 | 2.61 | 2.12 | 2.79 | 2.15 |
| 15 | 0.89 | 12.58 | 7.59 | 12.13 | 6.35 | 15.36 | 7.15 |
| 16 | 0.34 | 1.72 | 0.44 | 1.32 | 0.48 | 1.73 | 0.63 |
| 17 | 22.39 | 55.04 | 31.40 | 45.34 | 40.20 | 58.82 | 39.18 |
| 18 | 8.25 | 8.00 | 6.50 | 7.00 | 7.60 | 6.83 | 7.33 |
| 19 | 0.59 | 2.27 | 0.92 | 1.91 | 1.09 | 2.25 | 1.26 |
| 20 | 4.92 | 18.15 | 6.25 | 13.49 | 8.35 | 15.55 | 9.42 |
| 21 | 0.68 | 0.56 | 0.69 | 0.59 | 0.70 | 0.57 | 0.66 |

TABLE 125-continued

Measured parameters of correlation IDs in brachypodium accessions under normal conditions

| Ecotype/Treatment | Line-16 | Line-17 | Line-18 | Line-19 | Line-20 | Line-21 | Line-22 |
|---|---|---|---|---|---|---|---|
| 22 | 10.53 | 27.15 | 12.38 | 26.30 | 13.56 | 29.09 | 20.79 |
| 23 | 0.93 | 3.99 | 1.36 | 3.23 | 1.57 | 3.98 | 1.89 |
| 24 | 7.76 | 31.94 | 9.21 | 22.78 | 12.04 | 27.67 | 14.14 |
| 25 | 2.84 | 13.80 | 2.96 | 9.28 | 3.70 | 12.12 | 4.72 |

Table 125. Correlation IDs: 1, 2, 3, 4, 5, . . . etc. refer to those described in Table 122 above [Brachypodium correlated parameters (vectors)].

TABLE 126

Correlation between the expression level of selected genes of some embodiments of the invention in various tissues and the phenotypic performance under normal conditions across *brachypodium* varieties

| Gene Name | R | P value | Exp. set | Correl. Set ID |
|---|---|---|---|---|
| MGP6 | 0.72 | 8.12E−03 | 3 | 2 |

Table 126. Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal conditions across *brachypodium* varieties. P = p value.

Example 16

Production of Soybean (*Glycine Max*) Transcriptome and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [chem. (dot) agilent (dot) com/Scripts/PDS (dot) asp?1Page=50879]. The array oligonucleotide represents about 42,000 Soybean genes and transcripts. In order to define correlations between the levels of RNA expression with yield components or plant architecture related parameters or plant vigor related parameters, various plant characteristics of 29 different *Glycine max* varieties were analyzed and 26 varieties were further used for RNA expression analysis. The correlation between the RNA levels and the characterized parameters was analyzed using Pearson correlation test.

Correlation of *Glycine max* Genes' Expression Levels with Phenotypic Characteristics Across Ecotype Experimental Procedures 29 Soybean varieties were grown in three repetitive plots in field. Briefly, the growing protocol was as follows: Soybean seeds were sown in soil and grown under normal conditions (no irrigation, good organomic particles) which included high temperature about 82.38 (° F.), low temperature about 58.54 (° F.); total precipitation rainfall from May through September (from sowing until harvest) was about 16.97 inch.

In order to define correlations between the levels of RNA expression with yield components or plant architecture related parameters or vigor related parameters, 26 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

TABLE 127

| Soybean transcriptome expression sets | |
|---|---|
| Expression Set | Set ID |
| Apical meristem at vegetative stage under normal growth condition | 1 |
| Leaf at vegetative stage under normal growth condition | 2 |
| Leaf at flowering stage under normal growth condition | 3 |
| Leaf at pod setting stage under normal growth condition | 4 |
| Root at vegetative stage under normal growth condition | 5 |
| Root at flowering stage under normal growth condition | 6 |
| Root at pod setting stage under normal growth condition | 7 |
| Stem at vegetative stage under normal growth condition | 8 |
| Stem at pod setting stage under normal growth condition | 9 |
| Flower bud at flowering stage under normal growth condition | 10 |
| Pod (R3-R4) at pod setting stage under normal growth condition | 11 |

Table 127.

RNA extraction—All 12 selected Soybean varieties were sample per treatment. Plant tissues [leaf, root, Stem, Pod, apical meristem, Flower buds] growing under normal conditions were sampled and RNA was extracted as described above. The collected data parameters were as follows:

Main branch base diameter [mm] at pod set—the diameter of the base of the main branch (based diameter) average of three plants per plot.

Fresh weight [gr./plant] at pod set]—total weight of the vegetative portion above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr./plant]—weight of all lateral branches at pod set, average of three plants per plot.

Total weight of pods on main stem at pod set [gr./plant]—weight of all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count of the number of pods containing 1 seed in all lateral branches at pod set, average of three plants per plot.

Total number of pods with 2 seeds on lateral branches at pod set [value/plant]—count of the number of pods containing 2 seeds in all lateral branches at pod set, average of three plants per plot.

Total number of pods with 3 seeds on lateral branches at pod set [value/plant]—count of the number of pods containing 3 seeds in all lateral branches at pod set, average of three plants per plot.

Total number of pods with 4 seeds on lateral branches at pod set [value/plant]—count of the number of pods containing 4 seeds in all lateral branches at pod set, average of three plants per plot.

Total number of pods with 1 seed on main stem at pod set [value/plant]—count of the number of pods containing 1 seed in main stem at pod set, average of three plants per plot.

Total number of pods with 2 seeds on main stem at pod set [value/plant]—count of the number of pods containing 2 seeds in main stem at pod set, average of three plants per plot.

Total number of pods with 3 seeds on main stem at pod set [value/plant]—count of the number of pods containing 3 seeds in main stem at pod set, average of three plants per plot.

Total number of pods with 4 seeds on main stem at pod set [value/plant]—count of the number of pods containing 4 seeds in main stem at pod set, average of three plants per plot.

Total number of seeds per plant at pod set [value/plant]—count of number of seeds in lateral branches and main stem at pod set, average of three plants per plot.

Total number of seeds on lateral branches at pod set [value/plant]—count of total number of seeds on lateral branches at pod set, average of three plants per plot.

Total number of seeds on main stem at pod set [value/plant]—count of total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—calculated in Formula XXIII (above), average of three plants per plot.

Ratio of total number of seeds in main stem to number of seeds on lateral branches—calculated in Formula XXIV above, average of three plants per plot.

Total weight of pods per plant at pod set [gr./plant]—weight of all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, ars-grin (dot) gov/cgi-bin/npgs/html/desclist (dot) pl?51].

Seed quality [ranked 1-5]—measure at harvest; a visual estimate based on several hundred seeds. Parameter is rated according to the following scores considering the amount and degree of wrinkling, defective coat (cracks), greenish-ness, and moldy or other pigment. Rating is "1"—very good, "2"—good, "3"—fair, "4"—poor, "5"—very poor.

Lodging [ranked 1-5]—is rated at maturity per plot according to the following scores: "1"—most plants in a plot are erected; "2"—all plants leaning slightly or a few plants down; "3"—all plants leaning moderately, or 25%-50% down; "4"—all plants leaning considerably, or 50%-80% down; "5"—most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Average lateral branch seeds per pod [number]—Calculate number of seeds on lateral branches-at pod set and divide by the number of pods with seeds on lateral branches-at pod set.

Average main stem seeds per pod [number]—Calculate total number of seeds on main stem at pod set and divide by the number of pods with seeds on main stem at pod setting.

Main stem average internode length [cm]—Calculate plant height at pod set and divide by the total number of nodes on main stem at pod setting.

Total number of pods with seeds on main stem [number]—count all pods containing seeds on the main stem at pod setting.

Total number of pods with seeds on lateral branches [number]—count all pods containing seeds on the lateral branches at pod setting.

Total number of pods per plant at pod set [number]—count pods on main stem and lateral branches at pod setting.

TABLE 128

Soybean correlated parameters (vectors)

| Correlated parameter with | Correlation ID |
|---|---|
| 100 percent flowering (days) | 1 |
| 50 percent flowering (days) | 2 |
| Base diameter at pod set (mm) | 3 |
| DW at pod set (gr) | 4 |
| Lodging (score 1-5) | 5 |
| Maturity (days) | 6 |
| Num of lateral branches (number) | 7 |
| Num of pods with 1 seed on main stem at pod set (number) | 8 |
| Num of pods with 2 seed on main stem at pod set (number) | 9 |
| Num of pods with 3 seed on main stem at pod set (number) | 10 |
| Num of pods with 4 seed on main stem at pod set (number) | 11 |
| Plant height at harvest (cm) | 12 |
| Plant height at pod set (cm) | 13 |
| Ratio number of pods per node on main stem (ratio) | 14 |
| Ratio num of seeds-main stem to lateral branches (ratio) | 15 |
| Seed quality (score 1-5) | 16 |
| 1000 seed weight (gr) | 17 |
| Num of Seeds on lateral branches-at pod set | 18 |
| Total Number of Seeds on main stem at pod set (number) | 19 |
| Num of pods with 1 seed on lateral branch-pod set (number) | 20 |
| Num of pods with 2 seed on lateral branch-pod set (number) | 21 |

TABLE 128-continued

Soybean correlated parameters (vectors)

| Correlated parameter with | Correlation ID |
|---|---|
| Num pods with 3 seed on lateral branch-at pod set (number) | 22 |
| Num pods with 4 seed on lateral branch-at pod set (number) | 23 |
| Total number of nodes on main stem (number) | 24 |
| Num of nodes with pods on lateral branches-pod set (number) | 25 |
| Total number of seeds per plant (number) | 26 |
| Total weight of lateral branches at pod set (gr) | 27 |
| Weight of pods on lateral branches (gr)-at pod set | 28 |
| Total weight of pods on main stem at pod set (gt) | 29 |
| Total weight of pods per plant (gr/plant) | 30 |
| Total weight of seeds per plant (gr/plant) | 31 |
| fresh weight at pod set (gr) | 32 |
| yield at harvest (bushel/hectare) | 33 |
| Average lateral branch seeds per pod | 34 |
| Average main stem seeds per pod | 35 |
| Main stem average internode length | 36 |
| Num pods with seeds on lateral branches-at pod set (number) | 37 |
| Total number of pods per plant (number) | 38 |
| Total number of pods with seeds on main stem (number) | 39 |
| corrected Seed size (gr) | 40 |

Table 128.

Experimental Results 29 different Soybean varieties lines were grown and characterized for 40 parameters as specified above. Tissues for expression analysis were sampled from a subset of 12 lines. The correlated parameters are described in Table 128 above. The average for each of the measured parameter was calculated using the JMP software (Tables 129-134) and a subsequent correlation analysis was performed (Tables 135-136). Results were then integrated to the database.

TABLE 129

Measured parameters in Soybean varieties (lines 1-6)

| Ecotype/Treatment | Line-1 | Line-2 | Line-3 | Line-4 | Line-5 | Line-6 |
|---|---|---|---|---|---|---|
| 1 | 67.33 | 71.67 | 67.67 | 67.33 | 60.00 | 74.00 |
| 2 | 61.00 | 65.33 | 60.67 | 61.00 | 54.67 | 68.33 |
| 3 | 8.33 | 9.54 | 9.68 | 8.11 | 8.82 | 10.12 |
| 4 | 53.67 | 50.33 | 38.00 | 46.17 | 60.83 | 55.67 |
| 5 | 1.67 | 1.83 | 1.17 | 1.67 | 2.67 | 2.83 |
| 6 | 24.00 | 43.67 | 30.33 | 30.33 | 38.33 | 40.00 |
| 7 | 9.00 | 8.67 | 9.11 | 9.89 | 7.67 | 17.56 |
| 8 | 1.11 | 4.38 | 1.44 | 1.44 | 4.56 | 1.67 |
| 9 | 16.89 | 16.25 | 13.22 | 16.89 | 27.00 | 8.11 |
| 10 | 29.56 | 1.75 | 19.78 | 22.33 | 11.67 | 22.78 |
| 11 | 0.00 | 0.00 | 0.11 | 0.11 | 0.00 | 0.44 |
| 12 | 96.67 | 76.67 | 67.50 | 75.83 | 74.17 | 76.67 |
| 13 | 86.78 | 69.56 | 62.44 | 70.89 | 69.44 | 63.89 |
| 14 | 2.87 | 1.38 | 2.13 | 2.26 | 2.60 | 1.87 |
| 15 | 0.89 | 0.90 | 0.87 | 0.89 | 2.32 | 0.37 |
| 16 | 2.33 | 3.50 | 3.00 | 2.17 | 2.83 | 2.00 |
| 17 | 89.00 | 219.33 | 93.00 | 86.00 | 191.33 | 71.33 |
| 18 | 150.89 | 55.89 | 134.00 | 160.44 | 75.44 | 324.63 |
| 19 | 123.56 | 43.89 | 87.67 | 102.67 | 93.56 | 88.00 |
| 20 | 1.56 | 3.00 | 1.78 | 1.78 | 5.67 | 5.63 |
| 21 | 17.00 | 18.75 | 26.44 | 32.33 | 21.56 | 33.50 |
| 22 | 38.44 | 2.00 | 26.44 | 31.33 | 8.89 | 82.00 |
| 23 | 0.00 | 0.00 | 0.00 | 0.00 | 0.00 | 1.50 |
| 24 | 16.56 | 16.78 | 16.11 | 18.11 | 16.78 | 17.11 |
| 25 | 23.00 | 16.00 | 23.11 | 33.00 | 15.22 | 45.25 |
| 26 | 274.44 | 99.78 | 221.67 | 263.11 | 169.00 | 412.50 |
| 27 | 67.78 | 63.78 | 64.89 | 74.89 | 54.00 | 167.22 |
| 28 | 26.00 | 14.89 | 20.11 | 20.11 | 21.11 | 30.25 |
| 29 | 22.11 | 14.33 | 16.00 | 15.00 | 33.78 | 9.00 |
| 30 | 48.11 | 29.22 | 36.11 | 35.11 | 54.89 | 38.88 |
| 31 | 15.09 | 10.50 | 17.23 | 16.51 | 12.06 | 10.25 |
| 32 | 170.89 | 198.22 | 152.56 | 163.89 | 224.67 | 265.00 |

TABLE 129-continued

Measured parameters in Soybean varieties (lines 1-6)

| Ecotype/Treatment | Line-1 | Line-2 | Line-3 | Line-4 | Line-5 | Line-6 |
|---|---|---|---|---|---|---|
| 33 | 47.57 | 43.77 | 50.37 | 56.30 | 44.00 | 40.33 |
| 34 | 2.67 | 1.95 | 2.43 | 2.53 | 2.13 | 2.68 |
| 35 | 2.60 | 1.89 | 2.52 | 2.53 | 2.17 | 2.59 |
| 36 | 5.24 | 4.15 | 3.91 | 3.92 | 4.15 | 3.74 |
| 37 | 57.00 | 28.56 | 54.67 | 65.44 | 36.11 | 122.63 |
| 38 | 104.56 | 51.67 | 89.22 | 106.22 | 79.33 | 155.63 |
| 39 | 47.56 | 23.11 | 34.56 | 40.78 | 43.22 | 33.00 |
| 40 | 89.00 |  | 93.00 | 86.00 |  | 71.33 |

Table 129.

TABLE 130

Measured parameters in Soybean varieties (lines 7-12)

| Ecotype/Treatment | Line-7 | Line-8 | Line-9 | Line-10 | Line-11 | Line-12 |
|---|---|---|---|---|---|---|
| 1 | 73.00 | 72.33 | 68.67 | 73.67 | 68.00 | 70.67 |
| 2 | 66.50 | 65.67 | 62.33 | 67.67 | 61.67 | 64.33 |
| 3 | 8.46 | 8.09 | 8.26 | 7.73 | 8.16 | 7.89 |
| 4 | 48.00 | 52.00 | 44.17 | 52.67 | 56.00 | 47.50 |
| 5 | 2.67 | 2.50 | 1.83 | 3.50 | 3.33 | 1.50 |
| 6 | 41.00 | 38.33 | 31.00 | 39.00 | 27.33 | 32.67 |
| 7 | 11.67 | 12.11 | 8.00 | 9.11 | 6.78 | 10.00 |
| 8 | 4.00 | 4.33 | 2.11 | 1.89 | 3.44 | 1.22 |
| 9 | 21.33 | 17.67 | 20.33 | 16.11 | 28.11 | 16.56 |
| 10 | 11.11 | 28.22 | 24.11 | 36.44 | 39.67 | 32.33 |
| 11 | 0.00 | 0.56 | 0.00 | 3.89 | 0.00 | 0.00 |
| 12 | 101.67 | 98.33 | 75.83 | 116.67 | 76.67 | 71.67 |
| 13 | 89.78 | 82.11 | 70.56 | 101.67 | 79.56 | 67.22 |
| 14 | 1.98 | 2.71 | 2.78 | 2.75 | 3.70 | 2.84 |
| 15 | 3.90 | 0.78 | 1.18 | 1.98 | 1.03 | 0.83 |
| 16 | 3.50 | 2.50 | 2.17 | 2.33 | 2.17 | 2.17 |
| 17 | 88.00 | 75.00 | 80.67 | 75.67 | 76.33 | 77.33 |
| 18 | 46.88 | 176.22 | 143.00 | 105.44 | 184.33 | 187.33 |
| 19 | 80.00 | 126.56 | 115.11 | 159.00 | 178.67 | 131.33 |
| 20 | 2.88 | 3.00 | 1.25 | 2.67 | 1.78 | 3.00 |
| 21 | 8.50 | 22.78 | 21.75 | 10.67 | 23.78 | 25.67 |
| 22 | 9.00 | 42.11 | 32.75 | 25.67 | 45.00 | 44.33 |
| 23 | 0.00 | 0.33 | 0.00 | 1.11 | 0.00 | 0.00 |
| 24 | 18.78 | 18.89 | 16.78 | 21.11 | 19.33 | 20.78 |
| 25 | 8.25 | 25.44 | 21.88 | 16.33 | 22.56 | 24.22 |
| 26 | 136.00 | 302.78 | 260.50 | 264.44 | 363.00 | 318.67 |
| 27 | 45.44 | 83.22 | 64.33 | 52.00 | 76.89 | 67.00 |
| 28 | 4.13 | 20.11 | 17.00 | 9.22 | 28.11 | 22.56 |
| 29 | 9.03 | 16.00 | 15.89 | 14.56 | 30.44 | 18.00 |
| 30 | 14.25 | 36.11 | 32.75 | 23.78 | 58.56 | 40.56 |
| 31 | 7.30 | 11.38 | 15.68 | 10.83 | 12.98 | 15.16 |
| 32 | 160.67 | 196.33 | 155.33 | 178.11 | 204.44 | 164.22 |
| 33 | 34.23 | 44.27 | 53.67 | 42.47 | 43.60 | 52.20 |
| 34 | 2.12 | 2.58 | 2.58 | 2.67 | 2.62 | 2.58 |
| 35 | 2.22 | 2.49 | 2.47 | 2.71 | 2.51 | 2.61 |
| 36 | 4.80 | 4.36 | 4.20 | 4.82 | 4.12 | 3.83 |
| 37 | 20.38 | 68.22 | 55.75 | 40.11 | 70.56 | 73.00 |
| 38 | 61.00 | 119.00 | 103.25 | 98.44 | 141.78 | 123.11 |
| 39 | 36.44 | 50.78 | 43.63 | 58.33 | 71.22 | 50.11 |
| 40 | 88.00 | 75.00 | 80.67 | 75.67 | 76.33 | 77.33 |

Table 130.

TABLE 131

Measured parameters in Soybean varieties (lines 1-8)

| Ecotype/Treatment | Line-1 | Line-2 | Line-3 | Line-4 | Line-5 | Line-6 | Line-7 | Line-8 |
|---|---|---|---|---|---|---|---|---|
| 1 | 67.33 | 67.33 | 67.33 | 70.00 | 68.00 | 71.67 | 67.33 | 67.67 |
| 3 | 8.27 | 8.00 | 8.33 | 7.16 | 7.78 | 9.54 | 8.13 | 9.68 |
| 4 | 35.83 | 51.67 | 53.67 | 34.67 | 47.50 | 50.33 | 53.50 | 38.00 |
| 5 | 2.00 | 2.00 | 1.67 | 1.67 | 1.17 | 1.83 | 1.67 | 1.17 |
| 6 | 27.67 | 27.67 | 24.00 | 30.33 | 31.33 | 43.67 | 27.00 | 30.33 |
| 7 | 5.11 | 8.44 | 9.00 | 7.00 | 8.67 | 8.67 | 7.11 | 9.11 |
| 8 | 0.56 | 2.44 | 1.11 | 2.56 | 0.89 | 4.38 | 1.89 | 1.44 |
| 9 | 16.44 | 17.22 | 16.89 | 25.33 | 10.44 | 16.25 | 20.00 | 13.22 |
| 10 | 19.33 | 23.33 | 29.56 | 23.33 | 30.56 | 1.75 | 23.56 | 19.78 |
| 11 | 0.00 | 0.00 | 0.00 | 0.00 | 2.22 | 0.00 | 0.00 | 0.11 |
| 12 | 69.17 | 85.00 | 96.67 | 75.83 | 73.33 | 76.67 | 75.00 | 67.50 |
| 13 | 66.78 | 79.44 | 86.78 | 64.11 | 68.00 | 69.56 | 74.11 | 62.44 |
| 14 | 2.34 | 2.67 | 2.87 | 2.87 | 2.51 | 1.38 | 2.65 | 2.13 |
| 15 | 1.28 | 1.13 | 0.89 | 1.35 | 0.86 | 0.90 | 1.43 | 0.87 |
| 16 | 3.00 | 2.17 | 2.33 | 2.33 | 2.50 | 3.50 | 2.67 | 3.00 |
| 17 | 126.00 | 116.00 | 89.00 | 75.67 | 84.33 | 219.33 | 119.00 | 93.00 |
| 18 | 92.78 | 124.00 | 150.89 | 122.78 | 174.89 | 55.89 | 112.67 | 134.00 |
| 19 | 91.44 | 106.89 | 123.56 | 123.22 | 122.33 | 43.89 | 112.56 | 87.67 |
| 20 | 0.78 | 0.89 | 1.56 | 0.78 | 1.00 | 3.00 | 1.22 | 1.78 |
| 21 | 15.33 | 17.56 | 17.00 | 23.33 | 18.11 | 18.75 | 21.22 | 26.44 |
| 22 | 20.44 | 29.33 | 38.44 | 25.11 | 43.22 | 2.00 | 23.00 | 26.44 |
| 23 | 0.000 | 0.000 | 0.000 | 0.000 | 2.000 | 0.000 | 0.000 | 0.000 |
| 24 | 15.56 | 16.11 | 16.56 | 17.78 | 17.67 | 16.78 | 17.33 | 16.11 |
| 25 | 13.89 | 20.89 | 23.00 | 22.44 | 26.11 | 16.00 | 21.56 | 23.11 |
| 26 | 184.22 | 230.89 | 274.44 | 246.00 | 297.22 | 99.78 | 225.22 | 221.67 |
| 27 | 57.78 | 66.67 | 67.78 | 57.00 | 73.67 | 63.78 | 64.44 | 64.89 |
| 28 | 23.00 | 25.00 | 26.00 | 18.33 | 23.22 | 14.89 | 27.89 | 20.11 |
| 29 | 22.56 | 22.22 | 22.11 | 17.89 | 17.89 | 14.33 | 23.78 | 16.00 |
| 30 | 45.56 | 47.22 | 48.11 | 36.22 | 41.11 | 29.22 | 51.67 | 36.11 |
| 31 | 21.35 | 14.70 | 15.09 | 13.44 | 16.60 | 10.50 | 16.03 | 17.23 |
| 32 | 158.89 | 185.78 | 170.89 | 146.78 | 172.78 | 198.22 | 166.44 | 152.56 |
| 33 | 55.53 | 50.33 | 47.57 | 46.83 | 55.87 | 43.77 | 51.67 | 50.37 |
| 34 | 2.53 | 2.58 | 2.67 | 2.51 | 2.74 | 1.95 | 2.46 | 2.43 |
| 35 | 2.52 | 2.49 | 2.60 | 2.36 | 2.77 | 1.89 | 2.50 | 2.52 |
| 36 | 4.29 | 4.93 | 5.24 | 3.61 | 3.85 | 4.15 | 4.29 | 3.91 |
| 37 | 36.56 | 47.78 | 57.00 | 49.22 | 64.33 | 28.56 | 45.44 | 54.67 |
| 38 | 72.89 | 90.78 | 104.56 | 100.44 | 108.44 | 51.67 | 90.89 | 89.22 |
| 39 | 36.33 | 43.00 | 47.56 | 51.22 | 44.11 | 23.11 | 45.44 | 34.56 |

Table 131.

TABLE 132

Measured parameters in Soybean varieties (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 1 | 71.67 | 67.33 | 67.00 | 69.67 | 60.00 | 70.67 | 71.67 | 71.67 |
| 3 | 8.41 | 8.11 | 7.54 | 7.83 | 8.82 | 8.10 | 8.72 | 9.54 |
| 4 | 45.83 | 46.17 | 38.67 | 50.67 | 60.83 | 44.33 | 52.33 | 54.50 |
| 5 | 1.83 | 1.67 | 1.17 | 2.67 | 2.67 | 1.50 | 3.00 | 1.83 |
| 6 | 35.33 | 30.33 | 28.00 | 41.00 | 38.33 | 31.00 | 36.00 | 38.67 |
| 7 | 8.67 | 9.89 | 5.33 | 5.00 | 7.67 | 4.78 | 7.78 | 8.78 |
| 8 | 2.33 | 1.44 | 1.67 | 1.67 | 4.56 | 2.67 | 4.14 | 1.89 |
| 9 | 22.33 | 16.89 | 17.00 | 19.22 | 27.00 | 32.89 | 18.71 | 15.11 |
| 10 | 25.44 | 22.33 | 31.89 | 10.00 | 11.67 | 27.89 | 31.43 | 41.89 |
| 11 | 0.11 | 0.11 | 0.00 | 0.00 | 0.00 | 0.00 | 1.71 | 0.44 |
| 12 | 75.00 | 75.83 | 66.67 | 115.83 | 74.17 | 72.50 | 83.33 | 76.67 |
| 13 | 69.67 | 70.89 | 62.33 | 94.44 | 69.44 | 66.78 | 75.44 | 68.56 |
| 14 | 2.77 | 2.26 | 2.76 | 1.43 | 2.60 | 3.32 | 3.19 | 3.17 |
| 15 | 1.38 | 0.89 | 1.41 | 2.40 | 2.32 | 1.54 | 0.80 | 1.21 |
| 16 | 2.00 | 2.17 | 2.00 | 3.00 | 2.83 | 2.17 | 2.00 | 2.33 |
| 17 | 84.67 | 86.00 | 75.67 | 169.33 | 191.33 | 86.67 | 85.67 | 87.67 |
| 18 | 171.11 | 160.44 | 139.67 | 49.44 | 75.44 | 112.33 | 204.67 | 180.78 |
| 19 | 123.78 | 102.67 | 131.33 | 70.11 | 93.56 | 152.11 | 140.11 | 159.56 |
| 20 | 2.78 | 1.78 | 0.89 | 0.33 | 5.67 | 1.56 | 5.13 | 0.67 |
| 21 | 34.44 | 32.33 | 19.89 | 12.56 | 21.56 | 21.22 | 29.63 | 16.67 |
| 22 | 33.00 | 31.33 | 33.00 | 8.00 | 8.89 | 22.78 | 40.25 | 48.78 |
| 23 | 0.111 | 0.000 | 0.000 | 0.000 | 0.000 | 0.000 | 0.750 | 0.111 |
| 24 | 18.00 | 18.11 | 18.33 | 21.56 | 16.78 | 19.11 | 17.33 | 18.78 |
| 25 | 26.33 | 33.00 | 21.33 | 14.38 | 15.22 | 18.56 | 30.44 | 28.00 |

TABLE 132-continued

Measured parameters in Soybean varieties (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 26 | 294.89 | 263.11 | 271.00 | 119.56 | 169.00 | 264.44 | 344.78 | 340.33 |
| 27 | 80.33 | 74.89 | 58.33 | 55.25 | 54.00 | 52.44 | 105.00 | 67.00 |
| 28 | 23.00 | 20.11 | 19.33 | 12.00 | 21.11 | 15.33 | 23.78 | 20.67 |
| 29 | 18.00 | 15.00 | 19.63 | 15.41 | 33.78 | 21.56 | 16.22 | 26.56 |
| 30 | 41.00 | 35.11 | 39.88 | 27.41 | 54.89 | 36.89 | 40.00 | 47.22 |
| 31 | 14.64 | 16.51 | 17.12 | 10.52 | 12.06 | 15.80 | 12.64 | 12.58 |
| 32 | 175.67 | 163.89 | 136.56 | 191.67 | 224.67 | 155.33 | 216.22 | 192.11 |
| 33 | 52.93 | 56.30 | 55.07 | 40.17 | 44.00 | 52.37 | 46.90 | 48.57 |
| 34 | 2.43 | 2.53 | 2.60 | 2.34 | 2.13 | 2.48 | 2.47 | 2.70 |
| 35 | 2.48 | 2.53 | 2.60 | 2.26 | 2.17 | 2.40 | 2.52 | 2.68 |
| 36 | 3.90 | 3.92 | 3.41 | 4.38 | 4.15 | 3.50 | 4.36 | 3.67 |
| 37 | 70.33 | 65.44 | 53.78 | 20.89 | 36.11 | 45.56 | 83.11 | 66.22 |
| 38 | 120.56 | 106.22 | 104.33 | 51.78 | 79.33 | 109.00 | 138.89 | 125.56 |
| 39 | 50.22 | 40.78 | 50.56 | 30.89 | 43.22 | 63.44 | 55.78 | 59.33 |

Table 132

TABLE 133

Measured parameters in Soybean varieties (lines 17-23)

| Ecotype/Treatment | Line-17 | Line-18 | Line-19 | Line-20 | Line-21 | Line-22 | Line-23 |
|---|---|---|---|---|---|---|---|
| 1 | 74.00 | 73.00 | 72.33 | 73.33 | 67.33 | 68.67 | 69.33 |
| 3 | 10.12 | 8.46 | 8.09 | 8.11 | 7.09 | 8.26 | 7.57 |
| 4 | 55.67 | 48.00 | 52.00 | 45.17 | 57.00 | 44.17 | 43.33 |
| 5 | 2.83 | 2.67 | 2.50 | 1.67 | 2.50 | 1.83 | 2.00 |
| 6 | 40.00 | 41.00 | 38.33 | 37.00 | 24.67 | 31.00 | 37.67 |
| 7 | 17.56 | 11.67 | 12.11 | 10.44 | 8.00 | 8.00 | 9.00 |
| 8 | 1.67 | 4.00 | 4.33 | 1.89 | 1.78 | 2.11 | 0.44 |
| 9 | 8.11 | 21.33 | 17.67 | 20.00 | 17.44 | 20.33 | 11.22 |
| 10 | 22.78 | 11.11 | 28.22 | 27.89 | 25.11 | 24.11 | 25.22 |
| 11 | 0.44 | 0.00 | 0.56 | 0.56 | 0.44 | 0.00 | 0.11 |
| 12 | 76.67 | 101.67 | 98.33 | 89.17 | 93.33 | 75.83 | 78.33 |
| 13 | 63.89 | 89.78 | 82.11 | 81.11 | 85.67 | 70.56 | 70.78 |
| 14 | 1.87 | 1.98 | 2.71 | 2.58 | 2.45 | 2.78 | 2.15 |
| 15 | 0.37 | 3.90 | 0.78 | 1.36 | 0.92 | 1.18 | 0.82 |
| 16 | 2.00 | 3.50 | 2.50 | 2.00 | 2.50 | 2.17 | 2.17 |
| 17 | 71.33 | 88.00 | 75.00 | 78.67 | 91.67 | 80.67 | 80.67 |
| 18 | 324.63 | 46.88 | 176.22 | 121.56 | 151.56 | 143.00 | 144.00 |
| 19 | 88.00 | 80.00 | 126.56 | 127.78 | 113.78 | 115.11 | 99.00 |
| 20 | 5.63 | 2.88 | 3.00 | 2.33 | 1.67 | 1.25 | 0.89 |
| 21 | 33.50 | 8.50 | 22.78 | 21.89 | 22.89 | 21.75 | 13.22 |
| 22 | 82.00 | 9.00 | 42.11 | 24.56 | 34.11 | 32.75 | 38.89 |
| 23 | 1.500 | 0.000 | 0.333 | 0.444 | 0.444 | 0.000 | 0.000 |
| 24 | 17.11 | 18.78 | 18.89 | 19.44 | 19.89 | 16.78 | 17.00 |
| 25 | 45.25 | 8.25 | 25.44 | 22.67 | 23.00 | 21.88 | 23.78 |
| 26 | 412.50 | 136.00 | 302.78 | 249.33 | 265.33 | 260.50 | 243.00 |
| 27 | 167.22 | 45.44 | 83.22 | 63.67 | 69.67 | 64.33 | 76.22 |
| 28 | 30.25 | 4.13 | 20.11 | 14.89 | 24.33 | 17.00 | 19.22 |
| 29 | 9.00 | 9.03 | 16.00 | 14.57 | 19.78 | 15.89 | 14.67 |
| 30 | 38.88 | 14.25 | 36.11 | 29.46 | 44.11 | 32.75 | 33.89 |
| 31 | 10.25 | 7.30 | 11.38 | 13.86 | 14.63 | 15.68 | 14.77 |
| 32 | 265.00 | 160.67 | 196.33 | 166.33 | 171.44 | 155.33 | 175.78 |
| 33 | 40.33 | 34.23 | 44.27 | 46.23 | 49.70 | 53.67 | 52.53 |
| 34 | 2.68 | 2.12 | 2.58 | 2.48 | 2.61 | 2.58 | 2.70 |
| 35 | 2.59 | 2.22 | 2.49 | 2.53 | 2.53 | 2.47 | 2.67 |
| 36 | 3.74 | 4.80 | 4.36 | 4.18 | 4.89 | 4.20 | 4.16 |
| 37 | 122.63 | 20.38 | 68.22 | 49.22 | 59.11 | 55.75 | 53.00 |
| 38 | 155.63 | 61.00 | 119.00 | 99.56 | 103.89 | 103.25 | 90.00 |
| 39 | 33.00 | 36.44 | 50.78 | 50.33 | 44.78 | 46.56 | 37.00 |

Table 133.

TABLE 134

Measured parameters in Soybean varieties (lines 24-29)

| Ecotype/Treatment | Line-24 | Line-25 | Line-26 | Line-27 | Line-28 | Line-29 |
|---|---|---|---|---|---|---|
| 1 | 73.67 | 68.00 | 68.67 | 68.00 | 67.00 | 70.67 |
| 3 | 7.73 | 8.16 | 8.18 | 6.88 | 7.82 | 7.89 |
| 4 | 52.67 | 56.00 | 56.17 | 43.50 | 46.00 | 47.50 |
| 5 | 3.50 | 3.33 | 1.83 | 1.50 | 2.33 | 1.50 |
| 6 | 39.00 | 27.33 | 27.67 | 27.33 | 36.33 | 32.67 |
| 7 | 9.11 | 6.78 | 7.11 | 4.33 | 9.11 | 10.00 |
| 8 | 1.89 | 3.44 | 3.22 | 1.67 | 3.33 | 1.22 |
| 9 | 16.11 | 28.11 | 24.67 | 14.67 | 14.33 | 16.56 |
| 10 | 36.44 | 39.67 | 35.78 | 31.67 | 37.56 | 32.33 |
| 11 | 3.89 | 0.00 | 0.00 | 0.78 | 0.78 | 0.00 |
| 12 | 116.67 | 76.67 | 85.00 | 78.33 | 79.17 | 71.67 |
| 13 | 101.67 | 79.56 | 77.44 | 73.67 | 73.67 | 67.22 |
| 14 | 2.75 | 3.70 | 3.58 | 3.06 | 3.34 | 2.84 |
| 15 | 1.98 | 1.03 | 1.48 | 1.82 | 1.35 | 0.83 |
| 16 | 2.33 | 2.17 | 2.17 | 2.33 | 2.17 | 2.17 |
| 17 | 75.67 | 76.33 | 88.00 | 93.33 | 79.00 | 77.33 |
| 18 | 105.44 | 184.33 | 166.22 | 92.33 | 143.78 | 187.33 |
| 19 | 159.00 | 178.67 | 159.89 | 129.11 | 147.78 | 131.33 |
| 20 | 2.67 | 1.78 | 1.00 | 0.56 | 2.11 | 3.00 |
| 21 | 10.67 | 23.78 | 26.78 | 10.22 | 15.89 | 25.67 |
| 22 | 25.67 | 45.00 | 37.22 | 23.78 | 35.89 | 44.33 |
| 23 | 1.111 | 0.000 | 0.000 | 0.000 | 0.556 | 0.000 |
| 24 | 21.11 | 19.33 | 17.78 | 15.89 | 16.67 | 20.78 |
| 25 | 16.33 | 22.56 | 19.89 | 11.78 | 16.00 | 24.22 |
| 26 | 264.44 | 363.00 | 326.11 | 221.44 | 291.56 | 318.67 |
| 27 | 52.00 | 76.89 | 74.78 | 35.33 | 52.11 | 67.00 |
| 28 | 9.22 | 28.11 | 24.22 | 14.33 | 15.13 | 22.56 |
| 29 | 14.56 | 30.44 | 24.22 | 26.36 | 21.44 | 18.00 |
| 30 | 23.78 | 58.56 | 48.44 | 40.69 | 35.75 | 40.56 |
| 31 | 10.83 | 12.98 | 16.38 | 16.64 | 15.82 | 15.16 |
| 32 | 178.11 | 204.44 | 205.89 | 144.67 | 176.44 | 164.22 |
| 33 | 42.47 | 43.60 | 51.90 | 52.50 | 46.43 | 52.20 |
| 34 | 2.67 | 2.62 | 2.37 | 2.67 | 2.62 | 2.58 |
| 35 | 2.71 | 2.51 | 2.53 | 2.64 | 2.65 | 2.61 |
| 36 | 4.82 | 4.12 | 4.36 | 4.64 | 4.47 | 3.57 |
| 37 | 40.11 | 70.56 | 71.67 | 34.56 | 54.44 | 73.00 |
| 38 | 98.44 | 141.78 | 135.33 | 83.33 | 110.44 | 123.11 |
| 39 | 58.33 | 71.22 | 63.67 | 48.78 | 56.00 | 50.11 |

Table 134.

TABLE 135

Correlation between the expression level of selected genes of some embodiments of the invention in various tissues and the phenotypic performance under normal conditions across 26 soybean varieties

| Gene Name | R | P value | Exp. set | Corr. Set ID | Gene Name | R | P value | Exp. set | Corr. Set ID |
|---|---|---|---|---|---|---|---|---|---|
| LYD868 | 0.73 | 1.92E−05 | 3 | 31 | LYD874 | 0.72 | 2.21E−05 | 10 | 19 |
| LYD874 | 0.7 | 4.27E−05 | 10 | 10 | LYD874 | 0.7 | 4.37E−05 | 10 | 39 |
| LYD876 | 0.7 | 6.67E−05 | 6 | 31 | LYD877 | 0.76 | 3.69E−06 | 10 | 19 |
| LYD877 | 0.72 | 2.37E−05 | 10 | 10 | LYD877 | 0.74 | 1.06E−05 | 10 | 39 |
| LYD886 | 0.71 | 3.92E−05 | 10 | 31 | LYD888 | 0.54 | 4.40E−03 | 3 | 19 |
| LYD888 | 0.54 | 4.10E−03 | 3 | 14 | | | | | |
| LYD888 | 0.58 | 2.00E−03 | 3 | 39 | | | | | |

Table 135. Provided are the correlations (R) between the expression levels yield improving genes and their homologs in various tissues [Expression (Exp) sets] and the phenotypic performance [yield, biomass, and plant architecture (Correlation vector (Corr.))] under normal conditions across soybean varieties. P = p value.

TABLE 136

Correlation between the expression level of selected genes of some embodiments of the invention in various tissues and the phenotypic performance under normal conditions across 12 soybean varieties

| Gene Name | R | P value | Exp. set | Corr. Set ID | Gene Name | R | P value | Exp. set | Corr. Set ID |
|---|---|---|---|---|---|---|---|---|---|
| LGP104 | 0.76 | 4.05E−03 | 11 | 10 | LGP104 | 0.82 | 1.10E−03 | 11 | 19 |
| LGP104 | 0.87 | 2.71E−04 | 11 | 14 | LGP104 | 0.72 | 4.48E−02 | 9 | 24 |
| LGP104 | 0.79 | 2.33E−03 | 11 | 39 | LYD879 | 0.74 | 6.39E−03 | 10 | 37 |
| LGP105 | 0.73 | 1.70E−02 | 5 | 20 | LGP105 | 0.75 | 1.32E−02 | 8 | 20 |
| LGP105 | 0.75 | 3.22E−02 | 9 | 22 | LGP105 | 0.75 | 3.08E−02 | 9 | 18 |
| LGP105 | 0.76 | 2.96E−02 | 9 | 21 | LGP105 | 0.88 | 4.16E−03 | 9 | 32 |
| LGP105 | 0.94 | 5.61E−04 | 9 | 23 | LGP105 | 0.95 | 3.31E−04 | 9 | 27 |
| LGP105 | 0.79 | 1.96E−02 | 9 | 7 | LGP105 | 0.88 | 3.99E−03 | 9 | 25 |
| LGP105 | 0.82 | 1.33E−02 | 9 | 3 | LGP105 | 0.71 | 4.83E−02 | 9 | 26 |
| LGP105 | 0.85 | 7.65E−03 | 9 | 20 | LGP105 | 0.86 | 3.28E−04 | 4 | 17 |
| LGP105 | 0.72 | 4.60E−02 | 9 | 38 | LYD863 | 0.78 | 2.69E−03 | 10 | 35 |
| LGP109 | 0.77 | 8.57E−03 | 5 | 3 | LGP109 | 0.79 | 6.08E−03 | 5 | 20 |
| LGP109 | 0.82 | 3.82E−03 | 5 | 17 | LGP109 | 0.89 | 2.89E−03 | 9 | 31 |
| LGP109 | 0.88 | 3.86E−03 | 9 | 33 | LGP78 | 0.71 | 2.26E−02 | 7 | 3 |
| LGP78 | 0.83 | 3.10E−02 | 7 | 20 | LGP78 | 0.74 | 1.41E−02 | 8 | 31 |
| LGP78 | 0.74 | 3.70E−02 | 9 | 10 | LGP78 | 0.80 | 1.63E−02 | 9 | 31 |
| LGP78 | 0.75 | 3.38E−02 | 9 | 33 | LGP78 | 0.72 | 8.04E−03 | 10 | 10 |
| LGP78 | 0.71 | 9.99E−03 | 10 | 7 | LGP79 | 0.73 | 1.55E−02 | 8 | 31 |
| LGP78 | 0.72 | 4.42E−02 | 9 | 34 | MGP4 | 0.72 | 1.83E−02 | 8 | 35 |
| LGP78 | 0.71 | 5.00E−02 | 5 | 40 | LGP78 | 0.85 | 1.74E−03 | 1 | 40 |

TABLE 136-continued

Correlation between the expression level of selected genes of some embodiments of the invention in various tissues and the phenotypic performance under normal conditions across 12 soybean varieties

| Gene Name | R | P value | Exp. set | Corr. Set ID | Gene Name | R | P value | Exp. set | Corr. Set ID |
|---|---|---|---|---|---|---|---|---|---|
| LGP79 | 0.74 | 1.51E−02 | 8 | 33 | LGP79 | 0.71 | 4.99E−02 | 9 | 10 |
| LGP79 | 0.77 | 2.41E−02 | 9 | 30 | LGP79 | 0.75 | 3.35E−02 | 9 | 28 |
| LGP79 | 0.72 | 4.62E−02 | 9 | 26 | LGP79 | 0.73 | 7.58E−03 | 10 | 33 |
| LGP79 | 0.81 | 4.69E−03 | 7 | 35 | LYD863 | 0.87 | 5.39E−03 | 9 | 34 |
| LGP79 | 0.72 | 4.34E−02 | 9 | 34 | LYD866 | 0.73 | 6.85E−03 | 10 | 38 |
| LGP81 | 0.72 | 4.56E−02 | 9 | 10 | LGP81 | 0.88 | 3.91E−03 | 9 | 31 |
| LGP81 | 0.71 | 4.97E−02 | 9 | 33 | LGP81 | 0.77 | 2.60E−02 | 9 | 14 |
| LGP81 | 0.72 | 4.50E−02 | 9 | 29 | LYD860 | 0.71 | 5.02E−02 | 9 | 4 |
| LGP81 | 0.71 | 1.02E−02 | 11 | 39 | LYD871 | 0.76 | 1.12E−02 | 5 | 34 |
| LGP81 | 0.74 | 3.44E−02 | 5 | 40 | LGP81 | 0.82 | 3.75E−03 | 1 | 40 |
| LYD860 | 0.71 | 9.06E−03 | 1 | 20 | LYD860 | 0.75 | 4.64E−03 | 10 | 31 |
| LYD860 | 0.74 | 1.54E−02 | 10 | 40 | LYD861 | 0.75 | 3.25E−02 | 7 | 40 |
| LYD861 | 0.82 | 3.39E−03 | 8 | 23 | LYD861 | 0.75 | 1.33E−02 | 8 | 27 |
| LYD861 | 0.73 | 4.04E−02 | 9 | 24 | LYD861 | 0.72 | 8.53E−03 | 10 | 33 |
|  |  |  |  |  | LYD863 | 0.72 | 1.88E−02 | 7 | 31 |
| LYD863 | 0.80 | 1.79E−02 | 9 | 10 | LYD863 | 0.89 | 3.09E−03 | 9 | 31 |
| LYD863 | 0.86 | 5.61E−03 | 9 | 33 | LYD863 | 0.71 | 4.94E−02 | 9 | 21 |
| LYD863 | 0.84 | 8.27E−03 | 9 | 30 | LYD863 | 0.71 | 5.00E−02 | 9 | 14 |
| LYD863 | 0.85 | 7.84E−03 | 9 | 28 | LYD863 | 0.73 | 4.05E−02 | 9 | 26 |
| LYD863 | 0.71 | 1.02E−02 | 10 | 22 | LYD864 | 0.73 | 1.58E−02 | 5 | 9 |
| LYD863 | 0.78 | 2.29E−02 | 9 | 35 | LYD873 | 0.79 | 2.16E−02 | 4 | 34 |
| LYD863 | 0.72 | 4.24E−02 | 9 | 38 | LYD871 | 0.73 | 1.56E−02 | 5 | 35 |
| LYD863 | 0.76 | 4.25E−03 | 10 | 34 | LYD886 | 0.77 | 9.58E−03 | 8 | 37 |
| LYD864 | 0.79 | 6.93E−03 | 8 | 32 | LYD864 | 0.70 | 2.40E−02 | 8 | 20 |
| LYD864 | 0.90 | 2.27E−03 | 9 | 17 | LYD864 | 0.73 | 7.31E−03 | 10 | 22 |
| LYD864 | 0.78 | 2.98E−03 | 10 | 18 | LYD864 | 0.72 | 8.55E−03 | 10 | 21 |
| LYD864 | 0.85 | 4.87E−04 | 10 | 27 | LYD864 | 0.75 | 4.58E−03 | 10 | 7 |
| LYD864 | 0.83 | 8.46E−04 | 10 | 25 | LYD865 | 0.82 | 3.48E−03 | 5 | 32 |
| LYD865 | 0.85 | 1.78E−03 | 5 | 4 | LYD865 | 0.80 | 5.85E−03 | 8 | 17 |
| LYD865 | 0.78 | 2.36E−02 | 9 | 2 | LYD865 | 0.73 | 4.14E−02 | 9 | 23 |
| LYD865 | 0.73 | 3.89E−02 | 9 | 27 | LYD865 | 0.87 | 4.56E−03 | 9 | 7 |
| LYD865 | 0.74 | 3.57E−02 | 9 | 1 | LYD865 | 0.81 | 1.44E−02 | 9 | 3 |
| LYD865 | 0.75 | 3.11E−02 | 9 | 20 | LYD865 | 0.81 | 1.50E−03 | 1 | 16 |
| LYD865 | 0.89 | 8.77E−05 | 1 | 17 | LYD866 | 0.86 | 1.37E−03 | 8 | 32 |
| LYD865 | 0.83 | 3.25E−03 | 1 | 40 | LYD867 | 0.83 | 1.10E−02 | 4 | 40 |
| LYD866 | 0.71 | 2.06E−02 | 8 | 23 | LYD866 | 0.87 | 1.11E−03 | 8 | 27 |
| LYD866 | 0.71 | 2.07E−02 | 8 | 7 | LYD866 | 0.74 | 1.37E−02 | 8 | 25 |
| LYD866 | 0.87 | 1.06E−03 | 8 | 3 | LYD866 | 0.72 | 1.86E−02 | 8 | 20 |
| LYD866 | 0.81 | 1.30E−03 | 4 | 32 | LYD866 | 0.74 | 5.54E−03 | 1 | 27 |
| LYD866 | 0.77 | 3.73E−03 | 1 | 7 | LYD866 | 0.78 | 2.63E−03 | 10 | 22 |
| LYD866 | 0.82 | 1.15E−03 | 10 | 18 | LYD866 | 0.76 | 4.39E−03 | 10 | 27 |
| LYD866 | 0.75 | 4.84E−03 | 10 | 25 | LYD866 | 0.73 | 7.58E−03 | 10 | 26 |
| LYD866 | 0.83 | 9.30E−04 | 10 | 37 | LYD881 | 0.76 | 2.70E−02 | 9 | 38 |
| LYD867 | 0.74 | 1.52E−02 | 8 | 22 | LYD867 | 0.73 | 1.75E−02 | 8 | 18 |
| LYD867 | 0.77 | 8.66E−03 | 8 | 23 | LYD867 | 0.71 | 2.19E−02 | 8 | 26 |
| LYD867 | 0.79 | 1.89E−02 | 9 | 31 | LYD867 | 0.82 | 1.37E−02 | 9 | 33 |
| LYD867 | 0.71 | 2.07E−02 | 8 | 37 | LGP78 | 0.70 | 5.16E−02 | 9 | 35 |
| LYD868 | 0.75 | 4.80E−03 | 11 | 2 | LYD868 | 0.74 | 5.66E−03 | 11 | 13 |
| LYD868 | 0.71 | 9.19E−03 | 11 | 12 | LYD868 | 0.75 | 4.54E−03 | 11 | 1 |
| LYD868 | 0.72 | 1.86E−02 | 5 | 4 | LYD868 | 0.71 | 2.04E−02 | 5 | 3 |
| LYD868 | 0.84 | 2.13E−03 | 5 | 17 | LYD868 | 0.75 | 1.24E−02 | 8 | 11 |
| LYD868 | 0.92 | 2.00E−04 | 8 | 23 | LYD868 | 0.82 | 1.33E−02 | 9 | 9 |
| LYD868 | 0.72 | 4.48E−02 | 9 | 14 | LYD868 | 0.91 | 1.91E−03 | 9 | 29 |
| LYD868 | 0.73 | 7.60E−03 | 4 | 24 | LYD868 | 0.80 | 1.97E−03 | 1 | 11 |
| LYD868 | 0.74 | 5.97E−03 | 10 | 31 | LYD868 | 0.82 | 1.16E−02 | 10 | 33 |
| LYD869 | 0.72 | 1.97E−02 | 5 | 27 | LYD869 | 0.76 | 1.07E−02 | 8 | 20 |
| LYD869 | 0.76 | 1.02E−02 | 8 | 17 | LYD870 | 0.77 | 9.07E−03 | 7 | 4 |
| LYD869 | 0.76 | 3.03E−02 | 9 | 36 | LYD889 | 0.78 | 2.69E−03 | 1 | 39 |
| LYD869 | 0.84 | 1.74E−02 | 9 | 40 | LYD871 | 0.73 | 1.72E−02 | 11 | 40 |
| LYD870 | 0.74 | 1.38E−02 | 7 | 20 | LYD870 | 0.74 | 1.45E−02 | 8 | 21 |
| LYD870 | 0.76 | 1.08E−02 | 8 | 32 | LYD870 | 0.87 | 1.15E−03 | 8 | 23 |
| LYD870 | 0.81 | 4.62E−03 | 8 | 27 | LYD870 | 0.77 | 8.55E−03 | 8 | 7 |
| LYD870 | 0.74 | 1.39E−02 | 8 | 25 | LYD870 | 0.78 | 8.05E−03 | 8 | 20 |
| LYD870 | 0.73 | 4.01E−02 | 9 | 31 | LYD870 | 0.80 | 1.64E−02 | 9 | 19 |
| LYD870 | 0.86 | 5.80E−03 | 9 | 14 | LYD870 | 0.78 | 2.21E−02 | 9 | 29 |
| LYD870 | 0.75 | 5.35E−03 | 1 | 27 | LYD870 | 0.73 | 6.55E−03 | 1 | 25 |
| LYD870 | 0.75 | 5.05E−03 | 1 | 26 | LYD871 | 0.84 | 2.42E−02 | 7 | 4 |
| LYD870 | 0.76 | 4.35E−03 | 1 | 38 | LYD871 | 0.72 | 8.12E−03 | 10 | 35 |
| LYD871 | 0.86 | 1.33E−03 | 5 | 10 | LYD871 | 0.79 | 7.08E−03 | 5 | 19 |
| LYD871 | 0.78 | 8.01E−03 | 5 | 26 | LYD871 | 0.73 | 4.16E−02 | 9 | 33 |
| LYD871 | 0.71 | 4.82E−02 | 9 | 3 | LYD871 | 0.84 | 6.05E−04 | 10 | 10 |
| LYD871 | 0.79 | 2.40E−03 | 10 | 19 | LYD872 | 0.71 | 1.02E−02 | 10 | 33 |

TABLE 136-continued

Correlation between the expression level of selected genes of some embodiments of the invention in various tissues and the phenotypic performance under normal conditions across 12 soybean varieties

| Gene Name | R | P value | Exp. set | Corr. Set ID | Gene Name | R | P value | Exp. set | Corr. Set ID |
|---|---|---|---|---|---|---|---|---|---|
| LYD871 | 0.71 | 2.04E−02 | 5 | 39 | LGP78 | 0.72 | 8.75E−03 | 10 | 35 |
| LYD871 | 0.75 | 1.25E−02 | 5 | 38 | LYD876 | 0.84 | 9.17E−03 | 9 | 36 |
| LYD871 | 0.72 | 8.49E−03 | 10 | 34 | LYD876 | 0.87 | 1.02E−03 | 5 | 39 |
| LYD873 | 0.79 | 6.81E−03 | 7 | 31 | LYD873 | 0.77 | 9.39E−03 | 7 | 33 |
| LYD873 | 0.78 | 7.86E−03 | 8 | 23 | LYD873 | 0.75 | 3.04E−02 | 9 | 9 |
| LYD873 | 0.82 | 1.28E−02 | 9 | 29 | LYD873 | 0.70 | 1.11E−02 | 4 | 10 |
| LYD873 | 0.73 | 7.62E−03 | 4 | 22 | LYD873 | 0.73 | 6.89E−03 | 4 | 26 |
| LYD873 | 0.85 | 4.98E−04 | 10 | 23 | LYD874 | 0.73 | 1.58E−02 | 5 | 15 |
| LYD873 | 0.75 | 4.84E−03 | 4 | 35 | LYD863 | 0.70 | 2.28E−02 | 7 | 34 |
| LYD874 | 0.79 | 1.90E−02 | 9 | 31 | LYD874 | 0.80 | 1.81E−02 | 9 | 33 |
| LYD874 | 0.73 | 4.01E−02 | 9 | 19 | LYD874 | 0.77 | 2.44E−02 | 9 | 14 |
| LYD874 | 0.70 | 1.05E−02 | 1 | 14 | LYD874 | 0.74 | 6.44E−03 | 10 | 10 |
| LYD874 | 0.79 | 2.25E−03 | 10 | 24 | LYD874 | 0.75 | 5.21E−03 | 10 | 19 |
| LYD874 | 0.72 | 8.28E−03 | 10 | 39 | LYD877 | 0.78 | 3.02E−03 | 10 | 39 |
| LYD876 | 0.75 | 5.07E−03 | 11 | 10 | LYD876 | 0.77 | 3.62E−03 | 11 | 19 |
| LYD876 | 0.78 | 2.82E−03 | 11 | 14 | LYD876 | 0.72 | 8.52E−03 | 11 | 23 |
| LYD876 | 0.84 | 7.08E−04 | 11 | 27 | LYD876 | 0.71 | 1.02E−02 | 11 | 25 |
| LYD876 | 0.79 | 2.08E−03 | 11 | 20 | LYD876 | 0.85 | 2.06E−03 | 5 | 15 |
| LYD876 | 0.90 | 4.36E−04 | 5 | 10 | LYD876 | 0.91 | 2.44E−04 | 5 | 19 |
| LYD876 | 0.76 | 1.04E−02 | 5 | 14 | LYD876 | 0.79 | 6.36E−03 | 5 | 23 |
| LYD876 | 0.77 | 9.56E−03 | 8 | 32 | LYD876 | 0.96 | 9.16E−06 | 8 | 3 |
| LYD876 | 0.73 | 4.11E−02 | 9 | 15 | LYD876 | 0.72 | 4.20E−02 | 9 | 16 |
| LYD876 | 0.75 | 3.07E−02 | 9 | 13 | LYD876 | 0.81 | 1.58E−02 | 9 | 12 |
| LYD876 | 0.73 | 3.90E−02 | 9 | 7 | LYD876 | 0.84 | 8.87E−03 | 9 | 17 |
| LYD876 | 0.71 | 1.54E−02 | 2 | 19 | LYD876 | 0.82 | 1.24E−02 | 4 | 15 |
| LYD876 | 0.80 | 1.85E−03 | 4 | 32 | LYD876 | 0.71 | 9.23E−03 | 4 | 4 |
| LYD876 | 0.88 | 1.81E−04 | 4 | 20 | LYD876 | 0.71 | 9.67E−03 | 1 | 3 |
| LYD876 | 0.73 | 1.58E−02 | 5 | 34 | LYD891 | 0.72 | 1.91E−02 | 5 | 36 |
| LYD876 | 0.81 | 4.55E−03 | 5 | 35 | LYD870 | 0.80 | 1.65E−02 | 9 | 39 |
| LYD876 | 0.72 | 1.22E−02 | 2 | 39 | MGP4 | 0.75 | 3.16E−02 | 9 | 39 |
| LYD876 | 0.85 | 1.66E−02 | 9 | 40 | LYD877 | 0.81 | 1.50E−02 | 8 | 40 |
| LYD877 | 0.85 | 7.81E−03 | 9 | 15 | LYD877 | 0.80 | 2.00E−03 | 10 | 10 |
| LYD877 | 0.79 | 2.23E−03 | 10 | 24 | LYD877 | 0.81 | 1.39E−03 | 10 | 19 |
| LYD878 | 0.77 | 2.53E−02 | 7 | 40 | LYD878 | 0.77 | 4.17E−02 | 9 | 40 |
| LYD879 | 0.73 | 1.61E−02 | 7 | 21 | LYD879 | 0.87 | 4.72E−03 | 9 | 17 |
| LYD879 | 0.74 | 6.06E−03 | 10 | 22 | LYD879 | 0.74 | 5.61E−03 | 10 | 18 |
| LYD879 | 0.73 | 1.66E−02 | 8 | 39 | LYD889 | 0.86 | 1.41E−03 | 8 | 37 |
| LYD880 | 0.75 | 1.29E−02 | 5 | 11 | LYD880 | 0.88 | 8.00E−04 | 5 | 23 |
| LYD880 | 0.86 | 1.56E−03 | 8 | 32 | LYD880 | 0.76 | 1.00E−02 | 8 | 23 |
| LYD880 | 0.77 | 9.08E−03 | 8 | 27 | LYD880 | 0.73 | 1.70E−02 | 8 | 3 |
| LYD880 | 0.83 | 2.92E−03 | 8 | 20 | LYD880 | 0.79 | 1.94E−02 | 9 | 6 |
| LYD880 | 0.87 | 5.43E−03 | 9 | 3 | LYD880 | 0.76 | 3.82E−03 | 1 | 32 |
| LYD880 | 0.85 | 4.65E−04 | 1 | 27 | LYD880 | 0.80 | 1.98E−03 | 1 | 3 |
| LYD881 | 0.73 | 1.57E−02 | 7 | 20 | LYD881 | 0.78 | 2.37E−02 | 9 | 22 |
| LYD881 | 0.82 | 1.18E−02 | 9 | 18 | LYD881 | 0.89 | 3.24E−03 | 9 | 21 |
| LYD881 | 0.76 | 2.81E−02 | 9 | 32 | LYD881 | 0.71 | 4.87E−02 | 9 | 23 |
| LYD881 | 0.82 | 1.31E−02 | 9 | 27 | LYD881 | 0.81 | 1.38E−02 | 9 | 25 |
| LYD881 | 0.74 | 3.54E−02 | 9 | 26 | LYD881 | 0.72 | 8.57E−03 | 10 | 33 |
| LYD881 | 0.84 | 8.99E−03 | 9 | 37 | LYD890 | 0.76 | 4.26E−03 | 10 | 38 |
| LYD882 | 0.74 | 1.49E−02 | 5 | 3 | LYD882 | 0.72 | 1.93E−02 | 8 | 26 |
| LYD882 | 0.75 | 3.32E−02 | 9 | 31 | LYD882 | 0.77 | 2.59E−02 | 9 | 33 |
| LYD882 | 0.79 | 2.04E−03 | 1 | 27 | LYD882 | 0.80 | 1.90E−03 | 1 | 3 |
| LYD882 | 0.76 | 4.33E−03 | 1 | 28 | LYD882 | 0.70 | 1.06E−02 | 10 | 29 |
| LYD882 | 0.71 | 2.18E−02 | 8 | 38 | LGP105 | 0.78 | 2.31E−02 | 9 | 37 |
| LYD882 | 0.71 | 2.09E−02 | 11 | 40 | LYD884 | 0.71 | 4.91E−02 | 8 | 40 |
| LYD883 | 0.71 | 2.18E−02 | 7 | 28 | LYD883 | 0.71 | 4.99E−02 | 9 | 10 |
| LYD883 | 0.71 | 4.91E−02 | 9 | 31 | LYD883 | 0.77 | 2.62E−02 | 9 | 33 |
| LYD883 | 0.74 | 3.71E−02 | 9 | 19 | LYD883 | 0.76 | 2.79E−02 | 9 | 14 |
| LYD883 | 0.73 | 7.21E−03 | 10 | 22 | LYD883 | 0.73 | 6.58E−03 | 10 | 2 |
| LYD883 | 0.71 | 1.03E−02 | 10 | 1 | LYD884 | 0.72 | 1.89E−02 | 7 | 20 |
| LYD884 | 0.81 | 4.53E−03 | 8 | 15 | LYD886 | 0.72 | 7.67E−03 | 11 | 27 |
| LYD886 | 0.74 | 1.43E−02 | 5 | 20 | LYD886 | 0.74 | 1.51E−02 | 8 | 18 |
| LYD886 | 0.78 | 8.44E−03 | 8 | 21 | LYD886 | 0.88 | 9.14E−04 | 8 | 32 |
| LYD886 | 0.89 | 6.27E−04 | 8 | 27 | LYD886 | 0.75 | 1.29E−02 | 8 | 7 |
| LYD886 | 0.83 | 3.13E−03 | 8 | 25 | LYD886 | 0.82 | 4.07E−03 | 8 | 3 |
| LYD886 | 0.83 | 2.99E−03 | 8 | 20 | LYD886 | 0.71 | 4.63E−02 | 9 | 31 |
| LYD886 | 0.75 | 8.42E−03 | 2 | 32 | LYD886 | 0.78 | 4.86E−03 | 2 | 20 |
| LYD886 | 0.78 | 4.84E−03 | 2 | 17 | LYD886 | 0.85 | 4.67E−04 | 1 | 32 |
| LYD886 | 0.80 | 1.87E−03 | 1 | 27 | LYD886 | 0.73 | 7.36E−03 | 10 | 31 |
| LYD886 | 0.73 | 6.67E−03 | 10 | 33 | LYD886 | 0.72 | 8.68E−03 | 10 | 21 |
| LYD887 | 0.87 | 1.15E−03 | 7 | 15 | LYD887 | 0.77 | 9.35E−03 | 5 | 9 |
| LYD887 | 0.72 | 1.78E−02 | 5 | 19 | LYD887 | 0.80 | 5.65E−03 | 5 | 14 |

TABLE 136-continued

Correlation between the expression level of selected genes of some embodiments of the invention in various tissues and the phenotypic performance under normal conditions across 12 soybean varieties

| Gene Name | R | P value | Exp. set | Corr. Set ID | Gene Name | R | P value | Exp. set | Corr. Set ID |
|---|---|---|---|---|---|---|---|---|---|
| LYD887 | 0.90 | 3.83E-04 | 8 | 17 | LYD889 | 0.78 | 7.86E-03 | 5 | 6 |
| LYD887 | 0.81 | 4.54E-03 | 5 | 39 | LYD891 | 0.70 | 1.05E-02 | 1 | 37 |
|  |  |  |  |  | LYD876 | 0.73 | 6.90E-03 | 11 | 39 |
| LYD890 | 0.90 | 4.12E-04 | 7 | 15 | LYD890 | 0.87 | 4.56E-03 | 9 | 15 |
| LYD890 | 0.80 | 1.83E-03 | 10 | 22 | LYD890 | 0.81 | 1.48E-03 | 10 | 18 |
| LYD890 | 0.77 | 3.18E-03 | 10 | 25 | LYD890 | 0.77 | 3.27E-03 | 10 | 26 |
| LYD890 | 0.80 | 1.79E-03 | 10 | 37 | LYD873 | 0.72 | 4.22E-02 | 9 | 39 |
| LYD891 | 0.91 | 2.57E-04 | 7 | 13 | LYD891 | 0.92 | 1.76E-04 | 7 | 12 |
| LYD891 | 0.75 | 1.28E-02 | 5 | 3 | LYD891 | 0.75 | 1.32E-02 | 8 | 32 |
| LYD891 | 0.85 | 1.70E-03 | 8 | 3 | LYD891 | 0.74 | 1.43E-02 | 8 | 20 |
| LYD891 | 0.78 | 2.12E-02 | 9 | 15 | LYD891 | 0.78 | 2.37E-02 | 9 | 3 |
| LYD891 | 0.80 | 3.10E-03 | 2 | 17 | LYD891 | 0.73 | 7.12E-03 | 4 | 19 |
| LYD891 | 0.76 | 4.02E-03 | 1 | 27 | LYD891 | 0.74 | 6.21E-03 | 10 | 21 |
| LYD891 | 0.77 | 3.18E-03 | 10 | 13 | LYD933 | 0.70 | 2.35E-02 | 7 | 31 |
| LYD891 | 0.70 | 2.40E-02 | 7 | 36 | LYD864 | 0.80 | 1.92E-03 | 10 | 37 |
| LYD891 | 0.76 | 4.00E-03 | 4 | 39 | LGP79 | 0.71 | 4.95E-02 | 9 | 38 |
| LYD891 | 0.93 | 7.68E-04 | 5 | 40 | LYD891 | 0.71 | 4.75E-02 | 8 | 40 |
|  |  |  |  |  | LYD867 | 0.79 | 7.10E-03 | 8 | 35 |
| MGP4 | 0.86 | 1.24E-03 | 8 | 11 | MGP4 | 0.73 | 1.59E-02 | 8 | 23 |
| MGP4 | 0.76 | 2.77E-02 | 9 | 10 | MGP4 | 0.79 | 1.93E-02 | 9 | 31 |
| MGP4 | 0.80 | 1.68E-02 | 9 | 30 | MGP4 | 0.78 | 2.27E-02 | 9 | 19 |
| MGP4 | 0.84 | 9.56E-03 | 9 | 14 | MGP4 | 0.86 | 6.22E-03 | 9 | 29 |
| MGP4 | 0.80 | 1.63E-03 | 4 | 15 | LGP79 | 0.82 | 3.81E-03 | 7 | 34 |

Table 136. Provided are the correlations (R) between the expression levels yield improving genes and their homologs in various tissues [Expression (Exp) sets] and the phenotypic performance [yield, biomass, and plant architecture (Correlation vector (Corr.))] under normal conditions across soybean varieties. P = p value.

Example 17

Production of Tomato Transcriptome and High Throughput Correlation Analysis Using 44K Tomato Oligonucleotide Micro-Array In order to produce a high throughput correlation analysis between NUE related phenotypes and gene expression, the present inventors utilized a Tomato oligonucleotide micro-array, produced by Agilent Technologies [chem. (dot) agilent (dot) com/Scripts/PDS (dot) asp?1Page=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [davidmlane (dot) com/hyperstat/A34739 (dot) html].

Correlation of Tomato Varieties Across Ecotypes Grown Under Low Nitrogen, Drought and Regular Growth Conditions Experimental Procedures:

10 Tomato varieties were grown in 3 repetitive blocks, each containing 6 plants per plot were grown at net house. Briefly, the growing protocol was as follows:

1. Regular growth conditions: Tomato varieties were grown under normal conditions: 4-6 Liters/$m^2$ of water per day and fertilized with NPK (nitrogen, phosphorous and potassium at a ratio 6:6:6, respectively) as recommended in protocols for commercial tomato production.

2. Low Nitrogen fertilization conditions: Tomato varieties were grown under normal conditions (4-6 Liters/$m^2$ per day and fertilized with NPK as recommended in protocols for commercial tomato production) until flower stage. At this time, Nitrogen fertilization was stopped.

3. Drought stress: Tomato variety was grown under normal conditions (4-6 Liters/$m^2$ per day) until flower stage. At this time, irrigation was reduced to 50% compared to normal conditions.

Plants were phenotyped on a daily basis following the standard descriptor of tomato (Table 138). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 139-141, herein below.

Analyzed Tomato tissues—Two tissues at different developmental stages [flower and leaf], representing different plant characteristics, were sampled and RNA was extracted as described above. For convenience, each micro-array expression information tissue type has received a Set ID as summarized in Table 137 below.

TABLE 137

Tomato transcriptome expression sets

| Expression Set | Set ID |
|---|---|
| Leaf at reproductive stage under normal conditions | 1 |
| Flower under normal conditions | 2 |
| Leaf at reproductive stage under low N conditions | 3 |
| Flower under low N conditions | 4 |

TABLE 137-continued

Tomato transcriptome expression sets

| Expression Set | Set ID |
|---|---|
| Leaf at reproductive stage under drought conditions | 5 |
| Flower under drought conditions | 6 |

Table 137: Provided are the identification (ID) digits of each of the tomato expression sets.

The collected data parameters were as follows: Fruit Weight (gr)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Yield/SLA—Fruit yield divided by the specific leaf area, gives a measurement of the balance between reproductive and vegetative processes.

Yield/total leaf area—Fruit yield divided by the total leaf area, gives a measurement of the balance between reproductive and vegetative processes.

Plant vegetative Weight (FW) (gr)—At the end of the experiment [when 50% of the fruit were ripe (red)] all plants from plots within blocks A-C were collected. Fresh weight was measured (grams).

Inflorescence Weight (gr)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I as described above.

Plants that maintain high relative water content (RWC) compared to control lines were considered more tolerant to drought than those exhibiting reduced relative water content.

TABLE 138

Tomato correlated parameters (vectors)

| Correlated parameter with | Correlation ID |
|---|---|
| 100 weight green fruit [gr.] (Drought) | 1 |
| 100 weight green fruit [gr.] (Low N) | 2 |
| 100 weight green fruit [gr.] (Normal) | 3 |
| 100 weight red fruit [gr.] (Drought) | 4 |
| 100 weight red fruit [gr.] (Low N) | 5 |
| 100 weight red fruit [gr.] (Normal) | 6 |
| Cluster Weight (Low N/Normal) | 7 |
| FW NUE [gr.] (Normal) | 8 |
| FW (Drought/Normal) | 9 |
| FW/Plant [gr./number] (Low N) | 10 |
| FW/Plant [gr./number] (Normal) | 11 |
| FW/Plant [gr./number] (Drought) | 12 |
| Fruit (Drought/Low N) | 13 |
| Fruit NUE [number] (Normal) | 14 |

TABLE 138-continued

Tomato correlated parameters (vectors)

| Correlated parameter with | Correlation ID |
|---|---|
| Fruit Yield (Drought/Normal) | 15 |
| Fruit Yield/Plant [gr./number] (Low N) | 16 |
| Fruit Yield/Plant [gr./number] (Drought) | 17 |
| Fruit yield/Plant [gr.] (Normal) | 18 |
| HI [yield/yield + biomass] (Low N) | 19 |
| HI [yield/yield + biomass] (Normal) | 20 |
| Leaflet Length [cm] (Low N) | 21 |
| Leaflet Length [cm] (Normal) | 22 |
| Leaflet Length [cm]) (Drought) | 23 |
| Leaflet Width [cm] (Low N) | 24 |
| Leaflet Width [cm] (Normal) | 25 |
| Leaflet Width [cm] (Drought) | 26 |
| NUE [yield/SPAD] (Low N) | 27 |
| NUE [yield/SPAD] [gr./number] (Normal) | 28 |
| NUE2 [total biomass/SPAD] (Low N) | 29 |
| NUE2 [total biomass/SPAD] [gr./number] (Normal) | 30 |
| NUpE [biomass/SPAD] (Low N) | 31 |
| NUpE [biomass/SPAD] [gr./number] (Normal) | 32 |
| No flowers (Low N) | 33 |
| Number of flowers (Normal) | 34 |
| Number of Flower Drought/Low N | 35 |
| Number of Flower Drought/Normal | 36 |
| Number of flowers (Drought) | 37 |
| Num. Flowers (Low N/Normal) | 38 |
| RWC (Normal) | 39 |
| RWC Drought | 40 |
| RWC Drought/Normal | 41 |
| RWC (Low N) | 42 |
| RWC (Low N/Normal) | 43 |
| SPAD 100% RWC (Low N/Normal) | 44 |
| SLA [leaf area/plant biomass] [$cm^2$/gr] (Low N) | 45 |
| SLA [leaf area/plant biomass] [$cm^2$/gr] (Normal) | 46 |
| SPAD (Normal) | 47 |
| SPAD 100% RWC (Low N) | 48 |
| SPAD 100% RWC (Normal) | 49 |
| SPAD (Low N) | 50 |
| SPAD (Low N/Normal) | 51 |
| Total Leaf Area [$cm^2$] (Low N) | 52 |
| Total Leaf Area [$cm^2$] (Normal) | 53 |
| Total Leaf Area [$cm^2$]) (Drought) | 54 |
| Weight Flower clusters [gr.] (Normal) | 55 |
| Weight clusters (flowers) (Low N) | 56 |
| Weight flower clusters [gr.] (Drought) | 57 |
| Yield/SLA [gr./($cm^2$/gr.)] (Low N) | 58 |
| Yield/SLA [gr./($cm^2$/gr.)] (Normal) | 59 |
| Yield/total leaf area [gr/$cm^2$] (Low N) | 60 |
| Yield/total leaf area [gr./$cm^2$] (Normal) | 61 |
| Average red fruit weight [gr.] (Low N) | 62 |
| Average red fruit weight [gr.] (Normal) | 63 |
| Average red fruit weight [gr.] (Drought) | 64 |
| Flower cluster weight Drought/Low N | 65 |
| Flower cluster weight Drought/Normal | 66 |
| Red fruit weight (Drought/Normal) | 67 |

Table 138. Provided are the tomato correlated parameters. "gr." = grams; "FW" = fresh weight; "NUE" = nitrogen use efficiency; "RWC" = relative water content; "NUpE" = nitrogen uptake efficiency; "SPAD" = chlorophyll levels; "HI" = harvest index (vegetative weight divided on yield); "SLA" = specific leaf area (leaf area divided by leaf dry weight), Treatment in the parenthesis.

Experimental Results

Table 138 provides the tomato correlated parameters (Vectors). The average for each of the measured parameter was calculated using the JMP software and values are summarized in Tables 139-141 below. Subsequent correlation analysis was conducted (Table 142). Results were integrated to the database.

TABLE 139

Measured parameters in Tomato accessions (lines 1-6)

| Ecotype/Treatment | Line-1 | Line-2 | Line-3 | Line-4 | Line-5 | Line-6 |
|---|---|---|---|---|---|---|
| 1 | | | | | | |
| 2 | 0.57 | 0.37 | 3.40 | 0.68 | 0.45 | 0.47 |
| 3 | 0.56 | 3.05 | 0.24 | 2.58 | 6.32 | 5.75 |
| 4 | | | | | | |
| 5 | 0.65 | 0.53 | 7.17 | 0.44 | | 0.55 |
| 6 | 0.82 | 2.46 | 0.50 | 2.76 | 5.32 | 5.24 |
| 7 | 0.44 | 0.01 | 1.08 | 0.02 | 0.37 | 0.81 |
| 8 | 0.74 | 3.01 | 0.83 | 1.54 | 3.70 | 1.22 |
| 9 | 0.61 | 2.63 | 1.18 | 1.36 | 4.02 | 1.01 |
| 10 | 2.25 | 2.54 | 1.85 | 3.06 | 3.13 | 2.54 |
| 11 | 3.02 | 0.84 | 2.24 | 1.98 | 0.85 | 2.09 |
| 12 | 1.85 | 2.22 | 2.63 | 2.71 | 3.41 | 2.11 |
| 13 | 1.32 | 0.76 | 1.51 | 0.71 | 5.06 | 0.89 |
| 14 | 0.97 | 3.80 | 2.78 | 0.78 | 0.02 | 1.16 |
| 15 | 1.27 | 2.88 | 4.20 | 0.55 | 0.09 | 1.03 |
| 16 | 0.48 | 0.46 | 1.35 | 0.35 | 0.01 | 0.51 |
| 17 | 0.63 | 0.35 | 2.04 | 0.25 | 0.05 | 0.45 |
| 18 | 0.49 | 0.12 | 0.49 | 0.45 | 0.53 | 0.44 |
| 19 | 0.18 | 0.15 | 0.42 | 0.10 | 0.00 | 0.17 |
| 20 | 0.14 | 0.12 | 0.18 | 0.19 | 0.38 | 0.17 |
| 21 | 3.69 | 5.43 | 6.95 | 3.73 | 4.39 | 6.72 |
| 22 | 6.34 | 7.99 | 5.59 | 7.70 | 7.85 | 6.22 |
| 23 | | | | | | |
| 24 | 1.79 | 2.55 | 3.52 | 1.73 | 1.87 | 3.54 |
| 25 | 3.69 | 4.77 | 3.43 | 4.56 | 4.44 | 3.15 |
| 26 | | | | | | |
| 27 | 0.01 | 0.02 | 0.04 | 0.01 | 0.00 | 0.02 |
| 28 | 0.009 | 0.003 | 0.010 | 0.010 | 0.012 | 0.008 |
| 29 | 0.08 | 0.13 | 0.09 | 0.11 | 0.11 | 0.09 |
| 30 | 0.063 | 0.021 | 0.057 | 0.056 | 0.032 | 0.047 |
| 31 | 0.07 | 0.11 | 0.05 | 0.09 | 0.11 | 0.08 |
| 32 | 0.054 | 0.018 | 0.046 | 0.046 | 0.020 | 0.039 |
| 33 | 9.00 | 13.00 | 10.67 | 16.67 | 6.00 | 16.00 |
| 34 | 6.33 | 7.67 | 9.67 | 8.33 | 5.00 | 8.33 |
| 35 | 1.74 | 1.56 | 1.09 | 1.52 | 4.96 | 1.08 |
| 36 | 2.47 | 2.65 | 1.21 | 3.04 | 5.95 | 2.08 |
| 37 | 15.67 | 20.33 | 11.67 | 25.33 | 29.73 | 17.33 |
| 38 | 1.42 | 1.70 | 1.10 | 2.00 | 1.20 | 1.92 |
| 39 | 64.29 | 67.07 | 54.79 | 77.61 | 58.18 | 66.51 |
| 40 | 65.33 | 72.22 | 66.13 | 68.33 | 78.13 | 18.46 |
| 41 | 1.02 | 1.08 | 1.21 | 0.88 | 1.34 | 0.28 |
| 42 | 69.49 | 63.24 | 77.36 | 77.91 | 80.49 | 67.40 |
| 43 | 1.08 | 0.94 | 1.41 | 1.00 | 1.38 | 1.01 |
| 44 | 0.92 | 0.75 | 1.31 | 0.97 | 1.11 | 0.95 |
| 45 | 131.29 | 148.82 | 257.51 | 64.34 | 144.60 | 246.05 |
| 46 | 140.99 | 689.67 | 130.22 | 299.12 | 1117.74 | 111.77 |
| 47 | 55.80 | 46.40 | 48.20 | 43.40 | 42.90 | 53.30 |
| 48 | 33.01 | 23.42 | 34.53 | 32.51 | 27.66 | 33.68 |
| 49 | 35.89 | 31.09 | 26.38 | 33.68 | 24.98 | 35.47 |
| 50 | 47.50 | 37.00 | 44.60 | 41.70 | 34.40 | 50.00 |
| 51 | 0.85 | 0.80 | 0.93 | 0.96 | 0.80 | 0.94 |
| 52 | 294.83 | 378.00 | 476.39 | 197.08 | 453.24 | 625.51 |
| 53 | 426.10 | 582.38 | 291.40 | 593.58 | 947.59 | 233.35 |
| 54 | | | | | | |
| 55 | 0.69 | 56.35 | 0.44 | 11.31 | 0.79 | 0.58 |
| 56 | 0.31 | 0.35 | 0.47 | 0.25 | 0.29 | 0.47 |
| 57 | 0.33 | 0.29 | 0.55 | 0.31 | 0.45 | 0.56 |
| 58 | 0.004 | 0.003 | 0.005 | 0.006 | 0.000 | 0.002 |
| 59 | 0.004 | 0.000 | 0.004 | 0.002 | 0.000 | 0.004 |
| 60 | 0.002 | 0.001 | 0.003 | 0.002 | 0.000 | 0.001 |
| 61 | 0.001 | 0.000 | 0.002 | 0.001 | 0.001 | 0.002 |
| 62 | 0.006 | 0.005 | 0.096 | 0.004 | 0.006 | 0.007 |
| 63 | 0.01 | 0.29 | 0.01 | 0.05 | 0.23 | 0.29 |
| 64 | 0.209 | 0.005 | 0.102 | 0.002 | 0.035 | 0.006 |
| 65 | 1.06 | 0.82 | 1.16 | 1.25 | 1.52 | 1.19 |
| 66 | 0.47 | 0.01 | 1.25 | 0.03 | 0.56 | 0.96 |
| 67 | 25.38 | 0.02 | 20.26 | 0.04 | 0.15 | 0.02 |

Table 139.

TABLE 140

Measured parameters in Tomato accessions (lines 7-12)

| Ecotype/Treatment | Line-7 | Line-8 | Line-9 | Line-10 | Line-11 | Line-12 |
|---|---|---|---|---|---|---|
| 1 | | | | 0.80 | 0.28 | 0.38 |
| 2 | 0.54 | 0.39 | 0.97 | 0.91 | 0.36 | 0.35 |
| 3 | 0.38 | 0.30 | 1.95 | 2.53 | 1.42 | 2.03 |
| 4 | | | | 0.89 | 0.35 | 0.63 |
| 5 | 0.75 | 0.58 | 1.27 | 1.34 | 0.52 | 0.57 |
| 6 | 0.61 | 0.66 | 2.70 | 0.70 | 2.64 | 4.67 |
| 7 | 0.55 | 0.36 | 0.95 | 0.80 | 0.34 | 0.61 |
| 8 | 0.58 | 0.55 | 1.06 | 0.49 | 1.31 | 1.36 |
| 9 | 0.61 | 0.64 | 0.95 | 0.51 | 1.17 | 1.94 |
| 10 | 1.84 | 1.52 | 1.91 | 1.86 | 2.47 | 2.62 |
| 11 | 3.21 | 2.75 | 1.81 | 3.77 | 1.89 | 1.93 |
| 12 | 1.95 | 1.76 | 1.72 | 1.92 | 2.21 | 3.73 |
| 13 | 0.67 | 2.17 | 0.38 | 1.27 | 0.84 | 1.51 |
| 14 | 2.07 | 1.51 | 2.41 | 2.06 | 0.38 | 1.64 |
| 15 | 1.39 | 3.28 | 0.91 | 2.62 | 0.32 | 2.48 |
| 16 | 0.44 | 0.47 | 1.59 | 0.39 | 0.32 | 0.45 |
| 17 | 0.29 | 1.02 | 0.60 | 0.49 | 0.27 | 0.68 |
| 18 | 0.21 | 0.31 | 0.66 | 0.19 | 0.85 | 0.27 |
| 19 | 0.19 | 0.24 | 0.45 | 0.17 | 0.12 | 0.15 |
| 20 | 0.06 | 0.10 | 0.27 | 0.05 | 0.31 | 0.12 |
| 21 | 6.66 | 4.39 | 3.90 | 5.29 | 6.32 | 5.11 |
| 22 | 6.16 | 5.65 | 4.39 | 4.44 | 6.77 | 7.42 |
| 23 | | | | 5.15 | 3.38 | 7.14 |
| 24 | 3.28 | 2.52 | 2.61 | 2.61 | 3.58 | 2.56 |
| 25 | 3.37 | 3.13 | 2.40 | 2.02 | 3.80 | 3.74 |
| 26 | | | | 2.55 | 2.04 | 4.17 |
| 27 | 0.01 | 0.01 | 0.06 | 0.01 | 0.01 | 0.02 |
| 28 | 0.004 | 0.006 | 0.017 | 0.004 | 0.015 | 0.006 |
| 29 | 0.08 | 0.06 | 0.14 | 0.06 | 0.06 | 0.12 |
| 30 | 0.058 | 0.060 | 0.062 | 0.083 | 0.047 | 0.046 |
| 31 | 0.06 | 0.04 | 0.08 | 0.05 | 0.05 | 0.10 |
| 32 | 0.055 | 0.054 | 0.045 | 0.079 | 0.033 | 0.040 |
| 33 | 15.00 | 6.00 | 17.00 | 13.00 | 8.67 | 9.33 |
| 34 | 10.00 | 7.00 | 9.00 | 8.00 | 5.33 | 8.00 |
| 35 | 0.98 | 4.94 | 0.88 | 0.79 | 2.12 | 1.29 |
| 36 | 1.47 | 4.24 | 1.67 | 1.29 | 3.44 | 1.50 |
| 37 | 14.67 | 29.67 | 15.00 | 10.33 | 18.33 | 12.00 |
| 38 | 1.50 | 0.86 | 1.89 | 1.63 | 1.63 | 1.17 |
| 39 | 64.71 | 75.25 | 66.23 | 63.21 | 56.77 | 35.96 |
| 40 | 73.21 | 62.50 | 67.21 | 75.76 | 62.82 | 70.69 |
| 41 | 1.13 | 0.83 | 1.01 | 1.20 | 1.11 | 1.97 |
| 42 | 67.16 | 66.07 | 69.57 | 69.30 | 100.00 | 57.66 |
| 43 | 1.04 | 0.88 | 1.05 | 1.10 | 1.76 | 1.60 |
| 44 | 0.79 | 0.92 | 0.94 | 1.36 | 1.44 | 1.50 |
| 45 | 405.55 | 299.32 | 86.19 | 182.32 | 160.18 | 90.10 |
| 46 | 106.29 | 123.14 | 104.99 | 111.88 | 307.95 | 419.37 |
| 47 | 58.50 | 51.10 | 40.00 | 47.60 | 57.90 | 48.30 |
| 48 | 30.04 | 35.50 | 24.81 | 40.77 | 47.47 | 26.06 |
| 49 | 37.87 | 38.43 | 26.49 | 30.07 | 32.89 | 17.35 |
| 50 | 44.70 | 53.70 | 35.70 | 58.80 | 47.50 | 45.20 |
| 51 | 0.76 | 1.05 | 0.89 | 1.24 | 0.82 | 0.94 |
| 52 | 748.01 | 453.96 | 164.85 | 338.30 | 396.00 | 236.15 |
| 53 | 340.73 | 339.11 | 190.14 | 421.79 | 581.33 | 807.51 |
| 54 | | | | 337.63 | 130.78 | 557.93 |
| 55 | 0.73 | 0.83 | 0.86 | 0.50 | 1.02 | 0.70 |
| 56 | 0.40 | 0.30 | 0.82 | 0.40 | 0.35 | 0.43 |
| 57 | 0.304 | 0.315 | 0.308 | 0.311 | 8.360 | 0.288 |
| 58 | 0.001 | 0.002 | 0.018 | 0.002 | 0.002 | 0.005 |
| 59 | 0.002 | 0.003 | 0.006 | 0.002 | 0.003 | 0.001 |
| 60 | 0.001 | 0.001 | 0.010 | 0.001 | 0.001 | 0.002 |
| 61 | 0.001 | 0.001 | 0.003 | 0.000 | 0.001 | 0.000 |
| 62 | 0.006 | 0.013 | 0.021 | 0.005 | 0.006 | 0.047 |
| 63 | 0.006 | 0.007 | 0.058 | 0.007 | 0.026 | 0.261 |
| 64 | 0.005 | 0.005 | 0.005 | 0.012 | 0.005 | 0.006 |
| 65 | 0.76 | 1.04 | 0.38 | 0.78 | 24.12 | 0.67 |
| 66 | 0.42 | 0.38 | 0.36 | 0.62 | 8.20 | 0.41 |
| 67 | 0.86 | 0.74 | 0.09 | 1.72 | 0.17 | 0.02 |

Table 140.

TABLE 141

Measured parameters in Tomato accessions (lines 13-18)

| Ecotype/Treatment | Line-13 | Line-14 | Line-15 | Line-16 | Line-17 | Line-18 |
|---|---|---|---|---|---|---|
| 1 | 0.63 | 2.86 | 1.16 | 4.40 | | |
| 2 | 0.57 | 4.38 | 2.02 | 8.13 | 0.87 | 3.66 |
| 3 | 1.39 | 2.27 | 0.45 | 0.42 | | |
| 4 | 2.27 | 7.40 | 2.94 | 11.60 | | |
| 5 | 0.94 | 6.17 | 3.67 | 11.33 | 1.06 | 6.87 |
| 6 | 2.17 | 0.49 | 0.34 | 0.75 | | |
| 7 | 0.94 | 0.68 | 0.40 | 1.44 | 0.46 | 1.07 |
| 8 | 0.51 | 0.71 | 0.31 | 0.47 | 2.65 | 0.38 |
| 9 | 0.35 | 1.06 | 0.21 | 0.48 | 1.72 | 0.34 |
| 10 | 1.08 | 1.17 | 0.92 | 1.09 | 4.04 | 1.21 |
| 11 | 2.14 | 1.65 | 3.01 | 2.29 | 1.53 | 3.17 |
| 12 | 0.75 | 1.76 | 0.63 | 1.11 | 2.62 | 1.09 |
| 13 | 0.98 | 1.34 | 0.38 | 0.84 | 1.15 | 0.73 |
| 14 | 0.41 | 1.21 | 4.59 | 1.70 | 0.49 | 1.93 |
| 15 | 0.41 | 1.62 | 1.76 | 1.42 | 0.57 | 1.41 |
| 16 | 0.14 | 0.40 | 1.44 | 0.50 | 0.41 | 0.66 |
| 17 | 0.14 | 0.53 | 0.55 | 0.41 | 0.47 | 0.48 |
| 18 | 0.35 | 0.33 | 0.31 | 0.29 | 0.83 | 0.34 |
| 19 | 0.12 | 0.25 | 0.61 | 0.31 | 0.09 | 0.35 |
| 20 | 0.14 | 0.17 | 0.09 | 0.11 | 0.35 | 0.10 |
| 21 | 4.72 | 6.83 | 7.10 | 8.21 | 6.40 | 5.92 |
| 22 | 6.71 | 5.87 | 4.16 | 10.29 | | |
| 23 | 5.48 | 8.62 | 6.35 | 6.77 | | |
| 24 | 2.48 | 3.43 | 3.30 | 3.69 | 3.47 | 1.97 |
| 25 | 2.98 | 3.22 | 2.09 | 5.91 | | |
| 26 | 3.09 | 4.69 | 3.87 | 2.91 | | |
| 27 | 0.00 | 0.01 | 0.04 | 0.01 | 0.01 | 0.02 |
| 28 | 0.008 | 0.006 | 0.008 | 0.005 | 0.017 | 0.009 |
| 29 | 0.03 | 0.05 | 0.06 | 0.04 | 0.16 | 0.05 |
| 30 | 0.057 | 0.036 | 0.080 | 0.044 | 0.047 | 0.095 |
| 31 | 0.03 | 0.04 | 0.02 | 0.03 | 0.14 | 0.03 |
| 32 | 0.049 | 0.030 | 0.072 | 0.039 | 0.031 | 0.085 |
| 33 | 12.67 | 6.67 | 9.33 | 8.00 | 19.00 | 5.33 |
| 34 | 7.67 | 9.00 | 10.67 | 9.00 | 5.67 | 19.33 |
| 35 | 1.61 | 1.90 | 1.36 | 1.42 | 0.88 | 1.22 |
| 36 | 2.65 | 1.41 | 1.19 | 1.26 | 2.94 | 0.34 |
| 37 | 20.33 | 12.67 | 12.67 | 11.33 | 16.67 | 6.50 |
| 38 | 1.65 | 0.74 | 0.88 | 0.89 | 3.35 | 0.28 |
| 39 | 77.62 | 100.00 | 63.16 | 75.13 | 72.83 | 76.47 |
| 40 | 55.75 | 75.22 | 63.68 | 62.31 | 72.12 | 74.51 |
| 41 | 0.72 | 0.75 | 1.01 | 0.83 | 0.99 | 0.97 |
| 42 | 90.79 | 68.00 | 59.65 | 72.17 | 74.07 | 99.08 |
| 43 | 1.17 | 0.68 | 0.94 | 0.96 | 1.02 | 1.30 |
| 44 | 1.05 | 0.56 | 1.48 | 0.84 | 0.79 | 1.37 |
| 45 | 160.99 | 379.03 | 531.08 | 650.68 | 140.04 | 317.12 |
| 46 | 365.81 | 212.93 | 84.94 | 469.87 | | |
| 47 | 43.60 | 54.50 | 41.60 | 59.10 | 49.70 | 37.20 |
| 48 | 35.38 | 30.60 | 38.97 | 37.46 | 28.47 | 39.04 |
| 49 | 33.82 | 54.47 | 26.25 | 44.43 | 36.17 | 28.45 |
| 50 | 39.00 | 45.00 | 65.30 | 51.90 | 38.40 | 39.40 |
| 51 | 0.89 | 0.83 | 1.57 | 0.88 | 0.77 | 1.06 |
| 52 | 174.58 | 441.78 | 489.18 | 707.80 | 565.93 | 384.77 |
| 53 | 784.06 | 351.80 | 255.78 | 1078.10 | | |
| 54 | 176.67 | 791.86 | 517.05 | 832.27 | | |
| 55 | 0.38 | 0.66 | 0.70 | 0.33 | 1.17 | 0.34 |
| 56 | 0.35 | 0.45 | 0.28 | 0.47 | 0.53 | 0.37 |
| 57 | 0.34 | 0.44 | 0.27 | 0.43 | 0.37 | 0.41 |
| 58 | 0.001 | 0.001 | 0.003 | 0.001 | 0.003 | 0.002 |
| 59 | 0.001 | 0.002 | 0.004 | 0.001 | | |
| 60 | 0.001 | 0.001 | 0.003 | 0.001 | 0.001 | 0.002 |
| 61 | 0.000 | 0.001 | 0.001 | 0.000 | | |
| 62 | 0.357 | 0.037 | 0.626 | | 0.024 | 0.191 |
| 63 | 0.029 | 0.005 | 0.003 | 0.009 | 0.048 | 0.008 |
| 64 | 0.30 | 0.14 | 0.04 | 0.09 | 0.01 | 0.19 |
| 65 | 0.97 | 0.99 | 0.95 | 0.91 | 0.69 | 1.11 |
| 66 | 0.91 | 0.67 | 0.38 | 1.31 | 0.32 | 1.19 |
| 67 | 10.50 | 27.89 | 11.79 | 9.98 | 0.19 | 24.37 |

Table 141: Provided are the values of each of the parameters (as described above) measured in tomato accessions (Seed ID) under all growth conditions. Growth conditions are specified in the experimental procedure section.

TABLE 142

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LGP107 | 0.73 | 1.67E−02 | 3 | 48 | LGP32 | 0.75 | 2.09E−02 | 2 | 32 |
| LGP32 | 0.86 | 1.54E−03 | 5 | 40 | LGP34 | 0.72 | 2.82E−02 | 1 | 32 |
| LGP34 | 0.79 | 6.53E−03 | 4 | 38 | LGP42 | 0.83 | 1.09E−02 | 2 | 22 |
| LGP34 | 0.74 | 2.35E−02 | 1 | 30 | LGP34 | 0.82 | 3.60E−03 | 4 | 29 |
| LGP34 | 0.79 | 6.61E−03 | 4 | 31 | LGP34 | 0.76 | 1.06E−02 | 4 | 33 |
| LGP34 | 0.75 | 1.30E−02 | 4 | 56 | LGP34 | 0.72 | 1.82E−02 | 4 | 8 |
| LGP42 | 0.82 | 1.26E−02 | 2 | 46 | LGP42 | 0.87 | 4.97E−03 | 2 | 53 |
| LGP42 | 0.85 | 7.98E−03 | 2 | 25 | LGP42 | 0.83 | 2.84E−03 | 2 | 55 |
| LYD892 | 0.88 | 6.82E−04 | 1 | 63 | LYD892 | 0.73 | 1.76E−02 | 5 | 9 |
| LYD892 | 0.71 | 2.23E−02 | 3 | 50 | LYD892 | 0.88 | 7.09E−04 | 2 | 55 |
| LYD892 | 0.78 | 7.71E−03 | 2 | 63 | LYD892 | 0.84 | 2.64E−03 | 1 | 55 |
| LYD893 | 0.82 | 6.41E−03 | 1 | 20 | LYD893 | 0.95 | 2.49E−05 | 5 | 35 |
| LYD894 | 0.71 | 4.93E−02 | 2 | 22 | LYD894 | 0.85 | 7.34E−03 | 2 | 46 |
| LYD894 | 0.85 | 1.90E−03 | 5 | 9 | LYD895 | 0.81 | 1.53E−02 | 2 | 61 |
| LYD894 | 0.78 | 2.37E−02 | 2 | 53 | LYD894 | 0.71 | 2.22E−02 | 6 | 12 |
| LYD894 | 0.84 | 2.34E−03 | 6 | 9 | LYD894 | 0.79 | 6.15E−03 | 5 | 12 |
| LYD895 | 0.88 | 7.77E−04 | 5 | 37 | LYD895 | 0.79 | 6.33E−03 | 5 | 36 |
| LYD895 | 0.89 | 6.48E−04 | 4 | 50 | LYD895 | 0.90 | 3.33E−04 | 5 | 35 |
| LYD895 | 0.73 | 1.66E−02 | 4 | 19 | LYD895 | 0.73 | 1.63E−02 | 4 | 14 |
| LYD895 | 0.84 | 2.57E−03 | 4 | 51 | LYD895 | 0.73 | 2.49E−02 | 4 | 62 |
| LYD897 | 0.70 | 2.38E−02 | 4 | 52 | LYD898 | 0.79 | 7.08E−03 | 1 | 55 |
| LYD898 | 0.80 | 5.34E−03 | 6 | 12 | LYD899 | 0.77 | 1.49E−02 | 2 | 30 |
| LYD899 | 0.90 | 1.06E−03 | 2 | 32 | LYD899 | 0.73 | 1.56E−02 | 6 | 40 |
| LYD901 | 0.75 | 1.16E−02 | 4 | 27 | LYD901 | 0.70 | 2.34E−02 | 4 | 60 |
| LYD901 | 0.72 | 1.79E−02 | 4 | 16 | LYD902 | 0.75 | 1.21E−02 | 3 | 48 |
| LYD902 | 0.72 | 1.88E−02 | 2 | 49 | LYD902 | 0.74 | 1.34E−02 | 5 | 9 |
| LYD903 | 0.72 | 1.85E−02 | 6 | 35 | LYD903 | 0.91 | 2.11E−04 | 6 | 37 |
| LYD903 | 0.90 | 3.97E−04 | 6 | 36 | LYD903 | 0.73 | 1.59E−02 | 5 | 65 |

TABLE 142-continued

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LYD903 | 0.72 | 1.77E−02 | 5 | 57 | LYD904 | 0.73 | 1.71E−02 | 5 | 65 |
| LYD904 | 0.81 | 4.71E−03 | 5 | 66 | LYD904 | 0.74 | 1.42E−02 | 5 | 57 |
| LYD905 | 0.84 | 2.62E−03 | 3 | 58 | LYD906 | 0.88 | 1.93E−03 | 1 | 32 |
| LYD905 | 0.81 | 4.29E−03 | 2 | 55 | LYD905 | 0.88 | 7.46E−04 | 2 | 39 |
| LYD906 | 0.87 | 2.55E−03 | 1 | 30 | LYD906 | 0.72 | 2.85E−02 | 2 | 30 |
| LYD906 | 0.71 | 2.04E−02 | 1 | 11 | LYD906 | 0.75 | 1.25E−02 | 1 | 34 |
| LYD907 | 0.81 | 1.58E−02 | 2 | 59 | LYD907 | 0.75 | 3.19E−02 | 2 | 61 |
| LYD907 | 0.77 | 9.12E−03 | 6 | 9 | LYD907 | 0.73 | 1.61E−02 | 5 | 9 |
| LYD907 | 0.70 | 2.33E−02 | 2 | 63 | LYD907 | 0.71 | 2.03E−02 | 1 | 63 |
| LYD908 | 0.71 | 2.14E−02 | 1 | 34 | LYD909 | 0.72 | 1.98E−02 | 6 | 35 |
| LYD910 | 0.84 | 2.18E−03 | 4 | 33 | LYD911 | 0.76 | 1.03E−02 | 3 | 42 |
| LYD910 | 0.72 | 1.98E−02 | 2 | 55 | LYD910 | 0.75 | 1.31E−02 | 1 | 55 |
| LYD911 | 0.74 | 3.67E−02 | 2 | 59 | LYD911 | 0.75 | 1.99E−02 | 2 | 30 |
| LYD911 | 0.82 | 6.67E−03 | 2 | 32 | LYD912 | 0.74 | 2.41E−02 | 1 | 20 |
| LYD912 | 0.71 | 2.17E−02 | 3 | 24 | LYD913 | 0.78 | 2.36E−02 | 2 | 53 |
| LYD913 | 0.87 | 1.05E−03 | 5 | 57 | LYD914 | 0.72 | 1.86E−02 | 4 | 45 |
| LYD913 | 0.88 | 7.68E−04 | 5 | 65 | LYD913 | 0.81 | 4.57E−03 | 5 | 66 |
| LYD914 | 0.72 | 1.89E−02 | 5 | 64 | LYD915 | 0.76 | 2.80E−02 | 2 | 22 |
| LYD914 | 0.71 | 2.07E−02 | 4 | 2 | LYD914 | 0.70 | 2.35E−02 | 5 | 67 |
| LYD915 | 0.71 | 5.07E−02 | 2 | 46 | LYD915 | 0.75 | 3.07E−02 | 2 | 25 |
| LYD915 | 0.81 | 1.40E−02 | 2 | 6 | LYD915 | 0.72 | 1.78E−02 | 6 | 12 |
| LYD917 | 0.77 | 2.56E−02 | 2 | 6 | LYD917 | 0.77 | 8.86E−03 | 4 | 2 |
| LYD917 | 0.80 | 5.64E−03 | 4 | 5 | LYD917 | 0.77 | 8.74E−03 | 4 | 7 |
| LYD918 | 0.83 | 9.98E−03 | 2 | 59 | LYD918 | 0.70 | 3.57E−02 | 2 | 20 |
| LYD918 | 0.76 | 1.75E−02 | 2 | 28 | LYD918 | 0.80 | 1.62E−02 | 2 | 61 |
| LYD918 | 0.89 | 6.15E−04 | 5 | 35 | LYD919 | 0.75 | 3.36E−02 | 2 | 3 |
| LYD921 | 0.72 | 4.55E−02 | 2 | 22 | LYD921 | 0.78 | 2.23E−02 | 2 | 25 |
| LYD922 | 0.88 | 1.72E−03 | 2 | 30 | LYD922 | 0.78 | 1.34E−02 | 2 | 32 |
| LYD922 | 0.77 | 1.42E−02 | 1 | 32 | LYD922 | 0.80 | 9.23E−03 | 1 | 30 |
| LYD922 | 0.71 | 2.23E−02 | 5 | 35 | LYD923 | 0.72 | 1.85E−02 | 2 | 47 |
| LYD923 | 0.72 | 1.87E−02 | 6 | 12 | LYD923 | 0.77 | 9.81E−03 | 6 | 9 |
| LYD924 | 0.80 | 5.50E−03 | 3 | 7 | LYD924 | 0.71 | 4.79E−02 | 2 | 46 |
| LYD924 | 0.74 | 1.53E−02 | 3 | 2 | LYD924 | 0.78 | 8.34E−03 | 3 | 5 |
| LYD924 | 0.76 | 2.93E−02 | 2 | 53 | LYD924 | 0.78 | 7.44E−03 | 6 | 65 |
| LYD924 | 0.80 | 5.55E−03 | 6 | 66 | LYD924 | 0.78 | 7.83E−03 | 6 | 57 |
| LYD924 | 0.73 | 1.68E−02 | 4 | 48 | LYD924 | 0.74 | 1.47E−02 | 4 | 44 |
| LYD925 | 0.97 | 2.60E−06 | 5 | 65 | LYD925 | 0.95 | 3.34E−05 | 5 | 66 |
| LYD925 | 0.97 | 5.17E−06 | 5 | 57 | | | | | |

Table 142. Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal conditions across tomato ecotypes. P = p value.

Example 18

Production of Cotton Transcriptome and High Throughput Correlation Analysis with Yield and ABST Related Parameters Using 60K Cotton Oligonucleotide Micro-Arrays In order to produce a high throughput correlation analysis between plant phenotype and gene expression level, the present inventors utilized a cotton oligonucleotide microarray, produced by Agilent Technologies [chem. (dot) agilent (dot) com/Scripts/PDS (dot) asp?1Page=50879]. The array oligonucleotide represents about 60,000 cotton genes and transcripts. In order to define correlations between the levels of RNA expression with ABST and yield and components or vigor related parameters, various plant characteristics of 13 different cotton ecotypes were analyzed and further used for RNA expression analysis. The correlation between the RNA levels and the characterized parameters was analyzed using Pearson correlation test [davidmlane (dot) com/hyperstat/A34739 (dot) html].

Correlation of Cotton Varieties Across Ecotypes Grown Under Regular Growth Conditions Experimental Procedures 13 Cotton ecotypes were grown in 5-11 repetitive plots, in field. Briefly, the growing protocol was as follows: cotton plants were grown in the field using commercial fertilization and irrigation protocols [580,000 liter water per dunam (1000 square meters) per entire growth period, and fertilization of 24 units of nitrogen, 12 units of phosphorous ($P_2O_5$) and 12 units of potassium ($K_2O$) per entire growth period; Plot size of 5 meter long, two rows, 8 plants per meter].

It should be noted that one unit of phosphorous refers to one kg of $P_2O_5$ per dunam; and that one unit of potassium refers to one kg of $K_2O$ per dunam;

Analyzed Cotton tissues—Six tissues [mature leaf, lower and upper main stem, flower, main mature boll and fruit] from plants growing under normal conditions were sampled and RNA was extracted as described above. Each microarray expression information tissue type has received a Set ID as summarized in Table 143 below.

TABLE 143

Sorghum transcriptome expression sets

| Expression Set | Set ID |
|---|---|
| Mature leaf at reproductive stage under normal conditions | 1 |
| Lower main stem at reproductive stage under normal growth conditions | 2 |
| Upper main stem at reproductive stage under normal growth conditions | 3 |
| Main flower at reproductive stage under normal growth conditions | 4 |
| Fruit at 10 DPA at reproductive stage under normal growth conditions | 5 |
| Main mature boll at reproductive stage under normal growth conditions | 6 |

Table 143: Provided are the cotton transcriptome expression sets. Flag leaf = Full expanded leaf in the upper canopy; Lower main stem = the main stem adjacent to main mature boll, Upper main stem = the main stem adjacent to the main flower, Main flower = reproductive organ on the third position on the main stem (position 3), Fruit at 10DPA = reproductive organ ten days after anthesis on the main stem (position 2), Main mature boll = reproductive organ on the first position on the main stem (position 1).

Cotton yield components and vigor related parameters assessment—13 Cotton ecotypes in 5-11 repetitive plots, each plot containing approximately 80 plants were grown in field. Plants were regularly fertilized and watered during plant growth until harvesting (as recommended for commercial growth). Plants were continuously phenotyped during the growth period and at harvest (Table 144). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The following parameters were measured and collected:

% Canopy coverage (10 DPA), (F)—percent Canopy coverage 10 days post anthesis (DPA) and at flowering stage. The % Canopy coverage is calculated using Formula XXXII above.

Leaf area (10 DPA) [cm$^2$]—Total green leaves area 10 days post anthesis.

Leaf mass fraction (10 DPA) [cm$^2$/g]—leaf mass fraction 10 days post anthesis.

The leaf mass fraction is calculated using Formula XXXIII above.

SPAD—Plants were characterized for SPAD rate during growing period at 2 time points (pre-flowering and 17 days post anthesis). Chlorophyll content was determined using a Minolta SPAD 502 chlorophyll meter and measurement was performed 64 days post sowing. SPAD meter readings were done on young fully developed leaf. Four measurements per leaf were taken per plot.

PAR_LAI (10DPA)—Photosynthetically active radiation 10 days post anthesis.

Shoot FW and DW [gr]—Shoot fresh weight and shoot dry weight at vegetative stage and 10 days post anthesis, after drying at 70° C. in oven for 48 hours. Total weight of 3 plants in a plot.

Plant height (H)[cm]—plants were measured for their height at harvest using a measuring tape. Height of main stem was measured from ground to apical meristem base. Average of eight plants per plot.

Lower stem width (H)[mm]—This parameter was measured at harvest. Lower internodes from 8 plants per plot were separated from the plant and the diameter was measured using a caliber. The average internode width per plant was calculated by dividing the total stem width by the number of plants.

Upper stem width (H)[mm]—This parameter was measured at harvest. Upper internodes from 8 plants per plot were separated from the plant and the diameter was measured using a caliber. The average internode width per plant was calculated by dividing the total stem width by the number of plants.

Relative growth rate: the relative growth rate (RGR) of Plant Height (Formula III above) RGR of SPAD (Formula IV) as described above.

Reproductive period duration—number of days from flowering to harvest for each plot.

Number of lateral branches with open bolls (H)—count of number of lateral branches with open bolls at harvest, average of eight plants per plot.

Number of nodes with open bolls (MS) (H)—count of number of nodes with open bolls on main stem at harvest, average of eight plants per plot.

Closed Bolls number per plant (SP)—Average closed bolls number per plant from selected plants.

Closed Bolls number per plant (RP)—Average closed bolls number per plant from the rest of the plot.

Open bolls number per plant (SP)—Average open bolls number per plant from selected plants. average of eight plants per plot.

Bolls number per plant (RP)—Average bolls number per plant from the rest of the plot.

Bolls number in position 1 and position 3—Average bolls number from the first fruit node at position 1 and position 3 divided by plant number, 25 days post anthesis.

Total Bolls yield (SP)[gr]—Bolls fresh weight at harvest of selected plant.

Calculated Avr Bolls FW (MB) pO_1 and po_3 (H)[gr]—Calculated average bolls fresh weight on main branch at positions 1 (po_1) and 3 (po_3).

Calculated Avr Fiber yield (MB) po_1 and po_3 (H) [gr]—Weight of the fiber on the main branch in position 1 and position 3 at harvest.

Fiber yield per boll (RP)[gr]—Total fiber weight in plot divided by the number of bolls.

Fiber yield per plant (RP)[gr]—Total fiber weight in plot divided by the number of plants.

Fiber Length (RP)—Measure Fiber Length in inch from the rest of the plot.

Fiber Length Position 3 (SP)—Fiber length at position 3 from the selected plants. Measure Fiber Length in inch.

Fiber Length Position 1 (SP)—Fiber length at position 1 from the selected plants. Measure Fiber Length in inch.

Fiber Strength (RP)—Fiber Strength from the rest of the plot, measured in grams per denier.

Fiber Strength Position 3 (SP)—Fiber strength at position 3 from the selected plants, measured in grams per denier.

Fiber Strength Position 1 (SP)—Fiber strength at position 1 from the selected plants. Measured in grams per denier.

Micronaire (RP)—fiber fineness and maturity from the rest of the plot. The scale that was used was 3.7-4.2—for Premium; 4.3-4.9—Base Range; above 5—Discount Range.

Micronaire Position 3 (SP)—fiber fineness and maturity from position 3 from the selected plants. The scale that was used was 3.7-4.2—for Premium; 4.3-4.9—Base Range; above 5-Discount Range.

Micronaire Position 1 (SP)—fiber fineness and maturity from position 1 from the selected plants. The scale that was used was 3.7-4.2—for Premium; 4.3-4.9—Base Range; above 5—Discount Range.

1000 seed weight [gr]—At the end of the experiment all seeds from all plots were collected and weighted and the weight of 1000 seeds was calculated.

Seeds yield per plant (RP) [gr]—Total weight of seeds in plot divided in plants number.

Calculated Avr Seeds number (MB) po_1/po_3 (H)—Calculated Average Seeds number on main stem at position 1 and position 3 at harvest.

Calculated Avr Seeds yield (MB) po_1/po_3 (H)[gr]—Calculated Average

Seeds yield on main stem at position 1 and position 3 at harvest.

Experimental Results 13 different cotton varieties were grown and characterized for different parameters: The average for each of the measured parameter was calculated using the JMP software (Tables 145-146) and a subsequent correlation analysis between the various transcriptome sets (Table 143) and the average parameters, was conducted (Table 147). Results were then integrated to the database.

TABLE 144

| Cotton correlated parameters (vectors) | |
|---|---|
| Correlated parameter with | Correlation ID |
| % Canopy coverage (10DPA) | 1 |
| 1000 seeds weight (RP) [gr] | 2 |
| Bolls num per plant (RP) | 3 |
| Closed Bolls num per plant (RP) | 4 |
| Closed Bolls num per plant (SP) | 5 |
| Fiber Length (RP) | 6 |
| Fiber Length Position 3 (SP) | 7 |
| Fiber Strength (RP) | 8 |
| Fiber Strength Position 3 (SP) | 9 |
| Fiber yield per boll (RP) [gr] | 10 |
| Fiber yield per plant (RP) [gr] | 11 |
| Leaf area (10DPA) [cm$^2$] | 12 |

TABLE 144-continued

| Cotton correlated parameters (vectors) | |
|---|---|
| Correlated parameter with | Correlation ID |
| Lower Stem width (H) [mm] | 13 |
| Micronaire (RP) | 14 |
| Micronaire Position 3 (SP) | 15 |
| Num of lateral branches with open bolls (H) | 16 |
| Num of nodes with open bolls (MS) (H) | 17 |
| Open Bolls num per plant (SP) | 18 |
| PAR_LAI (10 DPA) | 19 |
| Plant height (H) [cm] | 20 |
| Plant height growth | 21 |
| Reproductive period duration | 22 |
| SPAD (17 DPA) | 23 |
| SPAD (pre F) | 24 |
| SPAD rate | 25 |
| Seeds yield per plant (RP) [gr] | 26 |
| Shoot DW (10 DPA) [gr] | 27 |
| Shoot DW (V) [gr] | 28 |
| Shoot FW (10 DPA) [gr] | 29 |
| Shoot FW (V) [gr] | 30 |
| Total Bolls yield (SP) [gr] | 31 |
| Upper Stem width (H) [mm] | 32 |
| bolls num in position 1 | 33 |
| bolls num in position 3 | 34 |
| estimated Avr Bolls FW (MB) po_1 (H) [gr] | 35 |
| estimated Avr Bolls FW (MB) po_3 (H) [gr] | 36 |
| estimated Avr Fiber yield (MB) po_1 (H) [gr] | 37 |
| estimated Avr Fiber yield (MB) po_3 (H) [gr] | 38 |
| estimated Avr Seeds num (MB) po_1 (H) | 39 |
| estimated Avr Seeds num (MB) po_3 (H) | 40 |
| estimated Avr Seeds yield (MB) po_1 (H) [gr] | 41 |
| estimated Avr Seeds yield (MB) po_3 (H) [gr] | 42 |
| leaf mass fraction (10DPA) [cm$^2$/g] | 43 |

Table 144. Provided are the Cotton correlated parameters (vectors). "gr." = grams; "SPAD" = chlorophyll levels; "FW" = Plant Fresh weight; "normal" = standard growth conditions.

TABLE 145

Measured parameters in Cotton accessions (1-7)

| Ecotype/Treatment | Line-1 | Line-2 | Line-3 | Line-4 | Line-5 | Line-6 | Line-7 |
|---|---|---|---|---|---|---|---|
| 1 | 84.01 | 94.86 | 92.93 | 89.23 | 84.88 | 87.15 | 79.89 |
| 2 | 105.24 | 113.64 | 98.49 | 84.74 | 111.74 | 82.47 | 91.64 |
| 3 | 11.01 | 19.11 | 11.83 | 15.49 | 22.62 | 11.78 | 13.45 |
| 4 | 4.23 | NA | NA | NA | NA | NA | 4.56 |
| 5 | 5.55 | 2.08 | 3.39 | 2.09 | 3.07 | 2.41 | 5.89 |
| 6 | 1.16 | 1.28 | 1.15 | 1.12 | 1.41 | 1.07 | 0.90 |
| 7 | 1.15 | 1.30 | 1.14 | 1.10 | 1.44 | 0.96 | 0.84 |
| 8 | 28.80 | 34.47 | 25.88 | 29.20 | 39.66 | 22.60 | 22.58 |
| 9 | 29.60 | 36.55 | 26.17 | 29.63 | 39.53 | 20.10 | 21.57 |
| 10 | 2.30 | 1.37 | 2.22 | 1.81 | 1.12 | 0.40 | 1.80 |
| 11 | 25.18 | 26.00 | 25.37 | 27.87 | 25.35 | 4.67 | 24.02 |
| 12 | 7007.67 | 6622.34 | 5544.74 | 8196.02 | 8573.30 | 8155.29 | 5291.27 |
| 13 | 12.79 | 13.71 | 11.83 | 12.38 | 12.97 | 10.92 | 12.97 |
| 14 | 4.31 | 3.63 | 3.95 | 4.37 | 4.10 | 6.05 | 5.01 |
| 15 | 4.57 | 3.89 | 3.99 | 4.71 | 4.75 | 5.69 | 5.25 |
| 16 | 1.02 | 1.46 | 0.81 | 0.96 | 1.21 | 1.69 | 1.29 |
| 17 | 8.15 | 10.90 | 9.00 | 11.04 | 10.14 | 7.85 | 8.48 |
| 18 | 11.98 | 22.56 | 11.80 | 18.75 | 27.65 | 16.42 | 15.00 |
| 19 | 5.67 | 6.87 | 6.45 | 5.86 | 5.61 | 6.59 | 4.09 |
| 20 | 112.80 | 110.77 | 100.59 | 115.45 | 103.26 | 98.52 | 121.91 |
| 21 | 1.86 | 2.00 | 1.73 | 1.72 | 1.66 | 1.72 | 2.09 |
| 22 | 121.33 | 108.11 | 108.00 | 103.80 | 102.88 | 108.00 | 126.00 |
| 23 | 34.29 | 33.52 | 31.41 | 29.66 | 37.10 | 27.43 | 33.39 |
| 24 | 32.13 | 35.30 | 35.99 | 35.80 | 35.03 | 32.92 | 35.89 |
| 25 | 0.04 | −0.06 | −0.26 | −0.22 | 0.10 | −0.29 | −0.14 |
| 26 | 32.49 | 34.86 | 32.48 | 35.06 | 36.32 | 26.74 | 33.06 |
| 27 | 169.15 | 183.58 | 171.09 | 172.70 | 190.03 | 149.03 | 193.14 |
| 28 | 39.20 | 64.68 | 44.79 | 38.06 | 46.23 | 36.68 | 48.20 |
| 29 | 842.47 | 792.64 | 804.23 | 766.97 | 745.20 | 725.93 | 922.57 |
| 30 | 168.94 | 256.04 | 194.76 | 155.69 | 154.56 | 172.13 | 193.28 |
| 31 | 505.37 | 564.21 | 544.17 | 585.47 | 536.54 | 317.18 | 488.33 |
| 32 | 3.02 | 3.64 | 3.32 | 3.13 | 3.23 | 2.73 | 2.80 |

TABLE 145-continued

Measured parameters in Cotton accessions (1-7)

| Ecotype/Treatment | Line-1 | Line-2 | Line-3 | Line-4 | Line-5 | Line-6 | Line-7 |
|---|---|---|---|---|---|---|---|
| 33 | 5.00 | 5.00 | 5.00 | 5.00 | 5.00 | 5.00 | 5.00 |
| 34 | 5.00 | 5.00 | 5.00 | 5.00 | 5.00 | 5.00 | 5.00 |
| 35 | 6.62 | 4.88 | 7.08 | 5.34 | 4.08 | 3.58 | 5.66 |
| 36 | 6.42 | 2.93 | 5.95 | 4.16 | 2.72 | 2.73 | 5.13 |
| 37 | 2.53 | 1.88 | 2.69 | 2.02 | 1.50 | 0.38 | 2.04 |
| 38 | 2.46 | 1.13 | 2.34 | 1.69 | 1.06 | 0.50 | 1.87 |
| 39 | 31.56 | 24.16 | 36.01 | 31.31 | 20.94 | 32.59 | 30.77 |
| 40 | 31.23 | 15.50 | 33.29 | 26.13 | 14.87 | 31.25 | 32.63 |
| 41 | 3.33 | 2.70 | 3.83 | 2.99 | 2.43 | 3.02 | 3.03 |
| 42 | 3.29 | 1.58 | 3.06 | 2.19 | 1.64 | 2.29 | 2.76 |
| 43 | 41.10 | 36.48 | 33.99 | 47.95 | 44.56 | 54.74 | 28.14 |

Table 145. Provided are the values of each of the parameters (as described above) measured in Cotton accessions (ecotype) under normal conditions. Growth conditions are specified in the experimental procedure section.

TABLE 146

Additional measured parameters in Cotton accessions (8-13)

| Ecotype/Treatment | Line-8 | Line-9 | Line-10 | Line-11 | Line-12 | Line-13 |
|---|---|---|---|---|---|---|
| 1 | 85.19 | 83.55 | 84.53 | 95.90 | 95.92 | 83.89 |
| 2 | 116.68 | 99.58 | 99.55 | 97.72 | 102.72 | 109.95 |
| 3 | 21.94 | 13.92 | 11.56 | 17.33 | 14.98 | 12.15 |
| 4 | NA | NA | 3.16 | 1.11 | NA | NA |
| 5 | 2.34 | 3.75 | 3.31 | 1.84 | 2.74 | 3.09 |
| 6 | 1.38 | 1.18 | 1.12 | 1.12 | 1.18 | 1.18 |
| 7 | 1.41 | 1.14 | 1.07 | 1.11 | 1.20 | 1.20 |
| 8 | 42.63 | 28.87 | 25.87 | 28.98 | 30.82 | 29.77 |
| 9 | 42.70 | 28.38 | 23.67 | 30.30 | 31.97 | 30.53 |
| 10 | 1.24 | 2.23 | 1.99 | 1.18 | 1.74 | 2.39 |
| 11 | 26.64 | 30.80 | 23.14 | 20.49 | 25.97 | 29.14 |
| 12 | 8854.54 | 5650.67 | 6003.34 | 6691.84 | 9004.97 | 7268.00 |
| 13 | 13.07 | 14.26 | 11.84 | 14.48 | 12.57 | 14.00 |
| 14 | 3.88 | 3.98 | 4.10 | 4.55 | 4.76 | 4.93 |
| 15 | 4.48 | 4.19 | 4.51 | 4.21 | 4.25 | 4.74 |
| 16 | 1.13 | 0.80 | 0.58 | 0.13 | 0.15 | 0.71 |
| 17 | 11.29 | 10.83 | 8.73 | 12.33 | 9.19 | 10.65 |
| 18 | 30.29 | 17.90 | 12.40 | 19.56 | 14.67 | 15.67 |
| 19 | 5.63 | 5.62 | 5.33 | 7.41 | 7.54 | 5.51 |
| 20 | 102.22 | 127.29 | 105.85 | 151.27 | 117.64 | 119.24 |
| 21 | 1.63 | 2.07 | 1.86 | 1.57 | 1.87 | 1.94 |
| 22 | 102.71 | 104.36 | 126.00 | 145.17 | 109.50 | 106.17 |
| 23 | 33.79 | 31.91 | 32.87 | 22.08 | 28.07 | 31.13 |
| 24 | 33.63 | 35.26 | 38.12 | 32.77 | 34.44 | 35.33 |
| 25 | −0.08 | −0.13 | −0.24 | −0.51 | −0.24 | −0.24 |
| 26 | 39.54 | 39.68 | 30.15 | 47.61 | 37.79 | 35.85 |
| 27 | 196.45 | 199.76 | 179.43 | 134.30 | 198.46 | 165.53 |
| 28 | 50.81 | 51.71 | 39.70 | 35.34 | 42.12 | 42.05 |
| 29 | 802.23 | 861.63 | 930.97 | 591.63 | 911.42 | 791.81 |
| 30 | 230.40 | 176.68 | 176.53 | 163.68 | 164.66 | 170.94 |
| 31 | 620.54 | 715.10 | 421.32 | 531.77 | 405.27 | 715.72 |
| 32 | 2.99 | 3.45 | 2.88 | 3.40 | 3.28 | 3.29 |
| 33 | 5.00 | 5.00 | 5.00 | NA | 5.00 | 5.00 |
| 34 | 5.00 | 5.00 | 5.00 | 5.00 | 5.00 | 5.00 |
| 35 | 3.13 | 6.37 | 6.14 | NA | 4.95 | 6.95 |
| 36 | 3.31 | 4.71 | 5.44 | 4.14 | 4.60 | 6.25 |
| 37 | 1.14 | 2.47 | 2.29 | NA | 1.77 | 2.92 |
| 38 | 1.19 | 1.91 | 2.02 | 1.12 | 1.65 | 2.65 |
| 39 | 15.45 | 31.45 | 29.29 | NA | 25.62 | 34.56 |
| 40 | 18.21 | 25.13 | 28.98 | 29.15 | 25.92 | 32.67 |
| 41 | 1.87 | 3.21 | 3.00 | NA | 2.82 | 3.87 |
| 42 | 2.06 | 2.25 | 2.65 | 2.73 | 2.55 | 3.56 |
| 43 | 45.41 | 28.05 | 33.48 | 47.94 | 45.95 | 44.01 |

Table 146: Provided are the values of each of the parameters (as described above) measured in Cotton accessions (ecotype) under normal conditions. Growth conditions are specified in the experimental procedure section.

TABLE 147

Correlation between the expression level of selected genes of some embodiments of the invention in various tissues and the phenotypic performance under normal conditions across Cotton accessions

| Gene Name | R | P value | Exp. set | Corr. Set ID | Gene Name | R | P value | Exp. set | Corr. Set ID |
|---|---|---|---|---|---|---|---|---|---|
| LGP47 | 0.81 | 2.69E−02 | 2 | 32 | LGP47 | 0.72 | 6.94E−02 | 2 | 19 |
| LGP47 | 0.72 | 7.83E−03 | 4 | 18 | LYD838 | 0.73 | 6.08E−02 | 2 | 32 |
| LGP47 | 0.92 | 3.56E−03 | 1 | 42 | LYD841 | 0.80 | 1.99E−03 | 6 | 37 |
| LGP47 | 0.99 | 1.97E−05 | 1 | 14 | LYD843 | 0.75 | 3.02E−03 | 6 | 7 |
| LGP47 | 0.74 | 8.97E−02 | 1 | 39 | LYD843 | 0.81 | 8.32E−04 | 6 | 8 |
| LGP47 | 0.78 | 3.70E−02 | 1 | 36 | LYD843 | 0.77 | 1.90E−03 | 6 | 6 |
| LGP47 | 0.84 | 1.80E−02 | 2 | 1 | LYD850 | 0.99 | 8.98E−06 | 1 | 25 |
| LGP47 | 0.72 | 8.12E−03 | 4 | 6 | LYD850 | 0.87 | 2.40E−04 | 3 | 28 |
| LGP58 | 0.70 | 7.84E−02 | 2 | 43 | LYD843 | 0.74 | 6.27E−03 | 4 | 9 |
| LGP58 | 0.71 | 9.10E−03 | 3 | 12 | LYD849 | 0.83 | 2.06E−02 | 1 | 38 |
| LGP58 | 0.71 | 6.90E−03 | 6 | 15 | LYD845 | 0.71 | 7.52E−02 | 1 | 27 |
| LGP65 | 0.83 | 2.69E−03 | 5 | 43 | LGP65 | 0.85 | 1.65E−03 | 5 | 14 |
| LGP65 | 0.70 | 1.06E−02 | 4 | 7 | LYD841 | 0.73 | 6.18E−02 | 2 | 32 |
| LGP65 | 0.81 | 1.37E−03 | 4 | 8 | LYD843 | 0.71 | 7.17E−02 | 2 | 43 |
| LGP65 | 0.74 | 5.88E−02 | 1 | 38 | LYD844 | 0.76 | 4.13E−03 | 6 | 39 |
| LGP65 | 0.82 | 4.61E−02 | 1 | 35 | LYD847 | 0.79 | 2.01E−03 | 6 | 35 |
| LGP65 | 0.83 | 3.94E−02 | 1 | 37 | LYD849 | 0.79 | 1.45E−03 | 6 | 10 |

TABLE 147-continued

Correlation between the expression level of selected genes of some embodiments of the invention in various tissues and the phenotypic performance under normal conditions across Cotton accessions

| Gene Name | R | P value | Exp. set | Corr. Set ID | Gene Name | R | P value | Exp. set | Corr. Set ID |
|---|---|---|---|---|---|---|---|---|---|
| LGP65 | 0.78 | 3.87E−02 | 2 | 22 | LYD850 | 0.77 | 4.12E−02 | 1 | 6 |
| LGP65 | 0.75 | 4.92E−03 | 4 | 9 | LYD837 | 0.74 | 5.67E−03 | 3 | 3 |
| LYD835 | 0.77 | 4.48E−02 | 1 | 42 | LYD849 | 0.77 | 3.60E−03 | 6 | 37 |
| LYD835 | 0.77 | 4.48E−02 | 1 | 40 | LYD842 | 0.71 | 6.52E−03 | 6 | 38 |
| LYD835 | 0.75 | 4.99E−02 | 2 | 30 | LGP65 | 0.86 | 1.22E−02 | 1 | 21 |
| LYD836 | 0.73 | 1.74E−02 | 5 | 43 | LYD836 | 0.80 | 5.25E−03 | 5 | 14 |
| LYD836 | 0.85 | 1.43E−02 | 1 | 42 | LGP47 | 0.74 | 9.48E−02 | 1 | 35 |
| LYD836 | 0.72 | 6.81E−02 | 1 | 14 | LGP47 | 0.85 | 1.57E−02 | 1 | 40 |
| LYD836 | 0.93 | 7.69E−03 | 1 | 39 | LGP47 | 0.78 | 7.02E−02 | 1 | 37 |
| LYD836 | 0.79 | 3.48E−02 | 1 | 36 | LGP47 | 0.79 | 6.19E−02 | 1 | 41 |
| LYD836 | 0.74 | 8.66E−03 | 3 | 39 | LYD849 | 0.83 | 4.00E−02 | 1 | 35 |
| LYD836 | 0.73 | 7.59E−03 | 4 | 1 | LYD843 | 0.72 | 7.88E−03 | 3 | 30 |
| LYD837 | 0.78 | 3.76E−02 | 2 | 2 | LYD837 | 0.70 | 7.80E−02 | 2 | 6 |
| LYD837 | 0.78 | 2.58E−03 | 3 | 9 | LYD849 | 0.78 | 6.82E−02 | 1 | 37 |
| LYD837 | 0.90 | 5.68E−03 | 1 | 32 | LYD838 | 0.70 | 1.13E−02 | 3 | 28 |
| LYD838 | 0.77 | 4.31E−02 | 2 | 19 | LYD838 | 0.89 | 7.87E−03 | 2 | 1 |
| LYD838 | 0.72 | 5.60E−03 | 6 | 18 | LYD849 | 0.81 | 1.41E−03 | 4 | 8 |
| LYD838 | 0.73 | 5.04E−03 | 6 | 3 | LYD849 | 0.72 | 7.88E−03 | 4 | 9 |
| LYD838 | 0.74 | 5.88E−02 | 1 | 7 | LGP65 | 0.79 | 3.36E−02 | 1 | 10 |
| LYD838 | 0.79 | 3.62E−02 | 1 | 8 | LGP65 | 0.82 | 4.64E−02 | 1 | 39 |
| LYD838 | 0.75 | 5.36E−02 | 1 | 6 | LGP65 | 0.79 | 6.21E−02 | 1 | 41 |
| LYD839 | 0.72 | 6.59E−02 | 2 | 30 | LYD839 | 0.74 | 5.75E−02 | 2 | 6 |
| LYD839 | 0.77 | 8.62E−03 | 5 | 14 | LYD849 | 0.74 | 5.65E−02 | 1 | 5 |
| LYD840 | 0.88 | 1.92E−04 | 4 | 42 | LYD844 | 0.84 | 1.84E−02 | 2 | 40 |
| LYD840 | 0.80 | 1.65E−03 | 4 | 40 | LYD850 | 0.78 | 3.91E−02 | 2 | 7 |
| LYD840 | 0.72 | 8.20E−03 | 4 | 36 | LGP47 | 0.72 | 7.78E−03 | 4 | 8 |
| LYD841 | 0.80 | 5.56E−03 | 5 | 38 | LYD841 | 0.84 | 2.57E−03 | 5 | 10 |
| LYD841 | 0.84 | 4.25E−03 | 5 | 35 | LYD841 | 0.83 | 5.11E−03 | 5 | 37 |
| LYD841 | 0.93 | 2.51E−03 | 2 | 20 | LYD841 | 0.75 | 5.45E−02 | 2 | 11 |
| LYD841 | 0.71 | 6.39E−03 | 6 | 38 | LYD836 | 0.70 | 1.12E−02 | 4 | 19 |
| LYD841 | 0.75 | 4.83E−03 | 6 | 35 | LYD840 | 0.83 | 7.70E−04 | 4 | 22 |
| LYD841 | 0.75 | 1.22E−02 | 5 | 36 | LYD850 | 0.84 | 1.71E−02 | 1 | 16 |
| LYD841 | 0.71 | 1.04E−02 | 4 | 8 | LYD847 | 0.80 | 1.93E−03 | 3 | 10 |
| LYD842 | 0.71 | 9.18E−03 | 3 | 22 | LYD849 | 0.81 | 2.79E−02 | 1 | 36 |
| LYD842 | 0.71 | 6.21E−02 | 6 | 36 | LGP58 | 0.71 | 7.26E−02 | 1 | 43 |
| LYD842 | 0.82 | 2.52E−02 | 1 | 20 | LYD843 | 0.80 | 1.81E−03 | 3 | 18 |
| LYD843 | 0.95 | 8.97E−04 | 2 | 14 | LYD843 | 0.86 | 1.35E−02 | 2 | 15 |
| LYD843 | 0.73 | 6.61E−03 | 4 | 7 | LGP65 | 0.72 | 8.29E−03 | 4 | 18 |
| LYD843 | 0.81 | 1.47E−03 | 4 | 8 | LGP65 | 0.71 | 9.91E−03 | 4 | 6 |
| LYD843 | 0.76 | 3.81E−03 | 4 | 6 | LYD840 | 0.73 | 1.05E−02 | 4 | 35 |
| LYD843 | 0.70 | 7.46E−03 | 6 | 2 | LYD844 | 0.71 | 1.04E−02 | 4 | 42 |
| LYD843 | 0.79 | 1.36E−03 | 6 | 18 | LGP58 | 0.72 | 5.32E−03 | 6 | 14 |
| LYD843 | 0.81 | 8.53E−04 | 6 | 3 | LYD847 | 0.79 | 1.18E−03 | 6 | 38 |
| LYD843 | 0.71 | 7.39E−02 | 1 | 18 | LYD835 | 0.88 | 8.12E−03 | 1 | 14 |
| LYD843 | 0.75 | 5.44E−02 | 1 | 31 | LYD835 | 0.80 | 3.11E−02 | 1 | 20 |
| LYD843 | 0.78 | 1.52E−03 | 6 | 9 | LYD836 | 0.87 | 1.16E−02 | 1 | 22 |
| LYD843 | 0.73 | 6.28E−03 | 1 | 13 | LYD844 | 0.75 | 4.72E−03 | 3 | 40 |
| LYD843 | 0.81 | 1.48E−03 | 3 | 3 | LYD844 | 0.76 | 9.99E−03 | 5 | 38 |
| LYD844 | 0.71 | 2.16E−02 | 5 | 21 | LYD844 | 0.71 | 2.12E−02 | 5 | 10 |
| LYD844 | 0.84 | 2.28E−03 | 5 | 42 | LYD844 | 0.75 | 1.29E−02 | 5 | 40 |
| LYD844 | 0.78 | 1.30E−02 | 5 | 35 | LYD844 | 0.77 | 1.51E−02 | 5 | 41 |
| LYD844 | 0.89 | 6.54E−04 | 5 | 36 | LYD844 | 0.75 | 1.21E−02 | 5 | 5 |
| LYD844 | 0.79 | 6.12E−02 | 1 | 41 | LYD844 | 0.71 | 7.38E−02 | 2 | 41 |
| LYD844 | 0.89 | 6.53E−03 | 2 | 39 | LYD840 | 0.73 | 1.06E−02 | 4 | 39 |
| LYD844 | 0.71 | 1.34E−02 | 4 | 35 | LYD840 | 0.84 | 1.14E−03 | 4 | 41 |
| LYD844 | 0.72 | 1.31E−02 | 4 | 39 | LYD849 | 0.83 | 4.72E−04 | 6 | 38 |
| LYD844 | 0.71 | 6.46E−03 | 6 | 40 | LYD836 | 0.96 | 2.99E−03 | 1 | 35 |
| LYD844 | 0.74 | 5.91E−02 | 1 | 42 | LYD836 | 0.95 | 1.02E−03 | 1 | 40 |
| LYD844 | 0.85 | 1.54E−02 | 1 | 40 | LYD836 | 0.92 | 8.24E−03 | 1 | 37 |
| LYD844 | 0.86 | 2.66E−02 | 1 | 37 | LYD850 | 0.77 | 4.35E−02 | 1 | 18 |
| LYD844 | 0.76 | 6.57E−03 | 3 | 39 | LYD845 | 0.79 | 3.29E−02 | 2 | 15 |
| LYD845 | 0.84 | 1.70E−02 | 2 | 16 | LYD837 | 0.73 | 6.33E−02 | 1 | 28 |
| LYD845 | 0.78 | 1.86E−03 | 6 | 30 | LGP47 | 0.70 | 1.08E−02 | 3 | 21 |
| LYD845 | 0.84 | 2.09E−03 | 5 | 14 | LYD846 | 0.72 | 2.01E−02 | 5 | 15 |
| LYD846 | 0.71 | 7.27E−02 | 1 | 15 | LYD847 | 0.79 | 1.22E−02 | 5 | 41 |
| LYD847 | 0.85 | 4.06E−03 | 5 | 39 | LYD847 | 0.94 | 1.41E−03 | 2 | 5 |
| LYD847 | 0.80 | 2.98E−02 | 2 | 22 | LYD847 | 0.71 | 7.62E−02 | 2 | 24 |
| LYD847 | 0.83 | 2.16E−02 | 2 | 21 | LYD847 | 0.81 | 2.80E−02 | 2 | 29 |
| LYD847 | 0.71 | 7.33E−02 | 2 | 10 | LYD844 | 0.81 | 1.54E−03 | 4 | 26 |
| LYD847 | 0.72 | 6.67E−02 | 2 | 36 | LYD838 | 0.71 | 6.78E−03 | 6 | 8 |
| LYD847 | 0.80 | 9.62E−04 | 6 | 10 | LYD836 | 0.86 | 2.67E−02 | 1 | 41 |
| LYD847 | 0.77 | 4.28E−02 | 1 | 22 | LYD838 | 0.91 | 3.90E−03 | 1 | 18 |
| LYD847 | 0.72 | 6.58E−02 | 1 | 20 | LYD842 | 0.96 | 7.51E−04 | 1 | 22 |

TABLE 147-continued

Correlation between the expression level of selected genes of some embodiments of the invention in various tissues and the phenotypic performance under normal conditions across Cotton accessions

| Gene Name | R | P value | Exp. set | Corr. Set ID | Gene Name | R | P value | Exp. set | Corr. Set ID |
|---|---|---|---|---|---|---|---|---|---|
| LYD847 | 0.82 | 1.10E−03 | 6 | 37 | LYD847 | 0.79 | 3.77E−03 | 3 | 37 |
| LYD847 | 0.86 | 3.87E−04 | 3 | 38 | LYD847 | 0.90 | 1.51E−04 | 3 | 41 |
| LYD847 | 0.90 | 1.64E−04 | 3 | 35 | MGP1 | 0.73 | 6.50E−03 | 4 | 22 |
| LYD847 | 0.95 | 1.11E−05 | 3 | 39 | LYD837 | 0.82 | 9.97E−04 | 3 | 8 |
| LYD847 | 0.84 | 5.58E−04 | 3 | 36 | LYD838 | 0.97 | 3.74E−04 | 1 | 3 |
| LYD848 | 0.77 | 4.08E−02 | 1 | 22 | LYD838 | 0.80 | 3.18E−02 | 1 | 9 |
| LYD848 | 0.85 | 1.56E−02 | 1 | 17 | LYD849 | 0.79 | 6.44E−03 | 5 | 42 |
| LYD849 | 0.83 | 2.71E−03 | 5 | 38 | LYD849 | 0.75 | 2.08E−02 | 5 | 35 |
| LYD849 | 0.75 | 1.17E−02 | 5 | 10 | LYD849 | 0.82 | 3.33E−03 | 5 | 36 |
| LYD849 | 0.75 | 1.97E−02 | 5 | 37 | LYD849 | 0.80 | 2.92E−02 | 2 | 42 |
| LYD849 | 0.97 | 3.35E−04 | 2 | 38 | LYD849 | 0.71 | 7.36E−02 | 2 | 32 |
| LYD849 | 0.95 | 1.28E−03 | 2 | 10 | LYD849 | 0.94 | 1.57E−03 | 2 | 37 |
| LYD849 | 0.81 | 2.62E−02 | 2 | 35 | LYD849 | 0.79 | 3.59E−02 | 2 | 11 |
| LYD849 | 0.71 | 7.35E−02 | 2 | 13 | LYD843 | 0.84 | 6.44E−04 | 4 | 18 |
| LYD849 | 0.84 | 7.16E−04 | 4 | 18 | LYD843 | 0.85 | 4.99E−04 | 4 | 3 |
| LYD849 | 0.74 | 5.74E−03 | 4 | 3 | LYD844 | 0.77 | 3.40E−03 | 4 | 17 |
| LYD849 | 0.93 | 2.47E−03 | 2 | 36 | LYD838 | 0.71 | 6.59E−03 | 6 | 6 |
| LYD849 | 0.77 | 1.99E−03 | 6 | 42 | LYD841 | 0.75 | 2.98E−03 | 6 | 10 |
| LYD849 | 0.76 | 3.76E−03 | 6 | 35 | LYD843 | 0.79 | 3.55E−02 | 1 | 14 |
| LYD849 | 0.73 | 6.51E−02 | 1 | 21 | LYD843 | 0.89 | 7.67E−03 | 1 | 17 |
| LYD849 | 0.88 | 8.24E−03 | 1 | 10 | LYD844 | 0.90 | 1.48E−02 | 1 | 35 |
| LYD849 | 0.78 | 6.57E−02 | 1 | 39 | LYD844 | 0.86 | 2.78E−02 | 1 | 39 |
| LYD849 | 0.71 | 7.38E−02 | 1 | 29 | LYD850 | 0.80 | 3.09E−02 | 1 | 8 |
| LYD849 | 0.73 | 7.29E−03 | 3 | 24 | LYD844 | 0.85 | 1.51E−02 | 1 | 22 |
| LYD849 | 0.81 | 7.63E−04 | 6 | 36 | LYD836 | 0.74 | 5.50E−03 | 3 | 40 |
| LYD849 | 0.73 | 2.46E−02 | 5 | 41 | LYD850 | 0.70 | 7.96E−02 | 2 | 28 |
| LYD850 | 0.87 | 1.18E−02 | 2 | 18 | LYD850 | 0.82 | 2.29E−02 | 2 | 32 |
| LYD850 | 0.89 | 7.44E−03 | 2 | 8 | LYD850 | 0.70 | 7.98E−02 | 2 | 27 |
| LYD850 | 0.93 | 2.60E−03 | 2 | 3 | LYD850 | 0.87 | 9.98E−03 | 2 | 6 |
| LYD850 | 0.85 | 1.62E−02 | 2 | 25 | LYD844 | 0.76 | 4.64E−02 | 1 | 20 |
| LYD850 | 0.74 | 5.94E−02 | 1 | 7 | LYD847 | 0.81 | 2.60E−02 | 1 | 19 |
| LYD850 | 0.93 | 2.63E−03 | 1 | 23 | LYD847 | 0.74 | 5.54E−02 | 1 | 1 |
| LYD850 | 0.86 | 1.21E−02 | 1 | 12 | LYD848 | 0.77 | 4.19E−02 | 1 | 32 |
| LYD850 | 0.74 | 5.50E−02 | 1 | 27 | LYD848 | 0.73 | 6.43E−02 | 1 | 13 |
| LYD850 | 0.79 | 3.35E−02 | 1 | 15 | LYD850 | 0.72 | 6.60E−02 | 1 | 3 |
| LYD850 | 0.76 | 3.97E−03 | 3 | 30 | LYD840 | 0.73 | 6.47E−02 | 1 | 14 |
| LYD850 | 0.83 | 2.05E−02 | 2 | 9 | LYD837 | 0.81 | 1.26E−03 | 3 | 18 |
| LYD850 | 0.76 | 1.16E−02 | 5 | 13 | LYD847 | 0.75 | 5.28E−03 | 3 | 40 |
| MGP1 | 0.73 | 1.55E−02 | 5 | 13 | | | | | |

Table 147. Provided are the correlations (R) between the expression levels of yield improving genes and their homologues in tissues [mature leaf, lower and upper main stem, flower, main mature boll and fruit; Expression sets (Exp)] and the phenotypic performance in various yield, biomass, growth rate and/or vigor components [Correlation vector (corr.)] under normal conditions across Cotton accessions.
P = p value.

Example 19

Production of Bean Transcriptome and High Throughput Correlation Analysis with Yield Parameters Using 60K Bean (*Phaseolus vulgaris* L.) Oligonucleotide Micro-Arrays In order to produce a high throughput correlation analysis, the present inventors utilized a Bean oligonucleotide microarray, produced by Agilent Technologies [chem. (dot) agilent (dot) com/Scripts/PDS (dot) asp?1Page=50879]. The array oligonucleotide represents about 60,000 Bean genes and transcripts. In order to define correlations between the levels of RNA expression with yield components or plant architecture related parameters or plant vigor related parameters, various plant characteristics of 40 different commercialized bean varieties were analyzed and further used for RNA expression analysis. The correlation between the RNA levels and the characterized parameters was analyzed using Pearson correlation test [davidmlane (dot) com/hyperstat/A34739 (dot) html].

Experimental Procedures
Analyzed Bean Tissues

Six tissues [leaf, Stem, lateral stem, lateral branch flower bud, lateral branch pod with seeds and meristem] growing under normal conditions [field experiment, normal growth conditions which included irrigation with water 2-3 times a week with 524 m$^3$ water per dunam (1000 square meters) per entire growth period, and fertilization of 16 units nitrogen per dunam given in the first month of the growth period] were sampled and RNA was extracted as described above.

For convenience, each micro-array expression information tissue type has received a Set ID as summarized in Table 148 below.

TABLE 148

Bean transcriptome expression sets

| Expression Set | Set ID |
|---|---|
| Lateral branch flower bud at flowering stage under normal growth conditions | 1 |
| Lateral branch pod with seeds at pod setting stage under normal growth conditions | 2 |

TABLE 148-continued

Bean transcriptome expression sets

| Expression Set | Set ID |
|---|---|
| Lateral stem at pod setting stage under normal growth conditions | 3 |
| Lateral stem at flowering stage under normal growth conditions | 4 |
| Leaf at pod setting stage under normal growth conditions | 5 |
| Leaf at flowering stage under normal growth conditions | 6 |
| Leaf at vegetative stage under normal growth conditions | 7 |
| Meristem at vegetative stage under normal growth conditions | 8 |
| stem at vegetative stage under normal growth conditions | 9 |

Table 148: Provided are the bean transcriptome expression sets. Lateral branch flower bud = flower bud from vegetative branch; Lateral branch pod with seeds = pod with seeds from vegetative branch; Lateral stem = stem from vegetative branch.

Bean Yield Components and Vigor Related Parameters Assessment

40 Bean varieties were grown in five repetitive plots, in field. Briefly, the growing protocol was as follows: Bean seeds were sown in soil and grown under normal conditions until harvest. Plants were continuously phenotyped during the growth period and at harvest (Table 149). The image analysis system included a personal desktop computer (Intel P4 3.0 GHz processor) and a public domain program—ImageJ 1.37 (Java based image processing program, which was developed at the U.S. National Institutes of Health and freely available on the internet [rsbweb (dot) nih (dot) gov/]. Next, analyzed data was saved to text files and processed using the JMP statistical analysis software (SAS institute).

The collected data parameters were as follows:

% Canopy coverage—percent Canopy coverage at grain filling stage, R1 flowering stage and at vegetative stage. The % Canopy coverage is calculated using Formula XXXII above.

1000 seed weight [gr]—At the end of the experiment all seeds from all plots were collected and weighted and the weight of 1000 were calculated.

Days till 50% flowering [days]—number of days till 50% flowering for each plot.

Avr shoot DW—At the end of the experiment, the shoot material was collected, measured and divided by the number of plants.

Big pods FW per plant (PS) [gr]—1 meter big pods fresh weight at pod setting divided by the number of plants.

Big pods num per plant (PS)—number of pods at development stage of R3-4 period above 4 cm per plant at pod setting.

Small pods FW per plant (PS) [gr]—1 meter small pods fresh weight at pod setting divided by the number of plants.

Small pods num per plant (PS)—number of pods at development stage of R3-4 period below 4 cm per plant at pod setting.

Pod Area [$cm^2$]—At development stage of R3-4 period pods of three plants were weighted, photographed and images were processed using the below described image processing system. The pod area above 4 cm and below 4 cm was measured from those images and was divided by the number of pods.

Pod Length and Pod width [cm]—At development stage of R3-4 period pods of three plants were weighted, photographed and images were processed using the below described image processing system. The sum of pod lengths/ or width (longest axis) was measured from those images and was divided by the number of pods.

Num of lateral branches per plant [value/plant]—number of lateral branches per plant at vegetative stage (average of two plants per plot) and at harvest (average of three plants per plot).

Relative growth rate [cm/day]: the relative growth rate (RGR) of Plant Height was calculated using Formula III above.

Leaf area per plant (PS) [$cm^2$]=Total leaf area of 3 plants in a plot at pod setting. Measurement was performed using a Leaf area-meter.

Specific leaf area (PS) [$cm^2/gr$]—leaf area per leaf dry weight at pod set.

Leaf form—Leaf length (cm)/leaf width (cm); average of two plants per plot.

Leaf number per plant (PS)—Plants were characterized for leaf number during pod setting stage. Plants were measured for their leaf number by counting all the leaves of 3 selected plants per plot.

Plant height [cm]—Plants were characterized for height during growing period at 3 time points. In each measure, plants were measured for their height using a measuring tape. Height of main stem was measured from first node above ground to last node before apex.

Seed yield per area (H)[gr]—1 meter seeds weight at harvest.

Seed yield per plant (H)[gr]—Average seeds weight per plant at harvest in 1 meter plot.

Seeds num per area (H)—1 meter plot seeds number at harvest.

Total seeds per plant (H)—Seeds number on lateral branch per plant+Seeds number on main branch per plant at harvest, average of three plants per plot.

Total seeds weight per plant (PS)—Seeds weight on lateral branch+Seeds weight on main branch at pod set per plant, average of three plants per plot.

Small pods FW per plant (PS)—Average small pods (below 4 cm) fresh weight per plant at pod setting per meter.

Small pods num per plant (PS)—Number of Pods below 4 cm per plant at pod setting, average of two plants per plot.

SPAD—Plants were characterized for SPAD rate during growing period at grain filling stage and vegetative stage. Chlorophyll content was determined using a Minolta SPAD 502 chlorophyll meter and measurement was performed 64 days post sowing. SPAD meter readings were done on young fully developed leaf. Three measurements per leaf were taken per plot.

Stem width (R2F)[mm]—width of the stem of the first node at R2 flowering stage, average of two plants per plot.

Total pods num per plant (H), (PS)—Pods number on lateral branch per plant+Pods number on main branch per plant at pod setting and at harvest, average of three plants per plot.

Total pods DW per plant (H) [gr]—Pods dry weight on main branch per plant+Pods dry weight on lateral branch per plant at harvest, average of three plants per plot.

Total pods FW per plant (PS) [gr]—Average pods fresh weight on lateral branch+Pods weight on main branch at pod setting.

Pods weight per plant (RP) (H) [gr]—Average pods weight per plant at harvest in 1 meter.

Total seeds per plant (H), (PS)—Seeds number on lateral branch per plant+Seeds number on main branch per plant at pod setting and at harvest. average of three plants per plot.

Total seeds num per pod (H), (PS)—Total seeds num per plant divided in total pods num per plant, average of three plants per plot.

Vegetative FW and DW per plant (PS) [gr/plant]—total weight of the vegetative portion above ground (excluding roots and pods) before and after drying at 70° C. in oven for 48 hours at pod set, average of three plants per plot.

Vigor till flowering [g/day]—Relative growth rate (RGR) of shoot DW=Regression coefficient of shoot DW along time course (two measurements at vegetative stage and one measurement at flowering stage).

Vigor post flowering [g/day]—Relative growth rate (RGR) of shoot DW=Regression coefficient of shoot DW measurements along time course (one measurement at flowering stage and two measurements at grain filling stage).

Experimental Results 40 different bean varieties lines 1-40 were grown and characterized for 48 parameters as specified above. Among the 40 varieties, 16 varieties are "fine" and "extra fine". The average for each of the measured parameters was calculated using the JMP software and values are summarized in Tables 150-154 below. Subsequent correlation analysis between the various transcriptome sets and the average parameters was conducted (Table 157). Follow, results were integrated to the database. Correlations were calculated across all 40 lines. The phenotypic data of all 40 lines is provided in Tables 150-154 below. The correlation data of all 40 lines is provided in Table 157 below. The phenotypic data of "fine" and "extra fine" lines is provided in Tables 155-156 below. The correlation data of "fine" and "extra fine" lines is provided in Table 158 below.

TABLE 149

Bean correlated parameters (vectors)

| Correlated parameter with | Correlation ID |
|---|---|
| % Canopy coverage (GF) | 1 |
| % Canopy coverage (R1F) | 2 |
| % Canopy coverage (V) | 3 |
| 1000 seed weight [gr] | 4 |
| Avr shoot DW (EGF) [gr] | 5 |
| Avr shoot DW (R2F) [gr] | 6 |
| Avr shoot DW (V) [gr] | 7 |
| Big pods FW per plant (PS) (RP) [gr] | 8 |
| Big pods num per plant (PS) [gr] | 9 |
| CV (Pod_Length) | 10 |
| CV (Pod_Length_Below_4 cm) | 11 |
| Height Rate | 12 |

TABLE 149-continued

Bean correlated parameters (vectors)

| Correlated parameter with | Correlation ID |
|---|---|
| Leaf Length | 13 |
| Leaf Width | 14 |
| Leaf area per plant (PS) | 15 |
| Leaf form | 16 |
| Leaf num per plant (PS) | 17 |
| Num of lateral branches per plant (H) | 18 |
| Num of lateral branches per plant (V) | 19 |
| PAR_LAI (EGF) | 20 |
| PAR_LAI (LGF) | 21 |
| PAR_LAI (R1F) | 22 |
| Plant height (GF) | 23 |
| Plant height (V2-V3) | 24 |
| Plant height (V4-V5) | 25 |
| Pods weight per plant (RP) (H) [gr] | 26 |
| SPAD (GF) | 27 |
| SPAD (V) | 28 |
| Seed yield per area (H) (RP) [gr] | 29 |
| Seed yield per plant (RP) (H) [gr] | 30 |
| Seeds num per area (H) (RP) | 31 |
| Small pods FW per plant (PS) (RP) [gr] | 32 |
| Small pods num per plant (PS) | 33 |
| Specific leaf area (PS) | 34 |
| Stem width (R2F) | 35 |
| Total pods DW per plant (H) [gr] | 36 |
| Total pods num per plant (H) | 37 |
| Total pods num per plant (PS) | 38 |
| Total pods weight per plant (PS) [gr] | 39 |
| Total seeds num per pod (H) | 40 |
| Total seeds num per pod (PS) | 41 |
| Total seeds per plant (H) | 42 |
| Total seeds per plant (PS) | 43 |
| Total seeds weight per plant (PS) [gr] | 44 |
| Vegetative DW per plant (PS) [gr] | 45 |
| Vegetative FW per plant (PS) [gr] | 46 |
| Vigor post flowering | 47 |
| Vigor till flowering | 48 |

Table 149. Provided are the Bean correlated parameters (vectors). "gr." = grams; "SPAD" = chlorophyll levels; "PAR" = Photosynthetically active radiation; "FW" = Plant Fresh weight; "normal" = standard growth conditions; "GF" = Grain filling; "R1F" = Flowering in R1 stage; "V" = Vegetative stage; "EGF" = Early grain filling; "R2F" = Flowering in R2 stage; "PS" = Pod setting; "RP" = Rest of the plot; "H" = Harvest; "LGF" = Late grain filling; "V2-V3" = Vegetative stages 2-3; "V4-V5" = Vegetative stages 4-5.

TABLE 150

Measured parameters in bean varieties (lines 1-8)

| Ecotype/Treatment | Line-1 | Line-2 | Line-3 | Line-4 | Line-5 | Line-6 | Line-7 | Line-8 |
|---|---|---|---|---|---|---|---|---|
| 1 | 88.66 | 87.35 | 78.24 | 91.02 | NA | 80.76 | 76.70 | 90.29 |
| 2 | 89.59 | 82.80 | 66.40 | 78.87 | 79.25 | 72.28 | 82.77 | 90.49 |
| 3 | 70.53 | 61.65 | 56.46 | 58.56 | 65.39 | 38.98 | 70.54 | 83.64 |
| 4 | 94.43 | 151.19 | 145.91 | 117.59 | 154.23 | 69.63 | 142.25 | 123.75 |
| 5 | 16.19 | 28.63 | 14.04 | 18.66 | 23.18 | 19.29 | 18.43 | 27.82 |
| 6 | 7.33 | 10.29 | 7.58 | 8.28 | 9.42 | 6.37 | 11.51 | 11.85 |
| 7 | 0.30 | 0.42 | 0.30 | 0.33 | 0.41 | 0.24 | 0.44 | 0.44 |
| 8 | NA | NA | NA | 67.40 | NA | 38.22 | NA | 76.45 |
| 9 | 24.25 | 36.00 | 25.25 | 35.25 | 19.50 | 65.00 | 28.50 | 26.50 |
| 10 | 19.39 | 46.26 | 18.29 | 40.69 | 54.77 | 36.57 | 36.81 | 19.08 |
| 11 | NA | 53.11 | NA | 48.72 | 47.60 | 38.91 | 41.17 | 67.38 |
| 12 | 0.97 | 0.90 | 0.85 | 0.85 | 0.76 | 0.91 | 1.33 | 0.85 |
| 13 | 13.34 | 12.31 | 11.76 | 11.64 | 12.19 | 11.14 | 13.20 | 13.15 |
| 14 | 8.16 | 7.75 | 7.69 | 8.83 | 7.67 | 7.03 | 8.97 | 8.42 |
| 15 | 211.67 | 242.06 | 183.00 | 307.13 | 306.53 | 133.13 | 253.07 | 308.07 |
| 16 | 1.64 | 1.59 | 1.53 | 1.32 | 1.59 | 1.58 | 1.47 | 1.56 |
| 17 | 4.73 | 4.67 | 4.67 | 6.07 | 5.00 | 4.73 | 5.00 | 6.17 |
| 18 | 7.93 | 6.06 | 7.00 | 6.20 | 7.27 | 7.93 | 6.93 | 7.00 |
| 19 | 4.90 | 5.17 | 5.50 | 4.90 | 5.30 | 5.80 | 6.60 | 6.60 |
| 20 | 8.44 | 6.39 | 4.85 | 7.85 | 6.10 | 5.78 | 7.82 | 7.61 |
| 21 | 6.15 | 4.76 | 3.97 | 5.84 | NA | 4.38 | 4.03 | 4.01 |
| 22 | 3.27 | 3.43 | 2.05 | 3.06 | 3.21 | 1.33 | 4.11 | 5.01 |
| 23 | 36.84 | 31.98 | 30.76 | 34.83 | 34.37 | 31.52 | 51.66 | 37.71 |

TABLE 150-continued

Measured parameters in bean varieties (lines 1-8)

| Ecotype/Treatment | Line-1 | Line-2 | Line-3 | Line-4 | Line-5 | Line-6 | Line-7 | Line-8 |
|---|---|---|---|---|---|---|---|---|
| 24 | 4.39 | 5.81 | 4.53 | 4.80 | 5.19 | 3.68 | 6.41 | 5.75 |
| 25 | 11.43 | 10.57 | 8.33 | 11.17 | 14.79 | 7.60 | 17.50 | 16.57 |
| 26 | 11.67 | 20.34 | 15.07 | 15.20 | 20.20 | 15.96 | 14.36 | 23.07 |
| 27 | 40.19 | 38.43 | 34.50 | 36.22 | 38.60 | 37.68 | 40.53 | NA |
| 28 | 36.00 | 40.03 | 30.82 | 39.44 | 33.66 | 31.41 | 35.44 | 40.15 |
| 29 | 342.44 | 243.25 | 284.35 | 457.16 | 493.65 | 196.69 | 457.67 | 430.61 |
| 30 | 6.31 | 4.73 | 8.70 | 8.29 | 9.28 | 4.53 | 8.40 | 9.20 |
| 31 | 3635.20 | 1588.67 | 1958.33 | 3879.60 | 3207.60 | 2875.20 | 3218.20 | 3485.80 |
| 32 | 0.62 | 2.16 | 1.52 | 2.06 | 0.72 | 1.15 | 0.87 | 0.60 |
| 33 | 0.50 | 3.75 | 0.25 | 6.00 | 4.75 | 9.50 | 1.75 | 1.50 |
| 34 | 226.25 | 226.14 | 211.39 | 222.25 | 207.28 | 213.00 | 200.97 | 207.31 |
| 35 | 5.79 | 5.65 | 6.14 | 5.84 | 6.01 | 5.40 | 6.10 | 5.83 |
| 36 | 12.76 | 15.64 | 15.42 | 20.71 | 16.54 | 13.89 | 19.23 | 30.42 |
| 37 | 27.13 | 19.35 | 17.56 | 24.73 | 17.93 | 46.07 | 18.53 | 38.27 |
| 38 | 33.07 | 24.67 | 29.67 | 33.93 | 16.80 | 31.58 | 27.50 | 20.94 |
| 39 | 32.96 | 122.68 | 60.41 | 105.04 | 40.17 | 61.14 | 50.37 | 33.15 |
| 40 | 3.32 | 3.32 | 3.92 | 4.68 | 3.94 | 2.81 | 4.46 | 3.93 |
| 41 | 2.64 | 2.22 | 3.94 | 2.35 | 4.13 | 1.02 | 3.66 | 0.63 |
| 42 | 90.47 | 64.18 | 70.22 | 111.33 | 67.67 | 128.60 | 81.00 | 151.80 |
| 43 | 87.60 | 51.87 | 117.20 | 79.00 | 68.87 | 29.38 | 92.60 | 9.17 |
| 44 | NA | NA | NA | 3.45 | NA | 0.50 | NA | 0.17 |
| 45 | 16.30 | NA | 14.80 | 13.53 | 11.36 | 18.80 | 16.38 | 12.64 |
| 46 | 91.61 | 62.45 | 81.49 | 65.65 | 64.54 | 61.83 | 85.77 | 71.07 |
| 47 | 0.92 | 1.26 | 1.04 | 2.03 | 1.97 | 1.67 | 0.87 | 0.84 |
| 48 | 0.44 | 0.61 | 0.27 | 0.46 | 0.52 | 0.35 | 1.10 | 1.18 |

Table 150.

TABLE 151

Measured parameters in bean varieties (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 1 | 82.43 | 70.03 | 84.86 | 70.84 | 78.11 | 84.27 | NA | NA |
| 2 | 76.92 | 76.66 | 85.93 | 82.06 | 77.77 | 73.78 | 76.45 | 71.73 |
| 3 | 69.36 | 68.78 | 53.71 | 64.00 | 71.82 | 46.91 | 51.88 | 61.04 |
| 4 | 149.23 | 191.85 | 124.61 | 151.53 | 149.49 | 66.31 | 93.68 | 147.99 |
| 5 | 15.82 | 31.36 | 26.38 | 24.74 | 20.06 | 14.44 | 18.02 | 22.65 |
| 6 | 9.34 | 10.13 | 8.74 | 8.66 | 9.26 | 5.42 | 7.40 | 13.47 |
| 7 | 0.38 | 0.44 | 0.33 | 0.39 | 0.34 | 0.21 | 0.35 | 0.48 |
| 8 | NA | NA | NA | NA | NA | 49.40 | 43.69 | 71.54 |
| 9 | 39.25 | 33.25 | 31.00 | 28.25 | 35.25 | 38.75 | 35.50 | 28.00 |
| 10 | 43.94 | 51.86 | 29.45 | 35.20 | 38.96 | 17.38 | 41.36 | 46.35 |
| 11 | 46.79 | 42.67 | 30.14 | 37.78 | 33.11 | 41.28 | 55.89 | 42.56 |
| 12 | 1.12 | 0.84 | 0.83 | 0.87 | 0.94 | 0.72 | 1.06 | 0.83 |
| 13 | 12.22 | 12.20 | 12.13 | 12.21 | 12.34 | 11.99 | 12.35 | 13.95 |
| 14 | 8.33 | 8.72 | 7.83 | 8.10 | 8.51 | 7.85 | 8.13 | 8.84 |
| 15 | 161.62 | 193.33 | 145.57 | 204.86 | 194.50 | 157.53 | 155.00 | 194.42 |
| 16 | 1.46 | 1.40 | 1.55 | 1.51 | 1.45 | 1.53 | 1.52 | 1.58 |
| 17 | 3.21 | 4.47 | 4.00 | 4.20 | 4.73 | 5.00 | 5.42 | 4.11 |
| 18 | 7.60 | 7.60 | 5.73 | 6.47 | 6.87 | 9.67 | 7.53 | 7.58 |
| 19 | 4.80 | 6.50 | 4.90 | 4.80 | 5.70 | 5.10 | 5.70 | 6.75 |
| 20 | 6.20 | 4.58 | 6.34 | 6.79 | 6.48 | 6.29 | 6.60 | 5.85 |
| 21 | 4.20 | 2.58 | 4.66 | 3.69 | 3.40 | 4.95 | NA | NA |
| 22 | 4.26 | 2.88 | 2.22 | 2.99 | 2.84 | 1.58 | 1.74 | 2.73 |
| 23 | 43.67 | 34.58 | 32.94 | 38.28 | 37.63 | 28.88 | 39.83 | 32.98 |
| 24 | 6.25 | 7.10 | 5.16 | 5.95 | 5.94 | 3.93 | 4.50 | 5.85 |
| 25 | 14.07 | 14.37 | 10.37 | 13.20 | 12.07 | 8.40 | 9.67 | 11.17 |
| 26 | 14.94 | 17.78 | 13.45 | 11.85 | 14.54 | 17.06 | 15.12 | 20.37 |
| 27 | 43.58 | NA | 40.78 | 41.57 | 44.54 | 39.40 | NA | NA |
| 28 | 30.39 | 38.56 | 37.48 | 36.32 | 35.10 | 35.76 | 35.01 | 35.68 |
| 29 | 528.80 | 449.28 | 403.09 | 381.85 | 521.60 | 198.09 | 371.13 | 260.02 |
| 30 | 9.46 | 10.86 | 8.19 | 6.86 | 8.72 | 4.02 | 6.55 | 6.99 |
| 31 | 3534.00 | 2342.20 | 3232.80 | 2522.40 | 3492.60 | 3012.20 | 3953.80 | 1768.25 |
| 32 | 1.57 | 0.00 | 1.22 | 1.68 | 1.76 | 0.80 | 1.27 | 1.79 |
| 33 | 6.00 | 6.00 | 1.50 | 1.75 | 4.50 | 1.00 | 5.00 | 3.50 |
| 34 | 218.94 | 205.59 | 187.77 | 242.99 | 169.32 | 257.81 | 238.23 | 208.44 |
| 35 | 5.69 | 5.99 | 5.67 | 5.51 | 5.26 | 4.91 | 6.00 | 6.04 |
| 36 | 19.10 | 29.78 | 24.08 | 15.14 | 13.05 | 15.31 | 10.75 | 26.02 |
| 37 | 22.53 | 24.50 | 22.27 | 18.40 | 15.80 | 38.27 | 18.86 | 24.17 |
| 38 | 22.33 | 19.33 | 22.93 | 24.87 | 25.00 | 46.00 | 24.33 | 18.00 |

TABLE 151-continued

Measured parameters in bean varieties (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 39 | 92.90 | 3.26 | 66.44 | 97.85 | 105.58 | 41.19 | 81.76 | 67.21 |
| 40 | 3.54 | 3.85 | 5.33 | 4.00 | 3.91 | 3.09 | 3.77 | 3.78 |
| 41 | 3.58 | 1.45 | 4.82 | 3.54 | 3.50 | 1.61 | 0.81 | 0.74 |
| 42 | 77.40 | 95.87 | 120.80 | 72.47 | 60.40 | 138.20 | 70.53 | 92.17 |
| 43 | 79.80 | 29.21 | 96.73 | 88.40 | 87.89 | 77.93 | 20.00 | 14.00 |
| 44 | NA | NA | NA | NA | NA | 2.88 | 0.39 | 0.86 |
| 45 | 13.66 | NA | 18.27 | 14.80 | 14.49 | 17.03 | 9.99 | 7.13 |
| 46 | 74.93 | 57.59 | 87.49 | 74.52 | 68.16 | 77.53 | 56.83 | 69.96 |
| 47 | 0.95 | 1.31 | 2.16 | 1.46 | 1.04 | 1.35 | NA | NA |
| 48 | 0.51 | 0.51 | 0.63 | 0.52 | 0.54 | 0.38 | 0.39 | 1.16 |

Table 151.

TABLE 152

Measured parameters in bean varieties (lines 17-24)

| Ecotype/Treatment | Line-17 | Line-18 | Line-19 | Line-20 | Line-21 | Line-22 | Line-23 | Line-24 |
|---|---|---|---|---|---|---|---|---|
| 1 | 85.44 | NA | 73.90 | 74.34 | 73.43 | 66.50 | 84.42 | 87.02 |
| 2 | 88.76 | 91.48 | 91.63 | 81.98 | 91.83 | 72.86 | 83.06 | 92.96 |
| 3 | 68.87 | 82.92 | 59.82 | 55.76 | 76.95 | 65.28 | 64.09 | 73.52 |
| 4 | 144.60 | 380.80 | 72.75 | 186.27 | 185.58 | 107.37 | 121.34 | 205.43 |
| 5 | 23.50 | 26.63 | 15.58 | 33.63 | 35.09 | 31.03 | 18.65 | 32.50 |
| 6 | 8.30 | 11.98 | 8.02 | 10.31 | 13.50 | 9.34 | 6.97 | 10.69 |
| 7 | 0.39 | 0.93 | 0.24 | 0.34 | 0.59 | 0.38 | 0.36 | 0.51 |
| 8 | NA | NA | NA | 110.03 | NA | 49.94 | 49.06 | NA |
| 9 | 26.25 | 19.00 | 49.75 | 31.00 | 37.75 | 22.25 | 23.25 | 24.25 |
| 10 | 40.09 | 35.22 | 42.84 | 46.31 | 52.08 | 22.62 | 32.83 | 26.57 |
| 11 | 35.03 | 36.25 | 28.70 | 34.90 | 36.98 | NA | 51.24 | 16.45 |
| 12 | 0.83 | 0.90 | 0.81 | 1.00 | 1.06 | 1.07 | 1.18 | 0.71 |
| 13 | 12.64 | 10.70 | 12.64 | 12.32 | 11.11 | 11.99 | 12.79 | 13.98 |
| 14 | 8.47 | 7.92 | 7.78 | 8.04 | 7.69 | 7.61 | 7.52 | 8.93 |
| 15 | 211.60 | 529.13 | 192.00 | 206.36 | 305.93 | 273.47 | 180.73 | 197.20 |
| 16 | 1.49 | 1.35 | 1.63 | 1.53 | 1.45 | 1.58 | 1.70 | 1.57 |
| 17 | 4.40 | 8.33 | 5.87 | 4.83 | 4.27 | 6.13 | 4.13 | 3.80 |
| 18 | 8.87 | 5.73 | 9.20 | 6.87 | 7.60 | 8.87 | 9.00 | 7.53 |
| 19 | 4.20 | 7.40 | 5.50 | 4.63 | 3.89 | 6.00 | 6.00 | 5.00 |
| 20 | 6.51 | 6.70 | 6.74 | 5.91 | 5.56 | 6.77 | 7.02 | 8.15 |
| 21 | 4.89 | NA | 3.73 | 3.69 | 3.59 | 2.88 | 5.16 | 4.49 |
| 22 | 3.82 | 5.59 | 2.25 | 2.40 | 4.79 | 3.34 | 3.63 | 3.43 |
| 23 | 32.26 | 39.72 | 30.44 | 38.68 | 43.13 | 41.27 | 44.56 | 29.97 |
| 24 | 4.28 | 9.29 | 4.68 | 5.55 | 7.06 | 6.16 | 5.54 | 7.23 |
| 25 | 10.47 | 25.33 | 11.23 | 12.67 | 18.33 | 15.33 | 11.67 | 13.30 |
| 26 | 16.39 | 16.43 | 19.48 | 21.19 | 18.02 | 18.88 | 15.89 | 21.26 |
| 27 | 35.16 | NA | NA | 41.68 | 42.06 | 43.01 | 42.34 | 31.11 |
| 28 | 32.53 | 34.72 | 35.75 | 32.77 | 37.16 | 35.13 | 34.16 | 31.92 |
| 29 | 550.81 | 595.35 | 431.52 | 568.44 | 526.18 | 533.60 | 482.22 | 456.91 |
| 30 | 9.63 | 10.35 | 7.92 | 12.65 | 11.08 | 9.62 | 9.05 | 12.66 |
| 31 | 3804.20 | 1569.60 | 5946.60 | 3054.60 | 3368.60 | 4920.20 | 3978.60 | 2220.60 |
| 32 | 1.57 | 0.87 | 0.00 | 2.40 | 2.68 | 0.73 | 1.23 | 0.84 |
| 33 | 3.00 | 1.50 | 8.75 | 5.00 | 7.00 | 0.50 | 1.75 | 0.50 |
| 34 | 216.30 | 246.68 | 248.17 | 192.00 | 200.55 | 237.69 | 220.62 | 223.74 |
| 35 | 5.39 | 5.98 | 5.29 | 5.24 | 6.13 | 5.54 | 5.54 | 5.76 |
| 36 | 23.61 | 29.91 | 21.88 | 31.96 | 27.07 | 23.49 | 18.86 | 35.40 |
| 37 | 24.40 | 13.80 | 44.07 | 25.67 | 23.42 | 33.93 | 30.00 | 25.53 |
| 38 | 23.67 | 13.80 | 30.27 | 31.67 | 26.56 | 27.33 | 22.25 | 24.80 |
| 39 | 73.38 | 53.96 | 2.98 | 85.80 | 144.79 | 42.96 | 82.63 | 38.90 |
| 40 | 4.33 | 3.26 | 3.87 | 3.75 | 4.05 | 3.78 | 3.66 | 4.16 |
| 41 | 0.68 | 2.63 | 1.58 | 1.72 | 3.15 | 3.15 | 2.52 | 2.45 |
| 42 | 108.57 | 45.93 | 168.40 | 101.14 | 94.27 | 128.80 | 98.53 | 107.67 |
| 43 | 18.50 | 34.73 | 50.13 | 71.08 | 79.58 | 84.60 | 58.55 | 75.20 |
| 44 | NA | NA | NA | 2.76 | NA | 2.30 | 1.53 | NA |
| 45 | 8.33 | 9.80 | 12.29 | 11.46 | 17.94 | 13.71 | NA | 18.26 |
| 46 | 60.35 | 67.95 | 47.66 | 76.06 | 79.67 | 70.77 | 70.87 | 108.68 |
| 47 | 1.22 | 1.37 | 1.52 | NA | 0.54 | 1.39 | 0.84 | 0.87 |
| 48 | 0.41 | 0.65 | 0.45 | 0.65 | 0.85 | 0.58 | 0.35 | 0.73 |

Table 152.

TABLE 153

Measured parameters in bean varieties (lines 25-32)

| Ecotype/Treatment | Line-25 | Line-26 | Line-27 | Line-28 | Line-29 | Line-30 | Line-31 | Line-32 |
|---|---|---|---|---|---|---|---|---|
| 1 | 78.37 | NA | NA | 83.89 | NA | NA | NA | 83.40 |
| 2 | 62.46 | 80.32 | 86.63 | 82.53 | 80.62 | 84.95 | 83.35 | 84.21 |
| 3 | 34.52 | 52.98 | 89.99 | 62.34 | 77.29 | 70.92 | 63.42 | 61.26 |
| 4 | 154.53 | 158.50 | 120.75 | 96.79 | 207.74 | 307.17 | 116.14 | 94.55 |
| 5 | 29.32 | 25.75 | 21.95 | 21.76 | 38.29 | 39.74 | 17.00 | 18.75 |
| 6 | 10.57 | 9.51 | 11.21 | 6.31 | 11.87 | 10.37 | 11.99 | 10.58 |
| 7 | 0.45 | 0.47 | 0.54 | 0.21 | 0.58 | 0.68 | 0.48 | 0.36 |
| 8 | 82.58 | NA | 76.18 | NA | 44.84 | NA | NA | 61.66 |
| 9 | 43.50 | 19.75 | 28.25 | 32.00 | 29.25 | 21.75 | 32.75 | 34.17 |
| 10 | 38.16 | 33.83 | 31.13 | 46.08 | 55.37 | 29.67 | 28.64 | 20.56 |
| 11 | 36.95 | 5.30 | 51.21 | 37.34 | 45.13 | NA | 58.24 | 82.14 |
| 12 | 0.78 | 1.04 | 1.30 | 0.94 | 1.03 | 1.04 | 0.98 | 0.88 |
| 13 | 12.75 | 12.57 | 12.17 | 10.39 | 12.74 | 12.48 | 11.16 | 13.10 |
| 14 | 7.95 | 8.50 | 7.73 | 6.26 | 7.91 | 7.36 | 7.05 | 8.23 |
| 15 | 175.33 | 216.47 | 324.07 | 175.80 | 296.67 | 394.11 | 242.20 | 200.60 |
| 16 | 1.61 | 1.49 | 1.58 | 1.67 | 1.62 | 1.69 | 1.59 | 1.59 |
| 17 | 4.44 | 4.53 | 7.17 | 7.00 | 5.78 | 7.22 | 6.19 | 5.13 |
| 18 | 5.22 | 7.93 | 6.94 | 8.27 | 6.25 | 7.89 | 6.53 | 8.20 |
| 19 | 4.33 | 4.40 | 6.92 | 7.60 | 5.38 | 9.00 | 6.40 | 8.40 |
| 20 | 4.86 | 6.67 | 7.40 | 6.21 | 5.81 | 6.62 | 6.42 | 8.40 |
| 21 | 3.58 | NA | NA | 4.78 | NA | NA | NA | 4.67 |
| 22 | 1.27 | 2.60 | 6.30 | 3.50 | 4.11 | 4.15 | 3.07 | 2.66 |
| 23 | 29.44 | 41.58 | 53.17 | 34.74 | 41.54 | 44.37 | 37.49 | 35.73 |
| 24 | 4.83 | 4.95 | 6.16 | 4.33 | 6.06 | 7.28 | 6.53 | 4.61 |
| 25 | 9.44 | 16.20 | 23.17 | 7.83 | 16.96 | 21.00 | 19.13 | 10.50 |
| 26 | 21.67 | 19.03 | 17.87 | 11.83 | 17.93 | 19.44 | 17.01 | 11.16 |
| 27 | 39.99 | NA | NA | 34.00 | NA | NA | NA | 37.81 |
| 28 | 35.57 | 34.99 | 34.50 | 30.78 | 40.98 | 35.59 | 38.38 | 37.03 |
| 29 | 243.58 | 611.10 | 290.77 | 426.57 | 701.11 | 487.72 | 501.09 | 102.62 |
| 30 | 7.97 | 10.63 | 5.42 | 7.37 | 11.01 | 12.46 | 8.24 | 1.94 |
| 31 | 1317.00 | 3861.60 | 2416.50 | 4403.00 | 3368.50 | 1595.00 | 4356.20 | 1164.40 |
| 32 | 2.32 | 1.06 | 1.47 | 1.40 | 0.00 | 1.99 | 0.90 | 0.61 |
| 33 | 3.50 | 0.75 | 2.00 | 6.25 | 6.75 | 0.25 | 2.25 | 0.83 |
| 34 | 199.91 | 210.95 | 250.40 | 236.94 | 211.71 | 257.52 | 203.46 | 211.37 |
| 35 | 6.69 | 6.01 | 6.05 | 5.09 | 5.14 | 5.72 | 5.65 | 6.28 |
| 36 | 26.12 | 21.54 | 13.01 | 18.17 | 25.12 | 19.18 | 18.92 | 9.77 |
| 37 | 38.56 | 23.67 | 22.06 | 25.20 | 17.00 | 11.56 | 24.07 | 23.53 |
| 38 | 30.67 | 18.60 | 23.17 | 25.33 | 19.33 | 17.11 | 24.93 | 32.40 |
| 39 | 109.63 | 71.71 | 91.03 | 85.27 | 4.47 | 69.78 | 62.23 | 36.42 |
| 40 | 2.32 | 3.95 | 3.08 | 4.79 | 4.35 | 4.10 | 4.27 | 3.02 |
| 41 | 3.07 | 1.78 | 0.35 | 3.65 | 2.88 | 3.44 | 4.93 | 2.48 |
| 42 | 85.44 | 90.13 | 65.11 | 118.07 | 73.08 | 46.33 | 103.20 | 70.33 |
| 43 | 94.73 | 33.53 | 12.54 | 91.07 | 54.50 | 56.78 | 97.07 | 81.40 |
| 44 | 6.16 | NA | 1.01 | NA | 3.36 | NA | NA | 3.74 |
| 45 | 17.51 | 7.69 | 8.80 | 11.70 | 13.20 | 15.19 | 12.91 | 18.53 |
| 46 | 105.57 | 57.22 | 66.76 | 61.77 | 75.61 | 82.68 | 69.11 | 86.77 |
| 47 | 0.97 | 1.56 | 1.65 | 0.93 | 1.28 | NA | NA | 0.37 |
| 48 | NA | 0.44 | 0.69 | 0.39 | 0.66 | NA | 0.64 | 0.54 |

Table 153.

TABLE 154

Measured parameters in bean varieties (lines 33-40)

| Ecotype/Treatment | Line-33 | Line-34 | Line-35 | Line-36 | Line-37 | Line-38 | Line-39 | Line-40 |
|---|---|---|---|---|---|---|---|---|
| 1 | NA | NA | 88.31 | 79.59 | NA | 75.12 | 86.49 | 83.55 |
| 2 | 73.07 | 86.20 | 85.38 | 71.41 | 87.69 | 68.05 | 78.62 | 83.74 |
| 3 | 38.21 | 80.07 | 69.51 | 40.26 | 77.04 | 26.24 | 52.90 | 83.07 |
| 4 | 82.93 | 442.79 | 140.28 | 111.76 | 172.62 | 70.74 | 332.33 | 234.20 |
| 5 | 14.78 | 30.35 | 17.92 | 18.54 | 27.13 | 15.10 | 42.93 | 33.72 |
| 6 | 7.35 | 8.81 | 9.00 | 7.44 | 10.39 | 5.21 | 11.57 | 14.47 |
| 7 | 0.20 | 0.88 | 0.34 | 0.30 | 0.53 | 0.21 | 0.52 | 0.77 |
| 8 | 23.67 | NA | 54.00 | 89.21 | 60.88 | NA | NA | NA |
| 9 | 46.50 | 23.75 | 34.00 | 23.50 | 31.00 | 68.75 | 36.75 | 19.50 |
| 10 | 46.23 | 50.20 | 32.68 | 23.70 | 61.33 | 22.64 | 25.53 | 29.43 |
| 11 | 44.70 | 48.77 | 26.60 | NA | 35.90 | 71.49 | 18.99 | 7.42 |
| 12 | 0.79 | 0.94 | 0.98 | 0.96 | 1.03 | 0.71 | 1.02 | 1.59 |
| 13 | 11.79 | 13.38 | 11.47 | 11.63 | 13.44 | 12.88 | 12.46 | 11.64 |
| 14 | 7.10 | 8.56 | 8.12 | 7.33 | 8.47 | 8.68 | 8.12 | 8.13 |
| 15 | 174.00 | 442.20 | 197.27 | 146.89 | 210.36 | 61.67 | 288.78 | 463.80 |

TABLE 154-continued

Measured parameters in bean varieties (lines 33-40)

| Ecotype/Treatment | Line-33 | Line-34 | Line-35 | Line-36 | Line-37 | Line-38 | Line-39 | Line-40 |
|---|---|---|---|---|---|---|---|---|
| 16 | 1.66 | 1.56 | 1.41 | 1.59 | 1.59 | 1.48 | 1.54 | 1.43 |
| 17 | 4.53 | 7.87 | 5.83 | 5.11 | 5.47 | 3.64 | 6.72 | 7.80 |
| 18 | 6.93 | 6.67 | 7.40 | 8.67 | 6.67 | 10.67 | 6.60 | 7.33 |
| 19 | 6.20 | 5.00 | 6.20 | 6.00 | 5.60 | 4.60 | 6.83 | 6.50 |
| 20 | 5.11 | 7.14 | 7.54 | 4.66 | 5.71 | 4.56 | 6.59 | 6.65 |
| 21 | NA | NA | 5.55 | 4.20 | NA | 4.01 | 4.92 | 4.87 |
| 22 | 1.14 | 4.89 | 4.29 | 1.28 | 4.73 | 0.76 | 2.32 | 5.49 |
| 23 | 29.54 | 45.00 | 36.67 | 34.89 | 39.58 | 26.25 | 40.51 | 60.87 |
| 24 | 3.46 | 9.08 | 4.25 | 4.98 | 6.69 | 3.50 | 5.44 | 6.36 |
| 25 | 8.70 | 25.73 | 13.07 | 8.72 | 17.17 | 5.90 | 12.47 | 22.70 |
| 26 | 12.83 | 17.06 | 15.57 | 20.16 | 18.73 | 19.53 | 23.90 | 23.34 |
| 27 | NA | NA | 37.33 | 31.09 | NA | 34.70 | 32.23 | 39.56 |
| 28 | 34.21 | 31.77 | 33.73 | 26.07 | 34.14 | 29.34 | 32.16 | 37.90 |
| 29 | 170.90 | 623.84 | 418.30 | 334.59 | 551.91 | 330.59 | 604.79 | 695.47 |
| 30 | 3.70 | 10.27 | 8.21 | 9.76 | 10.68 | 10.16 | 16.19 | 15.15 |
| 31 | 2036.80 | 1410.20 | 2980.60 | 2987.20 | 3196.80 | 4661.80 | 1823.80 | 3141.00 |
| 32 | 0.00 | 0.00 | 1.36 | 1.66 | 0.00 | 1.03 | 1.70 | 0.90 |
| 33 | 9.50 | 5.50 | 2.00 | 0.00 | 9.00 | 3.25 | 1.50 | 1.50 |
| 34 | 255.60 | 271.09 | 234.43 | 228.00 | 266.51 | 251.56 | 239.50 | 223.15 |
| 35 | 5.55 | 5.18 | 5.94 | 5.64 | 5.00 | 4.63 | 7.15 | 6.32 |
| 36 | 23.52 | 31.44 | 17.47 | 24.60 | 25.46 | 28.08 | 37.91 | 28.98 |
| 37 | 63.57 | 13.93 | 19.53 | 24.53 | 18.47 | 43.93 | 27.00 | 20.13 |
| 38 | 26.87 | 13.73 | 23.00 | 22.33 | 11.92 | 43.40 | 32.00 | 22.27 |
| 39 | 1.79 | 3.03 | 83.19 | 52.44 | 3.82 | 40.39 | 68.98 | 53.52 |
| 40 | 1.82 | 3.39 | 3.76 | 5.30 | 4.92 | 5.12 | 2.89 | 4.23 |
| 41 | 1.12 | 1.79 | 2.47 | 1.83 | 1.28 | 1.42 | 1.91 | 3.05 |
| 42 | 111.93 | 47.87 | 73.20 | 126.73 | 93.20 | 224.00 | 76.33 | 84.73 |
| 43 | 31.71 | 22.87 | 57.07 | 45.43 | 16.47 | 62.29 | 59.33 | 58.80 |
| 44 | 0.30 | NA | 1.67 | 1.54 | 1.01 | NA | NA | NA |
| 45 | 10.76 | 14.31 | 11.87 | 17.40 | NA | 14.32 | 27.62 | 14.82 |
| 46 | 52.76 | 71.50 | 80.20 | 116.85 | 59.77 | 71.51 | 156.73 | 80.57 |
| 47 | 1.39 | NA | 1.58 | 1.43 | NA | 1.34 | 1.36 | 2.03 |
| 48 | 0.42 | 0.60 | 0.54 | 0.36 | 0.68 | 0.25 | 0.79 | 0.89 |

Table 154.

TABLE 155

Measured parameters in bean varieties ("fine" and "extra fine") (lines 1-8)

| Ecotype/Treatment | Line-1 | Line-2 | Line-3 | Line-4 | Line-5 | Line-6 | Line-7 | Line-8 |
|---|---|---|---|---|---|---|---|---|
| 1 | 88.66 | 91.02 | 80.76 | 90.29 | 84.27 | NA | 73.90 | 66.50 |
| 2 | 89.59 | 78.87 | 72.28 | 90.49 | 73.78 | 76.45 | 91.63 | 72.86 |
| 3 | 70.53 | 58.56 | 38.98 | 83.64 | 46.91 | 51.88 | 59.82 | 65.28 |
| 4 | 94.43 | 117.59 | 69.63 | 123.75 | 66.31 | 93.68 | 72.75 | 107.37 |
| 5 | 16.19 | 18.66 | 19.29 | 27.82 | 14.44 | 18.02 | 15.58 | 31.03 |
| 6 | 7.33 | 8.28 | 6.37 | 11.85 | 5.42 | 7.40 | 8.02 | 9.34 |
| 7 | 0.30 | 0.33 | 0.24 | 0.44 | 0.21 | 0.35 | 0.24 | 0.38 |
| 8 | NA | 67.40 | 38.22 | 76.45 | 49.40 | 43.69 | NA | 49.94 |
| 9 | 24.25 | 35.25 | 65.00 | 26.50 | 38.75 | 35.50 | 49.75 | 22.25 |
| 10 | 19.39 | 40.69 | 36.57 | 19.08 | 17.38 | 41.36 | 42.84 | 22.62 |
| 11 | NA | 48.72 | 38.91 | 67.38 | 41.28 | 55.89 | 28.70 | NA |
| 12 | 0.97 | 0.85 | 0.91 | 0.85 | 0.72 | 1.06 | 0.81 | 1.07 |
| 13 | 13.34 | 11.64 | 11.14 | 13.15 | 11.99 | 12.35 | 12.64 | 11.99 |
| 14 | 8.16 | 8.83 | 7.03 | 8.42 | 7.85 | 8.13 | 7.78 | 7.61 |
| 15 | 211.67 | 307.13 | 133.13 | 308.07 | 157.53 | 155.00 | 192.00 | 273.47 |
| 16 | 1.64 | 1.32 | 1.58 | 1.56 | 1.53 | 1.52 | 1.63 | 1.58 |
| 17 | 4.73 | 6.07 | 4.73 | 6.17 | 5.00 | 5.42 | 5.87 | 6.13 |
| 18 | 7.93 | 6.20 | 7.93 | 7.00 | 9.67 | 7.53 | 9.20 | 8.87 |
| 19 | 4.90 | 4.90 | 5.80 | 6.60 | 5.10 | 5.70 | 5.50 | 6.00 |
| 20 | 8.44 | 7.85 | 5.78 | 7.61 | 6.29 | 6.60 | 6.74 | 6.77 |
| 21 | 6.15 | 5.84 | 4.38 | 4.01 | 4.95 | NA | 3.73 | 2.88 |
| 22 | 3.27 | 3.06 | 1.33 | 5.01 | 1.58 | 1.74 | 2.25 | 3.34 |
| 23 | 36.84 | 34.83 | 31.52 | 37.71 | 28.88 | 39.83 | 30.44 | 41.27 |
| 24 | 4.39 | 4.80 | 3.68 | 5.75 | 3.93 | 4.50 | 4.68 | 6.16 |
| 25 | 11.43 | 11.17 | 7.60 | 16.57 | 8.40 | 9.67 | 11.23 | 15.33 |
| 26 | 11.67 | 15.20 | 15.96 | 23.07 | 17.06 | 15.12 | 19.48 | 18.88 |
| 27 | 40.19 | 36.22 | 37.68 | NA | 39.40 | NA | NA | 43.01 |
| 28 | 36.00 | 39.44 | 31.41 | 40.15 | 35.76 | 35.01 | 35.75 | 35.13 |
| 29 | 342.44 | 457.16 | 196.69 | 430.61 | 198.09 | 371.13 | 431.52 | 533.60 |
| 30 | 6.31 | 8.29 | 4.53 | 9.20 | 4.02 | 6.55 | 7.92 | 9.62 |

TABLE 155-continued

Measured parameters in bean varieties ("fine" and "extra fine") (lines 1-8)

| Ecotype/Treatment | Line-1 | Line-2 | Line-3 | Line-4 | Line-5 | Line-6 | Line-7 | Line-8 |
|---|---|---|---|---|---|---|---|---|
| 31 | 3635.20 | 3879.60 | 2875.20 | 3485.80 | 3012.20 | 3953.80 | 5946.60 | 4920.20 |
| 32 | 0.62 | 2.06 | 1.15 | 0.60 | 0.80 | 1.27 | 0.00 | 0.73 |
| 33 | 0.50 | 6.00 | 9.50 | 1.50 | 1.00 | 5.00 | 8.75 | 0.50 |
| 34 | 226.25 | 222.25 | 213.00 | 207.31 | 257.81 | 238.23 | 248.17 | 237.69 |
| 35 | 5.79 | 5.84 | 5.40 | 5.83 | 4.91 | 6.00 | 5.29 | 5.54 |
| 36 | 12.76 | 20.71 | 13.89 | 30.42 | 15.31 | 10.75 | 21.88 | 23.49 |
| 37 | 27.13 | 24.73 | 46.07 | 38.27 | 38.27 | 18.86 | 44.07 | 33.93 |
| 38 | 33.07 | 33.93 | 31.58 | 20.94 | 46.00 | 24.33 | 30.27 | 27.33 |
| 39 | 32.96 | 105.04 | 61.14 | 33.15 | 41.19 | 81.76 | 2.98 | 42.96 |
| 40 | 3.32 | 4.68 | 2.81 | 3.93 | 3.09 | 3.77 | 3.87 | 3.78 |
| 41 | 2.64 | 2.35 | 1.02 | 0.63 | 1.61 | 0.81 | 1.58 | 3.15 |
| 42 | 90.47 | 111.33 | 128.60 | 151.80 | 138.20 | 70.53 | 168.40 | 128.80 |
| 43 | 87.60 | 79.00 | 29.38 | 9.17 | 77.93 | 20.00 | 50.13 | 84.60 |
| 44 | NA | 3.45 | 0.50 | 0.17 | 2.88 | 0.39 | NA | 2.30 |
| 45 | 16.30 | 13.53 | 18.80 | 12.64 | 17.03 | 9.99 | 12.29 | 13.71 |
| 46 | 91.61 | 65.65 | 61.83 | 71.07 | 77.53 | 56.83 | 47.66 | 70.77 |
| 47 | 0.92 | 2.03 | 1.67 | 0.84 | 1.35 | NA | 1.52 | 1.39 |
| 48 | 0.44 | 0.46 | 0.35 | 1.18 | 0.38 | 0.39 | 0.45 | 0.58 |

Table 155.

TABLE 156

Measured parameters in bean varieties ("fine" and "extra fine") (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 1 | 84.42 | NA | 83.89 | NA | 83.40 | NA | 79.59 | 75.12 |
| 2 | 83.06 | 86.63 | 82.53 | 83.35 | 84.21 | 73.07 | 71.41 | 68.05 |
| 3 | 64.09 | 89.99 | 62.34 | 63.42 | 61.26 | 38.21 | 40.26 | 26.24 |
| 4 | 121.34 | 120.75 | 96.79 | 116.14 | 94.55 | 82.93 | 111.76 | 70.74 |
| 5 | 18.65 | 21.95 | 21.76 | 17.00 | 18.75 | 14.78 | 18.54 | 15.10 |
| 6 | 6.97 | 11.21 | 6.31 | 11.99 | 10.58 | 7.35 | 7.44 | 5.21 |
| 7 | 0.36 | 0.54 | 0.21 | 0.48 | 0.36 | 0.20 | 0.30 | 0.21 |
| 8 | 49.06 | 76.18 | NA | NA | 61.66 | 23.67 | 89.21 | NA |
| 9 | 23.25 | 28.25 | 32.00 | 32.75 | 34.17 | 46.50 | 23.50 | 68.75 |
| 10 | 32.83 | 31.13 | 46.08 | 28.64 | 20.56 | 46.23 | 23.70 | 22.64 |
| 11 | 51.24 | 51.21 | 37.34 | 58.24 | 82.14 | 44.70 | NA | 71.49 |
| 12 | 1.18 | 1.30 | 0.94 | 0.98 | 0.88 | 0.79 | 0.96 | 0.71 |
| 13 | 12.79 | 12.17 | 10.39 | 11.16 | 13.10 | 11.79 | 11.63 | 12.88 |
| 14 | 7.52 | 7.73 | 6.26 | 7.05 | 8.23 | 7.10 | 7.33 | 8.68 |
| 15 | 180.73 | 324.07 | 175.80 | 242.20 | 200.60 | 174.00 | 146.89 | 61.67 |
| 16 | 1.70 | 1.58 | 1.67 | 1.59 | 1.59 | 1.66 | 1.59 | 1.48 |
| 17 | 4.13 | 7.17 | 7.00 | 6.19 | 5.13 | 4.53 | 5.11 | 3.64 |
| 18 | 9.00 | 6.94 | 8.27 | 6.53 | 8.20 | 6.93 | 8.67 | 10.67 |
| 19 | 6.00 | 6.92 | 7.60 | 6.40 | 8.40 | 6.20 | 6.00 | 4.60 |
| 20 | 7.02 | 7.40 | 6.21 | 6.42 | 8.40 | 5.11 | 4.66 | 4.56 |
| 21 | 5.16 | NA | 4.78 | NA | 4.67 | NA | 4.20 | 4.01 |
| 22 | 3.63 | 6.30 | 3.50 | 3.07 | 2.66 | 1.14 | 1.28 | 0.76 |
| 23 | 44.56 | 53.17 | 34.74 | 37.49 | 35.73 | 29.54 | 34.89 | 26.25 |
| 24 | 5.54 | 6.16 | 4.33 | 6.53 | 4.61 | 3.46 | 4.98 | 3.50 |
| 25 | 11.67 | 23.17 | 7.83 | 19.13 | 10.50 | 8.70 | 8.72 | 5.90 |
| 26 | 15.89 | 17.87 | 11.83 | 17.01 | 11.16 | 12.83 | 20.16 | 19.53 |
| 27 | 42.34 | NA | 34.00 | NA | 37.81 | NA | 31.09 | 34.70 |
| 28 | 34.16 | 34.50 | 30.78 | 38.38 | 37.03 | 34.21 | 26.07 | 29.34 |
| 29 | 482.22 | 290.77 | 426.57 | 501.09 | 102.62 | 170.90 | 334.59 | 330.59 |
| 30 | 9.05 | 5.42 | 7.37 | 8.24 | 1.94 | 3.70 | 9.76 | 10.16 |
| 31 | 3978.60 | 2416.50 | 4403.00 | 4356.20 | 1164.40 | 2036.80 | 2987.20 | 4661.80 |
| 32 | 1.23 | 1.47 | 1.40 | 0.90 | 0.61 | 0.00 | 1.66 | 1.03 |
| 33 | 1.75 | 2.00 | 6.25 | 2.25 | 0.83 | 9.50 | 0.00 | 3.25 |
| 34 | 220.62 | 250.40 | 236.94 | 203.46 | 211.37 | 255.60 | 228.00 | 251.56 |
| 35 | 5.54 | 6.05 | 5.09 | 5.65 | 6.28 | 5.55 | 5.64 | 4.63 |
| 36 | 18.86 | 13.01 | 18.17 | 18.92 | 9.77 | 23.52 | 24.60 | 28.08 |
| 37 | 30.00 | 22.06 | 25.20 | 24.07 | 23.53 | 63.57 | 24.53 | 43.93 |
| 38 | 22.25 | 23.17 | 25.33 | 24.93 | 32.40 | 26.87 | 22.33 | 43.40 |
| 39 | 82.63 | 91.03 | 85.27 | 62.23 | 36.42 | 1.79 | 52.44 | 40.39 |
| 40 | 3.66 | 3.08 | 4.79 | 4.27 | 3.02 | 1.82 | 5.30 | 5.12 |
| 41 | 2.52 | 0.35 | 3.65 | 4.93 | 2.48 | 1.12 | 1.83 | 1.42 |
| 42 | 98.53 | 65.11 | 118.07 | 103.20 | 70.33 | 111.93 | 126.73 | 224.00 |
| 43 | 58.55 | 12.54 | 91.07 | 97.07 | 81.40 | 31.71 | 45.43 | 62.29 |
| 44 | 1.53 | 1.01 | NA | NA | 3.74 | 0.30 | 1.54 | NA |
| 45 | NA | 8.80 | 11.70 | 12.91 | 18.53 | 10.76 | 17.40 | 14.32 |

TABLE 156-continued

Measured parameters in bean varieties ("fine" and "extra fine") (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 46 | 70.87 | 66.76 | 61.77 | 69.11 | 86.77 | 52.76 | 116.85 | 71.51 |
| 47 | 0.84 | 1.65 | 0.93 | NA | 0.37 | 1.39 | 1.43 | 1.34 |
| 48 | 0.35 | 0.69 | 0.39 | 0.64 | 0.54 | 0.42 | 0.36 | 0.25 |

Table 156.

TABLE 157

Correlation between the expression level of selected genes of some embodiments of the invention in various tissues and the phenotypic performance under normal conditions across 40 bean varieties

| Gene Name | R | P value | Exp. set | Corr. Set ID | Gene Name | R | P value | Exp. set | Corr. Set ID |
|---|---|---|---|---|---|---|---|---|---|
| LGP84 | 0.72 | 1.22E−02 | 4 | 27 | LGP84 | 0.76 | 1.06E−04 | 4 | 46 |
| LGP84 | 0.79 | 4.04E−03 | 9 | 27 | LGP85 | 0.72 | 3.25E−04 | 9 | 40 |
| LYD701 | 0.73 | 6.02E−04 | 2 | 9 | LYD702 | 0.81 | 1.50E−06 | 5 | 43 |
| LYD702 | 0.74 | 1.79E−03 | 5 | 44 | LYD702 | 0.73 | 2.86E−03 | 3 | 27 |
| LYD702 | 0.75 | 6.21E−07 | 6 | 38 | LYD703 | 0.87 | 1.17E−03 | 2 | 27 |
| LYD705 | 0.85 | 1.18E−07 | 5 | 46 | LYD705 | 0.77 | 7.09E−04 | 5 | 44 |
| LYD706 | 0.73 | 2.69E−04 | 9 | 9 | LYD706 | 0.8 | 2.55E−06 | 5 | 43 |
| LYD706 | 0.79 | 4.18E−04 | 5 | 44 | LYD713 | 0.72 | 1.70E−03 | 1 | 44 |
| LYD713 | 0.83 | 1.92E−05 | 2 | 25 | LYD713 | 0.73 | 1.55E−02 | 2 | 27 |
| LYD713 | 0.75 | 3.27E−04 | 2 | 23 | LYD717 | 0.73 | 2.62E−04 | 9 | 4 |
| LYD717 | 0.71 | 2.24E−04 | 7 | 29 | LYD718 | 0.78 | 3.29E−04 | 1 | 44 |
| LYD718 | 0.77 | 6.00E−05 | 9 | 33 | LYD719 | 0.76 | 5.46E−05 | 3 | 46 |
| LYD720 | 0.72 | 1.28E−02 | 4 | 27 | LYD721 | 0.76 | 1.18E−04 | 9 | 33 |
| LYD722 | 0.76 | 2.37E−04 | 2 | 43 | LYD722 | 0.72 | 6.72E−04 | 2 | 41 |
| LYD722 | 0.77 | 8.76E−04 | 2 | 44 | LYD722 | 0.76 | 1.04E−04 | 7 | 48 |
| LYD723 | 0.76 | 1.06E−03 | 2 | 44 | LYD723 | 0.71 | 9.72E−05 | 5 | 43 |
| LYD723 | 0.75 | 1.39E−03 | 5 | 44 | LYD723 | 0.71 | 1.01E−03 | 7 | 45 |
| LYD725 | 0.71 | 4.61E−03 | 2 | 45 | LYD725 | 0.73 | 1.31E−04 | 7 | 38 |
| LYD726 | 0.71 | 3.33E−03 | 7 | 8 | LYD727 | 0.75 | 2.95E−03 | 2 | 1 |
| LYD729 | 0.72 | 3.83E−04 | 4 | 28 | LYD729 | 0.75 | 3.10E−03 | 2 | 21 |
| LYD731 | 0.82 | 3.47E−05 | 2 | 4 | LYD731 | 0.76 | 2.75E−04 | 2 | 7 |
| LYD731 | 0.7 | 2.61E−04 | 7 | 22 | LYD731 | 0.75 | 5.02E−03 | 6 | 8 |
| LYD733 | 0.72 | 2.27E−04 | 6 | 1 | LYD738 | 0.7 | 1.15E−03 | 2 | 14 |
| LYD738 | 0.8 | 7.29E−05 | 2 | 28 | LYD739 | 0.72 | 1.74E−05 | 7 | 5 |
| LYD739 | 0.71 | 1.04E−03 | 2 | 9 | LYD739 | 0.72 | 1.67E−04 | 7 | 46 |
| LYD739 | 0.75 | 1.21E−03 | 7 | 8 | LYD742 | 0.73 | 2.42E−04 | 9 | 20 |
| LYD742 | 0.71 | 9.42E−04 | 2 | 19 | LYD745 | 0.75 | 1.26E−04 | 9 | 42 |
| LYD742 | 0.7 | 5.50E−04 | 9 | 23 | LYD747 | 0.77 | 8.34E−05 | 9 | 33 |
| LYD745 | 0.75 | 6.72E−05 | 7 | 17 | LYD749 | 0.7 | 2.41E−02 | 2 | 27 |
| LYD748 | 0.75 | 2.99E−04 | 2 | 2 | LYD750 | 0.73 | 2.36E−04 | 4 | 42 |
| LYD749 | 0.71 | 3.08E−04 | 3 | 48 | LYD752 | 0.72 | 2.60E−03 | 5 | 1 |
| LYD752 | 0.77 | 7.05E−04 | 5 | 21 | LYD753 | 0.76 | 2.79E−04 | 2 | 46 |
| LYD753 | 0.72 | 6.87E−04 | 2 | 43 | LYD753 | 0.74 | 3.04E−05 | 5 | 43 |
| LYD753 | 0.8 | 3.10E−04 | 2 | 44 | LYD754 | 0.75 | 1.52E−04 | 4 | 37 |
| LYD753 | 0.81 | 2.86E−04 | 5 | 44 | LYD754 | 0.73 | 5.42E−05 | 5 | 42 |
| LYD754 | 0.83 | 6.15E−06 | 9 | 37 | LYD755 | 0.75 | 1.35E−04 | 9 | 10 |
| LYD754 | 0.76 | 1.71E−05 | 5 | 37 | LYD756 | 0.7 | 5.38E−04 | 9 | 4 |
| LYD755 | 0.76 | 4.20E−03 | 5 | 27 | LYD761 | 0.72 | 2.50E−03 | 7 | 8 |
| LYD757 | 0.75 | 7.31E−03 | 3 | 8 | LYD765 | 0.73 | 2.92E−04 | 4 | 7 |
| LYD765 | 0.71 | 1.04E−06 | 1 | 37 | LYD765 | 0.72 | 3.84E−04 | 9 | 4 |
| LYD765 | 0.7 | 1.14E−03 | 2 | 38 | LYD765 | 0.79 | 1.87E−05 | 3 | 3 |
| LYD765 | 0.73 | 1.53E−04 | 3 | 22 | LYD768 | 0.71 | 9.74E−04 | 2 | 19 |
| LYD767 | 0.76 | 6.24E−04 | 1 | 44 | LYD768 | 0.84 | 2.20E−07 | 5 | 4 |
| LYD768 | 0.77 | 4.81E−04 | 2 | 11 | LYD769 | 0.78 | 2.06E−05 | 7 | 46 |
| LYD769 | 0.71 | 9.51E−04 | 2 | 3 | LYD771 | 0.73 | 5.44E−04 | 2 | 43 |
| LYD773 | 0.71 | 9.72E−04 | 2 | 46 | LYD774 | 0.75 | 2.52E−05 | 5 | 46 |
| LYD776 | 0.78 | 5.36E−05 | 4 | 13 | LYD776 | 0.73 | 5.17E−04 | 2 | 46 |
| LYD777 | 0.7 | 2.30E−02 | 2 | 27 | LYD777 | 0.7 | 5.59E−04 | 9 | 9 |
| LYD780 | 0.71 | 3.26E−03 | 5 | 44 | LYD780 | 0.71 | 3.35E−04 | 3 | 46 |
| LYD782 | 0.74 | 4.11E−03 | 2 | 21 | LYD782 | 0.71 | 6.28E−03 | 2 | 1 |
| LYD783 | 0.76 | 1.03E−04 | 9 | 4 | LYD783 | 0.71 | 1.44E−06 | 8 | 7 |
| LYD785 | 0.8 | 2.42E−06 | 5 | 46 | LYD788 | 0.71 | 6.72E−03 | 2 | 21 |
| LYD788 | 0.8 | 2.14E−04 | 3 | 21 | LYD791 | 0.73 | 2.87E−04 | 9 | 9 |
| LYD791 | 0.8 | 2.36E−04 | 9 | 33 | LYD794 | 0.73 | 3.42E−04 | 4 | 48 |
| LYD795 | 0.84 | 1.33E−03 | 4 | 27 | LYD796 | 0.76 | 6.14E−05 | 3 | 37 |
| LYD797 | 0.73 | 1.02E−02 | 3 | 44 | LYD798 | 0.71 | 4.06E−04 | 9 | 32 |
| LYD798 | 0.71 | 1.38E−03 | 9 | 44 | LYD798 | 0.83 | 1.32E−04 | 7 | 8 |
| LYD803 | 0.71 | 4.87E−04 | 4 | 7 | LYD803 | 0.72 | 2.29E−03 | 7 | 8 |

TABLE 157-continued

Correlation between the expression level of selected genes of some embodiments of the invention in various tissues and the phenotypic performance under normal conditions across 40 bean varieties

| Gene Name | R | P value | Exp. set | Corr. Set ID | Gene Name | R | P value | Exp. set | Corr. Set ID |
|---|---|---|---|---|---|---|---|---|---|
| LYD809 | 0.75 | 2.44E−05 | 5 | 46 | LYD810 | 0.76 | 2.92E−04 | 2 | 46 |
| LYD810 | 0.71 | 2.12E−04 | 7 | 4 | LYD810 | 0.7 | 2.84E−04 | 7 | 7 |
| LYD811 | 0.72 | 8.51E−04 | 2 | 38 | LYD811 | 0.84 | 2.52E−05 | 2 | 48 |
| LYD812 | 0.77 | 5.47E−04 | 1 | 8 | LYD815 | 0.7 | 1.30E−04 | 5 | 24 |
| LYD815 | 0.71 | 1.09E−04 | 5 | 7 | LYD816 | 0.75 | 1.33E−03 | 2 | 8 |
| LYD817 | 0.78 | 1.26E−04 | 4 | 11 | LYD817 | 0.72 | 8.38E−04 | 2 | 38 |
| LYD818 | 0.71 | 1.08E−06 | 1 | 4 | LYD821 | 0.72 | 6.98E−04 | 2 | 46 |
| LYD822 | 0.77 | 9.28E−06 | 5 | 24 | LYD822 | 0.74 | 4.11E−05 | 5 | 4 |
| LYD822 | 0.74 | 3.64E−05 | 5 | 25 | LYD822 | 0.78 | 6.34E−06 | 5 | 7 |
| LYD822 | 0.71 | 1.03E−04 | 5 | 15 | LYD823 | 0.73 | 2.86E−04 | 9 | 7 |
| LYD826 | 0.73 | 1.01E−02 | 3 | 44 | LYD827 | 0.72 | 6.55E−05 | 5 | 46 |
| LYD829 | 0.77 | 5.02E−05 | 3 | 4 | LYD829 | 0.73 | 1.98E−04 | 3 | 25 |
| LYD830 | 0.72 | 6.86E−05 | 5 | 43 | LYD830 | 0.77 | 7.63E−04 | 5 | 44 |
| LYD927 | 0.7 | 1.85E−06 | 8 | 20 | LYD930 | 0.79 | 2.88E−05 | 9 | 10 |

Table 157. Provided are the correlations (R) between the expression levels yield improving genes and their homologs in various tissues [Expression (Exp) sets] and the phenotypic performance [yield, biomass, and plant architecture (Correlation vector (Cor))] under normal conditions across bean varieties.
P = p value.

TABLE 158

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LGP71 | 0.85 | 9.05E−04 | 2 | 46 | LGP71 | 0.71 | 1.46E−02 | 3 | 38 |
| LGP71 | 0.74 | 9.69E−03 | 3 | 45 | LGP71 | 0.71 | 4.75E−02 | 3 | 11 |
| LGP71 | 0.74 | 6.41E−03 | 6 | 18 | LGP84 | 0.78 | 7.37E−03 | 1 | 27 |
| LGP84 | 0.71 | 2.09E−03 | 1 | 6 | LGP84 | 0.86 | 1.28E−02 | 4 | 27 |
| LGP84 | 0.85 | 3.94E−04 | 4 | 46 | LGP84 | 0.73 | 1.65E−02 | 4 | 11 |
| LGP84 | 0.77 | 1.58E−02 | 2 | 21 | LGP84 | 0.73 | 6.95E−03 | 9 | 32 |
| LGP84 | 0.80 | 2.90E−02 | 9 | 27 | LGP84 | 0.71 | 3.36E−02 | 9 | 1 |
| LGP84 | 0.73 | 1.00E−02 | 9 | 8 | LGP84 | 0.73 | 6.65E−03 | 9 | 46 |
| LGP84 | 0.81 | 5.25E−03 | 5 | 27 | LGP84 | 0.71 | 2.20E−03 | 8 | 24 |
| LGP84 | 0.73 | 1.42E−03 | 8 | 7 | LGP84 | 0.71 | 2.23E−02 | 7 | 18 |
| LGP84 | 0.74 | 1.34E−02 | 7 | 13 | LGP84 | 0.84 | 1.80E−02 | 3 | 27 |
| LGP84 | 0.72 | 4.33E−02 | 3 | 11 | LGP84 | 0.70 | 1.10E−02 | 6 | 42 |
| LGP84 | 0.77 | 3.65E−03 | 6 | 26 | LGP84 | 0.77 | 3.22E−03 | 6 | 36 |
| LGP84 | 0.81 | 1.50E−03 | 6 | 30 | LGP84 | 0.87 | 2.37E−02 | 6 | 27 |
| LGP85 | 0.87 | 2.62E−04 | 4 | 48 | LGP85 | 0.82 | 2.14E−03 | 2 | 40 |
| LGP85 | 0.79 | 3.90E−03 | 2 | 46 | LGP85 | 0.75 | 4.62E−03 | 9 | 40 |
| LGP85 | 0.74 | 9.57E−03 | 5 | 5 | LGP85 | 0.79 | 2.61E−04 | 8 | 48 |
| LGP85 | 0.77 | 1.53E−02 | 7 | 8 | LGP85 | 0.79 | 6.87E−03 | 7 | 40 |
| LGP85 | 0.76 | 8.01E−02 | 6 | 27 | LGP85 | 0.73 | 6.66E−03 | 6 | 5 |
| LYD701 | 0.80 | 1.86E−04 | 1 | 9 | LYD701 | 0.73 | 7.46E−03 | 4 | 37 |
| LYD701 | 0.73 | 1.04E−02 | 2 | 24 | LYD701 | 0.80 | 3.36E−03 | 2 | 9 |
| LYD701 | 0.85 | 9.18E−04 | 2 | 25 | LYD701 | 0.76 | 6.15E−03 | 2 | 33 |
| LYD701 | 0.71 | 1.52E−02 | 2 | 7 | LYD701 | 0.80 | 3.45E−03 | 2 | 22 |
| LYD701 | 0.74 | 9.78E−03 | 2 | 3 | LYD701 | 0.82 | 1.10E−03 | 9 | 32 |
| LYD701 | 0.86 | 2.67E−03 | 9 | 21 | LYD701 | 0.83 | 7.71E−04 | 9 | 39 |
| LYD701 | 0.78 | 4.64E−03 | 3 | 33 | LYD701 | 0.84 | 1.29E−03 | 3 | 37 |
| LYD701 | 0.73 | 1.09E−02 | 3 | 48 | LYD701 | 0.74 | 5.47E−03 | 6 | 9 |
| LYD701 | 0.72 | 8.38E−03 | 6 | 33 | LYD702 | 0.90 | 1.83E−04 | 5 | 43 |
| LYD702 | 0.80 | 3.17E−03 | 5 | 41 | LYD702 | 0.81 | 5.22E−02 | 5 | 27 |
| LYD702 | 0.83 | 5.84E−03 | 5 | 44 | LYD702 | 0.72 | 1.23E−02 | 3 | 41 |
| LYD702 | 0.82 | 1.02E−03 | 6 | 18 | LYD702 | 0.81 | 1.38E−03 | 6 | 38 |
| LYD702 | 0.81 | 2.60E−02 | 6 | 44 | LYD703 | 0.83 | 2.06E−02 | 4 | 27 |
| LYD703 | 0.97 | 3.23E−04 | 2 | 27 | LYD703 | 0.77 | 3.52E−03 | 9 | 39 |
| LYD703 | 0.93 | 7.80E−03 | 5 | 27 | LYD703 | 0.75 | 8.42E−04 | 8 | 4 |
| LYD703 | 0.72 | 1.56E−03 | 8 | 5 | LYD703 | 0.71 | 1.90E−03 | 8 | 48 |
| LYD703 | 0.70 | 2.41E−03 | 8 | 3 | LYD703 | 0.90 | 3.75E−04 | 7 | 2 |
| LYD703 | 0.79 | 6.07E−03 | 7 | 20 | LYD703 | 0.82 | 3.76E−03 | 7 | 28 |
| LYD703 | 0.77 | 9.62E−03 | 7 | 14 | LYD703 | 0.80 | 3.01E−02 | 7 | 27 |
| LYD703 | 0.74 | 1.52E−02 | 7 | 48 | LYD703 | 0.76 | 1.02E−02 | 7 | 22 |
| LYD703 | 0.86 | 1.61E−03 | 7 | 3 | LYD703 | 0.90 | 3.26E−04 | 7 | 13 |
| LYD703 | 0.76 | 6.75E−03 | 3 | 28 | LYD703 | 0.71 | 1.40E−02 | 3 | 7 |
| LYD703 | 0.83 | 1.96E−02 | 3 | 27 | LYD703 | 0.85 | 9.45E−04 | 3 | 15 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD703 | 0.71 | 1.36E-02 | 3 | 6 | LYD703 | 0.77 | 8.68E-03 | 6 | 11 |
| LYD704 | 0.88 | 1.55E-03 | 9 | 21 | LYD704 | 0.79 | 1.10E-02 | 9 | 1 |
| LYD704 | 0.78 | 4.25E-03 | 5 | 41 | LYD704 | 0.71 | 2.17E-02 | 7 | 2 |
| LYD704 | 0.78 | 6.63E-02 | 6 | 27 | LYD705 | 0.70 | 2.48E-03 | 1 | 41 |
| LYD705 | 0.75 | 4.72E-03 | 4 | 34 | LYD705 | 0.74 | 9.38E-03 | 5 | 43 |
| LYD705 | 0.72 | 1.29E-02 | 5 | 41 | LYD705 | 0.73 | 2.48E-02 | 5 | 44 |
| LYD705 | 0.76 | 1.15E-02 | 7 | 2 | LYD705 | 0.73 | 2.61E-02 | 7 | 8 |
| LYD705 | 0.80 | 2.90E-03 | 3 | 45 | LYD705 | 0.75 | 1.30E-02 | 6 | 11 |
| LYD706 | 0.71 | 2.18E-03 | 1 | 31 | LYD706 | 0.78 | 2.50E-03 | 9 | 9 |
| LYD706 | 0.78 | 2.87E-03 | 9 | 33 | LYD706 | 0.86 | 6.34E-04 | 5 | 43 |
| LYD706 | 0.90 | 1.65E-04 | 5 | 41 | LYD706 | 0.73 | 1.63E-02 | 7 | 2 |
| LYD706 | 0.84 | 1.22E-03 | 3 | 46 | LYD706 | 0.81 | 4.78E-03 | 6 | 11 |
| LYD707 | 0.75 | 5.36E-03 | 4 | 43 | LYD707 | 0.80 | 1.69E-02 | 4 | 38 |
| LYD707 | 0.72 | 1.90E-02 | 2 | 44 | LYD707 | 0.74 | 8.52E-03 | 5 | 43 |
| LYD707 | 0.71 | 3.22E-02 | 5 | 44 | LYD707 | 0.91 | 6.31E-04 | 7 | 8 |
| LYD707 | 0.76 | 1.12E-02 | 7 | 40 | LYD707 | 0.70 | 2.41E-02 | 7 | 46 |
| LYD707 | 0.79 | 3.93E-03 | 3 | 46 | LYD707 | 0.73 | 7.24E-03 | 6 | 30 |
| LYD708 | 0.71 | 9.04E-03 | 4 | 10 | LYD708 | 0.70 | 1.57E-02 | 2 | 2 |
| LYD708 | 0.78 | 4.84E-03 | 2 | 20 | LYD708 | 0.74 | 9.47E-03 | 2 | 28 |
| LYD708 | 0.75 | 5.00E-02 | 2 | 27 | LYD708 | 0.75 | 8.11E-03 | 2 | 15 |
| LYD708 | 0.79 | 3.91E-03 | 2 | 22 | LYD708 | 0.77 | 5.64E-03 | 2 | 3 |
| LYD708 | 0.79 | 1.21E-02 | 9 | 21 | LYD708 | 0.77 | 3.66E-03 | 9 | 39 |
| LYD708 | 0.82 | 1.83E-03 | 5 | 33 | LYD708 | 0.70 | 2.28E-02 | 7 | 18 |
| LYD708 | 0.71 | 2.02E-02 | 7 | 34 | LYD708 | 0.82 | 1.87E-03 | 3 | 48 |
| LYD710 | 0.81 | 2.77E-03 | 2 | 43 | LYD710 | 0.70 | 1.65E-02 | 2 | 41 |
| LYD710 | 0.81 | 4.73E-03 | 2 | 44 | LYD710 | 0.85 | 9.84E-04 | 5 | 43 |
| LYD710 | 0.85 | 3.90E-03 | 5 | 44 | LYD710 | 0.70 | 2.49E-03 | 8 | 9 |
| LYD710 | 0.71 | 2.06E-02 | 7 | 28 | LYD710 | 0.83 | 2.83E-03 | 7 | 14 |
| LYD710 | 0.71 | 2.15E-02 | 7 | 15 | LYD710 | 0.77 | 9.83E-03 | 7 | 22 |
| LYD710 | 0.80 | 9.51E-03 | 7 | 1 | LYD710 | 0.71 | 2.20E-02 | 7 | 3 |
| LYD710 | 0.84 | 1.35E-03 | 3 | 43 | LYD710 | 0.82 | 1.84E-03 | 3 | 41 |
| LYD710 | 0.80 | 1.68E-02 | 3 | 44 | LYD710 | 0.73 | 6.72E-03 | 6 | 32 |
| LYD710 | 0.77 | 3.40E-03 | 6 | 20 | LYD710 | 0.72 | 6.88E-02 | 6 | 8 |
| LYD711 | 0.76 | 6.95E-04 | 1 | 42 | LYD711 | 0.77 | 9.33E-03 | 7 | 48 |
| LYD711 | 0.84 | 1.72E-02 | 3 | 27 | LYD711 | 0.75 | 4.99E-03 | 6 | 42 |
| LYD711 | 0.83 | 9.15E-04 | 6 | 37 | LYD713 | 0.73 | 7.29E-03 | 4 | 37 |
| LYD713 | 0.75 | 8.03E-03 | 2 | 2 | LYD713 | 0.75 | 7.56E-03 | 2 | 24 |
| LYD713 | 0.81 | 2.28E-03 | 2 | 20 | LYD713 | 0.83 | 1.56E-03 | 2 | 28 |
| LYD713 | 0.91 | 1.26E-04 | 2 | 25 | LYD713 | 0.86 | 7.36E-04 | 2 | 7 |
| LYD713 | 0.71 | 1.41E-02 | 2 | 12 | LYD713 | 0.79 | 3.27E-02 | 2 | 27 |
| LYD713 | 0.79 | 4.05E-03 | 2 | 17 | LYD713 | 0.81 | 2.68E-03 | 2 | 22 |
| LYD713 | 0.79 | 3.56E-03 | 2 | 3 | LYD713 | 0.83 | 1.39E-03 | 2 | 23 |
| LYD713 | 0.74 | 9.11E-03 | 2 | 6 | LYD713 | 0.80 | 8.93E-03 | 2 | 11 |
| LYD713 | 0.88 | 3.74E-04 | 2 | 13 | LYD713 | 0.78 | 2.99E-03 | 9 | 9 |
| LYD713 | 0.81 | 1.35E-03 | 9 | 33 | LYD713 | 0.75 | 2.01E-02 | 9 | 1 |
| LYD713 | 0.72 | 1.25E-02 | 5 | 17 | LYD713 | 0.81 | 1.44E-02 | 5 | 1 |
| LYD713 | 0.74 | 1.12E-03 | 8 | 5 | LYD713 | 0.80 | 3.37E-03 | 3 | 26 |
| LYD713 | 0.75 | 8.38E-03 | 3 | 35 | LYD713 | 0.73 | 1.15E-02 | 3 | 25 |
| LYD713 | 0.70 | 1.63E-02 | 3 | 7 | LYD713 | 0.80 | 3.10E-03 | 3 | 48 |
| LYD713 | 0.76 | 1.79E-02 | 3 | 1 | LYD713 | 0.89 | 3.34E-03 | 3 | 11 |
| LYD713 | 0.82 | 1.11E-03 | 6 | 19 | LYD714 | 0.79 | 2.18E-03 | 4 | 20 |
| LYD714 | 0.84 | 6.82E-04 | 4 | 28 | LYD714 | 0.88 | 1.91E-04 | 4 | 14 |
| LYD714 | 0.73 | 7.54E-03 | 4 | 15 | LYD714 | 0.77 | 3.38E-03 | 4 | 48 |
| LYD714 | 0.70 | 1.07E-02 | 4 | 6 | LYD714 | 0.74 | 2.18E-02 | 2 | 21 |
| LYD714 | 0.73 | 1.11E-02 | 2 | 14 | LYD714 | 0.73 | 1.62E-02 | 5 | 45 |
| LYD714 | 0.71 | 2.14E-02 | 7 | 15 | LYD714 | 0.82 | 3.75E-03 | 7 | 48 |
| LYD714 | 0.80 | 3.26E-03 | 3 | 43 | LYD714 | 0.72 | 2.92E-02 | 3 | 21 |
| LYD714 | 0.77 | 6.08E-03 | 3 | 41 | LYD714 | 0.88 | 3.51E-03 | 3 | 44 |
| LYD714 | 0.88 | 4.25E-03 | 6 | 21 | LYD714 | 0.74 | 2.13E-02 | 2 | 11 |
| LYD715 | 0.82 | 9.57E-04 | 9 | 32 | LYD715 | 0.78 | 3.01E-03 | 9 | 39 |
| LYD715 | 0.80 | 5.57E-03 | 7 | 19 | LYD715 | 0.74 | 1.44E-02 | 7 | 20 |
| LYD715 | 0.77 | 2.46E-02 | 7 | 11 | LYD715 | 0.72 | 1.94E-02 | 7 | 13 |
| LYD715 | 0.71 | 1.48E-02 | 3 | 16 | LYD717 | 0.72 | 8.69E-03 | 4 | 18 |
| LYD717 | 0.80 | 3.38E-03 | 4 | 45 | LYD717 | 0.84 | 1.11E-03 | 2 | 29 |
| LYD717 | 0.78 | 2.88E-03 | 9 | 4 | LYD717 | 0.77 | 3.20E-03 | 9 | 39 |
| LYD717 | 0.76 | 6.27E-03 | 5 | 40 | LYD717 | 0.70 | 2.41E-02 | 7 | 15 |
| LYD717 | 0.81 | 1.38E-03 | 6 | 4 | LYD718 | 0.73 | 7.56E-03 | 4 | 43 |
| LYD718 | 0.72 | 8.68E-03 | 4 | 41 | LYD718 | 0.79 | 2.32E-03 | 4 | 46 |
| LYD718 | 0.76 | 1.15E-02 | 2 | 44 | LYD718 | 0.70 | 1.09E-02 | 9 | 9 |
| LYD718 | 0.84 | 6.89E-04 | 9 | 33 | LYD718 | 0.75 | 4.84E-03 | 9 | 10 |
| LYD718 | 0.75 | 2.07E-02 | 9 | 1 | LYD718 | 0.85 | 1.03E-03 | 5 | 43 |
| LYD718 | 0.87 | 5.42E-04 | 5 | 41 | LYD718 | 0.80 | 9.78E-03 | 5 | 44 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD718 | 0.79 | 6.28E-03 | 7 | 2 | LYD718 | 0.72 | 1.85E-02 | 7 | 20 |
| LYD718 | 0.73 | 6.32E-02 | 7 | 27 | LYD718 | 0.71 | 2.04E-02 | 7 | 22 |
| LYD718 | 0.76 | 9.98E-03 | 7 | 3 | LYD718 | 0.84 | 2.27E-03 | 7 | 13 |
| LYD718 | 0.78 | 4.80E-03 | 3 | 4 | LYD718 | 0.75 | 3.25E-02 | 3 | 44 |
| LYD719 | 0.72 | 1.20E-02 | 4 | 45 | LYD719 | 0.80 | 1.60E-03 | 4 | 46 |
| LYD719 | 0.71 | 1.35E-02 | 4 | 44 | LYD719 | 0.95 | 8.30E-05 | 9 | 21 |
| LYD719 | 0.78 | 1.24E-02 | 9 | 1 | LYD719 | 0.77 | 5.51E-03 | 5 | 42 |
| LYD719 | 0.81 | 2.78E-03 | 5 | 43 | LYD719 | 0.89 | 2.02E-04 | 5 | 41 |
| LYD719 | 0.71 | 5.08E-02 | 3 | 8 | LYD719 | 0.89 | 2.47E-04 | 3 | 46 |
| LYD719 | 0.76 | 2.92E-02 | 3 | 11 | LYD720 | 0.79 | 3.58E-02 | 4 | 27 |
| LYD720 | 0.74 | 9.08E-03 | 2 | 5 | LYD720 | 0.93 | 3.38E-04 | 2 | 11 |
| LYD720 | 0.70 | 1.05E-02 | 9 | 32 | LYD720 | 0.78 | 2.76E-03 | 9 | 39 |
| LYD720 | 0.84 | 1.12E-03 | 5 | 43 | LYD720 | 0.88 | 3.63E-04 | 5 | 41 |
| LYD720 | 0.76 | 1.86E-02 | 5 | 44 | LYD720 | 0.84 | 2.22E-03 | 7 | 28 |
| LYD720 | 0.79 | 7.02E-03 | 7 | 14 | LYD720 | 0.71 | 2.17E-02 | 7 | 48 |
| LYD720 | 0.71 | 1.43E-02 | 3 | 28 | LYD720 | 0.71 | 1.45E-02 | 3 | 15 |
| LYD720 | 0.75 | 7.96E-03 | 3 | 48 | LYD720 | 0.76 | 4.02E-03 | 6 | 32 |
| LYD720 | 0.74 | 6.23E-03 | 6 | 39 | LYD721 | 0.71 | 1.48E-02 | 2 | 43 |
| LYD721 | 0.72 | 2.00E-02 | 2 | 44 | LYD721 | 0.82 | 1.16E-03 | 9 | 33 |
| LYD721 | 0.70 | 1.06E-02 | 9 | 10 | LYD721 | 0.72 | 7.70E-03 | 9 | 37 |
| LYD721 | 0.77 | 6.00E-03 | 5 | 43 | LYD721 | 0.74 | 8.60E-03 | 5 | 41 |
| LYD721 | 0.82 | 6.21E-03 | 5 | 44 | LYD721 | 0.90 | 9.24E-04 | 7 | 21 |
| LYD721 | 0.71 | 3.34E-02 | 7 | 1 | LYD721 | 0.81 | 2.53E-03 | 3 | 45 |
| LYD721 | 0.71 | 4.98E-02 | 6 | 21 | LYD721 | 0.70 | 1.10E-02 | 6 | 15 |
| LYD721 | 0.80 | 3.05E-02 | 6 | 8 | LYD721 | 0.70 | 1.12E-02 | 6 | 6 |
| LYD722 | 0.77 | 3.34E-03 | 4 | 34 | LYD722 | 0.70 | 1.61E-02 | 2 | 43 |
| LYD722 | 0.76 | 7.08E-03 | 2 | 41 | LYD722 | 0.73 | 2.45E-02 | 9 | 21 |
| LYD722 | 0.75 | 5.04E-03 | 9 | 14 | LYD722 | 0.81 | 1.29E-03 | 9 | 39 |
| LYD722 | 0.79 | 1.15E-02 | 9 | 1 | LYD722 | 0.75 | 7.66E-03 | 5 | 38 |
| LYD722 | 0.70 | 2.36E-02 | 7 | 26 | LYD722 | 0.79 | 5.99E-03 | 7 | 25 |
| LYD722 | 0.73 | 1.65E-02 | 7 | 15 | LYD722 | 0.95 | 3.07E-05 | 7 | 48 |
| LYD722 | 0.71 | 2.24E-02 | 7 | 17 | LYD722 | 0.79 | 6.65E-03 | 7 | 22 |
| LYD722 | 0.82 | 3.85E-03 | 7 | 3 | LYD722 | 0.72 | 1.81E-02 | 7 | 6 |
| LYD722 | 0.71 | 1.46E-02 | 3 | 28 | LYD722 | 0.87 | 4.31E-04 | 3 | 48 |
| LYD722 | 0.72 | 4.23E-02 | 3 | 11 | LYD723 | 0.73 | 6.93E-03 | 4 | 40 |
| LYD723 | 0.84 | 1.25E-03 | 2 | 41 | LYD723 | 0.85 | 2.04E-03 | 2 | 44 |
| LYD723 | 0.87 | 4.79E-04 | 5 | 43 | LYD723 | 0.87 | 5.42E-04 | 5 | 41 |
| LYD723 | 0.74 | 9.06E-03 | 5 | 38 | LYD723 | 0.90 | 1.04E-03 | 5 | 44 |
| LYD723 | 0.79 | 1.08E-02 | 7 | 1 | LYD723 | 0.89 | 2.04E-04 | 3 | 43 |
| LYD723 | 0.86 | 7.41E-04 | 3 | 41 | LYD723 | 0.88 | 4.36E-03 | 3 | 44 |
| LYD725 | 0.75 | 5.27E-03 | 4 | 46 | LYD725 | 0.72 | 1.86E-02 | 2 | 45 |
| LYD725 | 0.75 | 7.43E-03 | 5 | 34 | LYD725 | 0.76 | 6.63E-03 | 3 | 9 |
| LYD725 | 0.73 | 1.01E-02 | 3 | 43 | LYD725 | 0.73 | 1.13E-02 | 3 | 41 |
| LYD725 | 0.82 | 4.75E-02 | 6 | 27 | LYD726 | 0.78 | 2.55E-03 | 4 | 37 |
| LYD726 | 0.73 | 1.13E-02 | 2 | 24 | LYD726 | 0.91 | 1.16E-04 | 2 | 25 |
| LYD726 | 0.75 | 7.87E-03 | 2 | 7 | LYD726 | 0.72 | 1.31E-02 | 2 | 48 |
| LYD726 | 0.71 | 1.37E-02 | 2 | 17 | LYD726 | 0.87 | 5.37E-04 | 2 | 22 |
| LYD726 | 0.88 | 3.34E-04 | 2 | 3 | LYD726 | 0.71 | 1.36E-02 | 2 | 6 |
| LYD726 | 0.76 | 7.75E-02 | 5 | 27 | LYD726 | 0.71 | 3.20E-02 | 7 | 1 |
| LYD726 | 0.71 | 3.24E-02 | 7 | 8 | LYD726 | 0.79 | 2.10E-03 | 6 | 30 |
| LYD727 | 0.73 | 6.50E-03 | 4 | 28 | LYD727 | 0.85 | 4.03E-03 | 9 | 21 |
| LYD727 | 0.73 | 6.50E-03 | 9 | 39 | LYD727 | 0.74 | 5.45E-03 | 9 | 38 |
| LYD727 | 0.83 | 6.01E-03 | 9 | 1 | LYD727 | 0.77 | 5.92E-03 | 5 | 20 |
| LYD727 | 0.70 | 5.20E-02 | 5 | 1 | LYD727 | 0.84 | 4.54E-03 | 5 | 8 |
| LYD727 | 0.85 | 4.11E-03 | 3 | 21 | LYD727 | 0.74 | 9.58E-03 | 3 | 46 |
| LYD729 | 0.86 | 3.37E-04 | 4 | 28 | LYD729 | 0.86 | 2.92E-04 | 4 | 14 |
| LYD729 | 0.81 | 8.67E-03 | 2 | 21 | LYD729 | 0.79 | 4.06E-03 | 2 | 33 |
| LYD729 | 0.76 | 3.94E-03 | 9 | 32 | LYD729 | 0.85 | 3.73E-03 | 9 | 1 |
| LYD729 | 0.73 | 1.03E-02 | 9 | 8 | LYD729 | 0.72 | 1.29E-02 | 5 | 43 |
| LYD729 | 0.85 | 3.92E-03 | 5 | 44 | LYD729 | 0.83 | 2.75E-03 | 7 | 20 |
| LYD729 | 0.75 | 1.16E-02 | 7 | 14 | LYD729 | 0.72 | 1.79E-02 | 7 | 7 |
| LYD729 | 0.72 | 1.92E-02 | 7 | 22 | LYD729 | 0.79 | 1.08E-02 | 7 | 8 |
| LYD729 | 0.76 | 2.91E-02 | 7 | 11 | LYD729 | 0.73 | 6.36E-02 | 3 | 27 |
| LYD729 | 0.75 | 7.86E-03 | 3 | 31 | LYD729 | 0.81 | 1.44E-03 | 6 | 35 |
| LYD729 | 0.78 | 2.81E-03 | 6 | 12 | LYD729 | 0.78 | 2.91E-03 | 6 | 23 |
| LYD730 | 0.70 | 2.52E-03 | 1 | 41 | LYD730 | 0.70 | 7.86E-02 | 4 | 27 |
| LYD730 | 0.71 | 9.65E-03 | 4 | 37 | LYD730 | 0.85 | 8.08E-04 | 2 | 20 |
| LYD730 | 0.75 | 7.64E-03 | 2 | 28 | LYD730 | 0.79 | 3.58E-03 | 2 | 14 |
| LYD730 | 0.70 | 1.61E-02 | 2 | 13 | LYD730 | 0.78 | 2.64E-03 | 9 | 32 |
| LYD730 | 0.76 | 1.72E-02 | 9 | 21 | LYD730 | 0.83 | 8.95E-04 | 9 | 39 |
| LYD730 | 0.89 | 1.49E-03 | 9 | 1 | LYD730 | 0.72 | 1.26E-02 | 5 | 43 |
| LYD730 | 0.87 | 5.69E-04 | 5 | 41 | LYD730 | 0.80 | 2.96E-02 | 7 | 27 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD730 | 0.75 | 5.28E−03 | 6 | 26 | LYD730 | 0.72 | 8.70E−03 | 6 | 38 |
| LYD731 | 0.78 | 4.83E−03 | 4 | 8 | LYD731 | 0.89 | 6.27E−04 | 7 | 48 |
| LYD731 | 0.78 | 7.15E−03 | 7 | 22 | LYD731 | 0.71 | 3.23E−02 | 7 | 1 |
| LYD731 | 0.76 | 1.09E−02 | 7 | 3 | LYD731 | 0.72 | 1.18E−02 | 3 | 24 |
| LYD731 | 0.80 | 3.28E−03 | 3 | 4 | LYD731 | 0.84 | 9.80E−03 | 3 | 8 |
| LYD731 | 0.77 | 5.75E−03 | 3 | 46 | LYD731 | 0.74 | 5.93E−03 | 6 | 12 |
| LYD731 | 0.80 | 1.89E−03 | 6 | 22 | LYD731 | 0.74 | 3.70E−02 | 6 | 1 |
| LYD731 | 0.76 | 4.51E−03 | 6 | 3 | LYD731 | 0.82 | 1.22E−03 | 6 | 23 |
| LYD731 | 0.74 | 5.73E−02 | 6 | 8 | LYD733 | 0.81 | 4.41E−04 | 1 | 47 |
| LYD733 | 0.86 | 2.83E−03 | 9 | 21 | LYD733 | 0.76 | 3.92E−03 | 9 | 39 |
| LYD733 | 0.76 | 4.37E−03 | 9 | 31 | LYD733 | 0.76 | 1.85E−02 | 9 | 1 |
| LYD733 | 0.71 | 1.45E−02 | 5 | 43 | LYD733 | 0.75 | 7.84E−03 | 5 | 41 |
| LYD733 | 0.78 | 7.90E−03 | 7 | 28 | LYD733 | 0.71 | 2.27E−02 | 7 | 38 |
| LYD733 | 0.72 | 1.27E−02 | 3 | 2 | LYD733 | 0.79 | 1.86E−02 | 6 | 21 |
| LYD733 | 0.74 | 3.77E−02 | 6 | 1 | LYD735 | 0.72 | 1.25E−02 | 5 | 5 |
| LYD735 | 0.74 | 5.75E−02 | 4 | 27 | LYD735 | 0.88 | 9.44E−03 | 7 | 27 |
| LYD735 | 0.81 | 2.80E−03 | 9 | 27 | LYD735 | 0.74 | 8.96E−03 | 3 | 24 |
| LYD735 | 0.76 | 1.15E−02 | 7 | 25 | LYD735 | 0.71 | 1.52E−02 | 3 | 48 |
| LYD735 | 0.72 | 1.86E−02 | 7 | 5 | LYD735 | 0.70 | 1.05E−02 | 6 | 39 |
| LYD735 | 0.84 | 1.12E−03 | 3 | 5 | LYD736 | 0.75 | 8.06E−03 | 5 | 42 |
| LYD735 | 0.70 | 1.61E−02 | 3 | 6 | LYD736 | 0.79 | 3.80E−03 | 5 | 48 |
| LYD735 | 0.70 | 1.08E−02 | 6 | 17 | LYD736 | 0.87 | 4.81E−03 | 7 | 11 |
| LYD736 | 0.76 | 6.61E−03 | 5 | 26 | LYD736 | 0.73 | 1.02E−02 | 3 | 41 |
| LYD736 | 0.77 | 1.50E−02 | 7 | 8 | LYD737 | 0.77 | 5.12E−03 | 1 | 8 |
| LYD736 | 0.74 | 8.87E−03 | 3 | 43 | LYD737 | 0.72 | 2.83E−02 | 2 | 11 |
| LYD736 | 0.79 | 2.03E−03 | 3 | 44 | LYD738 | 0.85 | 8.10E−04 | 2 | 28 |
| LYD737 | 0.71 | 1.90E−03 | 1 | 6 | LYD738 | 0.71 | 1.53E−02 | 2 | 48 |
| LYD738 | 0.83 | 1.51E−03 | 2 | 20 | LYD738 | 0.77 | 1.54E−02 | 9 | 1 |
| LYD738 | 0.89 | 2.54E−04 | 2 | 14 | LYD738 | 0.74 | 5.56E−02 | 7 | 27 |
| LYD738 | 0.79 | 1.08E−02 | 2 | 11 | LYD738 | 0.70 | 1.10E−02 | 6 | 36 |
| LYD738 | 0.76 | 6.42E−03 | 5 | 40 | LYD739 | 0.79 | 2.00E−03 | 4 | 25 |
| LYD738 | 0.76 | 6.79E−03 | 3 | 48 | LYD739 | 0.83 | 9.08E−04 | 4 | 15 |
| LYD739 | 0.85 | 4.56E−04 | 4 | 4 | LYD739 | 0.78 | 2.65E−03 | 4 | 3 |
| LYD739 | 0.87 | 2.04E−04 | 4 | 7 | LYD739 | 0.77 | 6.05E−03 | 4 | 8 |
| LYD739 | 0.87 | 2.76E−04 | 4 | 22 | LYD739 | 0.75 | 7.69E−03 | 2 | 9 |
| LYD739 | 0.75 | 4.93E−03 | 4 | 23 | LYD740 | 0.83 | 8.43E−04 | 1 | 21 |
| LYD739 | 0.73 | 7.35E−03 | 4 | 6 | LYD740 | 0.72 | 7.87E−03 | 1 | 1 |
| LYD739 | 0.70 | 1.58E−02 | 2 | 37 | LYD740 | 0.84 | 5.72E−04 | 4 | 14 |
| LYD740 | 0.75 | 8.04E−04 | 1 | 35 | LYD740 | 0.71 | 1.01E−02 | 9 | 25 |
| LYD740 | 0.75 | 4.95E−03 | 4 | 28 | LYD740 | 0.72 | 8.55E−03 | 9 | 15 |
| LYD740 | 0.75 | 4.87E−03 | 9 | 24 | LYD740 | 0.70 | 1.05E−02 | 9 | 22 |
| LYD740 | 0.73 | 7.40E−03 | 9 | 7 | LYD740 | 0.90 | 1.28E−04 | 9 | 8 |
| LYD740 | 0.75 | 5.18E−03 | 9 | 48 | LYD740 | 0.81 | 2.75E−03 | 5 | 24 |
| LYD740 | 0.74 | 5.47E−03 | 9 | 3 | LYD740 | 0.72 | 1.26E−02 | 5 | 35 |
| LYD740 | 0.88 | 1.68E−04 | 9 | 6 | LYD740 | 0.86 | 6.98E−04 | 5 | 7 |
| LYD740 | 0.82 | 2.11E−03 | 5 | 4 | LYD740 | 0.78 | 4.92E−03 | 5 | 5 |
| LYD740 | 0.86 | 6.11E−04 | 5 | 25 | LYD740 | 0.87 | 4.86E−04 | 5 | 3 |
| LYD740 | 0.71 | 1.47E−02 | 5 | 30 | LYD740 | 0.77 | 1.43E−02 | 5 | 8 |
| LYD740 | 0.90 | 1.65E−04 | 5 | 22 | LYD740 | 0.73 | 1.66E−02 | 5 | 11 |
| LYD740 | 0.84 | 1.26E−03 | 5 | 23 | LYD740 | 0.71 | 2.23E−02 | 7 | 35 |
| LYD740 | 0.75 | 8.37E−03 | 5 | 6 | LYD740 | 0.74 | 1.51E−02 | 7 | 22 |
| LYD740 | 0.77 | 9.67E−03 | 7 | 20 | LYD740 | 0.77 | 8.79E−03 | 7 | 6 |
| LYD740 | 0.82 | 3.33E−03 | 7 | 7 | LYD740 | 0.82 | 3.99E−03 | 7 | 13 |
| LYD740 | 0.78 | 7.79E−03 | 7 | 3 | LYD741 | 0.71 | 1.51E−02 | 2 | 18 |
| LYD740 | 0.84 | 9.12E−03 | 7 | 11 | LYD741 | 0.75 | 7.97E−03 | 5 | 41 |
| LYD740 | 0.74 | 8.79E−03 | 3 | 46 | LYD741 | 0.70 | 1.60E−02 | 5 | 40 |
| LYD741 | 0.73 | 1.04E−02 | 5 | 18 | LYD741 | 0.77 | 2.47E−02 | 7 | 11 |
| LYD741 | 0.77 | 7.03E−02 | 5 | 27 | LYD741 | 0.72 | 4.53E−02 | 3 | 44 |
| LYD741 | 0.80 | 8.92E−03 | 7 | 1 | LYD741 | 0.81 | 1.55E−02 | 6 | 1 |
| LYD741 | 0.76 | 1.09E−02 | 7 | 13 | LYD742 | 0.84 | 4.36E−03 | 2 | 11 |
| LYD741 | 0.78 | 2.22E−02 | 6 | 21 | LYD742 | 0.90 | 7.27E−05 | 9 | 24 |
| LYD742 | 0.81 | 2.42E−03 | 2 | 19 | LYD742 | 0.81 | 1.46E−03 | 9 | 7 |
| LYD742 | 0.74 | 5.90E−03 | 9 | 2 | LYD742 | 0.76 | 3.91E−03 | 9 | 5 |
| LYD742 | 0.71 | 9.45E−03 | 9 | 25 | LYD742 | 0.82 | 1.15E−03 | 9 | 23 |
| LYD742 | 0.74 | 6.26E−03 | 9 | 12 | LYD742 | 0.83 | 7.31E−04 | 9 | 13 |
| LYD742 | 0.70 | 1.10E−02 | 9 | 3 | LYD742 | 0.83 | 2.98E−03 | 7 | 18 |
| LYD742 | 0.78 | 7.86E−03 | 9 | 11 | LYD742 | 0.71 | 1.50E−02 | 3 | 20 |
| LYD742 | 0.71 | 2.13E−02 | 8 | 13 | LYD742 | 0.72 | 1.18E−02 | 3 | 13 |
| LYD742 | 0.75 | 8.10E−03 | 3 | 9 | LYD744 | 0.78 | 2.68E−03 | 9 | 32 |
| LYD742 | 0.78 | 2.10E−02 | 3 | 11 | LYD744 | 0.90 | 6.35E−05 | 9 | 39 |
| LYD742 | 0.73 | 6.73E−03 | 6 | 9 | LYD744 | 0.74 | 1.43E−02 | 7 | 18 |
| LYD744 | 0.75 | 1.96E−02 | 9 | 21 | LYD745 | 0.71 | 9.61E−03 | 4 | 46 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD744 | 0.72 | 8.59E−03 | 9 | 37 | LYD745 | 0.72 | 2.74E−02 | 9 | 21 |
| LYD744 | 0.81 | 2.48E−03 | 3 | 48 | LYD745 | 0.83 | 1.61E−03 | 5 | 43 |
| LYD745 | 0.76 | 4.17E−03 | 9 | 42 | LYD745 | 0.88 | 1.69E−03 | 5 | 44 |
| LYD745 | 0.84 | 4.20E−03 | 9 | 1 | LYD745 | 0.85 | 3.69E−03 | 7 | 1 |
| LYD745 | 0.70 | 1.62E−02 | 5 | 41 | LYD745 | 0.72 | 1.27E−02 | 3 | 39 |
| LYD745 | 0.81 | 4.57E−03 | 7 | 14 | LYD745 | 0.76 | 6.89E−03 | 3 | 40 |
| LYD745 | 0.73 | 1.13E−02 | 3 | 32 | LYD746 | 0.75 | 8.11E−03 | 9 | 8 |
| LYD745 | 0.72 | 4.20E−02 | 3 | 8 | LYD746 | 0.72 | 8.54E−03 | 9 | 13 |
| LYD745 | 0.73 | 7.46E−03 | 6 | 12 | LYD746 | 0.95 | 4.03E−03 | 6 | 27 |
| LYD746 | 0.77 | 9.05E−03 | 9 | 11 | LYD747 | 0.78 | 4.38E−03 | 4 | 8 |
| LYD746 | 0.76 | 1.01E−02 | 7 | 28 | LYD747 | 0.96 | 7.67E−04 | 2 | 27 |
| LYD747 | 0.71 | 9.86E−03 | 4 | 14 | LYD747 | 0.89 | 9.65E−05 | 9 | 37 |
| LYD747 | 0.74 | 5.50E−03 | 4 | 46 | LYD747 | 0.75 | 1.18E−02 | 7 | 15 |
| LYD747 | 0.85 | 5.02E−04 | 9 | 33 | LYD747 | 0.82 | 1.11E−03 | 6 | 17 |
| LYD747 | 0.80 | 1.62E−02 | 5 | 21 | LYD747 | 0.83 | 2.05E−02 | 6 | 8 |
| LYD747 | 0.79 | 1.98E−02 | 6 | 21 | LYD748 | 0.83 | 1.42E−03 | 2 | 2 |
| LYD747 | 0.70 | 5.15E−02 | 6 | 1 | LYD748 | 0.77 | 5.61E−03 | 2 | 3 |
| LYD748 | 0.71 | 9.92E−03 | 4 | 28 | LYD748 | 0.83 | 8.82E−04 | 9 | 4 |
| LYD748 | 0.74 | 8.63E−03 | 2 | 22 | LYD748 | 0.84 | 5.68E−04 | 9 | 7 |
| LYD748 | 0.73 | 6.77E−03 | 9 | 24 | LYD748 | 0.81 | 1.30E−03 | 9 | 22 |
| LYD748 | 0.73 | 6.54E−03 | 9 | 25 | LYD748 | 0.84 | 5.94E−04 | 9 | 23 |
| LYD748 | 0.73 | 6.49E−03 | 9 | 12 | LYD748 | 0.76 | 6.57E−03 | 5 | 22 |
| LYD748 | 0.70 | 1.06E−02 | 9 | 3 | LYD748 | 0.72 | 1.83E−02 | 7 | 7 |
| LYD748 | 0.78 | 4.74E−03 | 5 | 48 | LYD748 | 0.80 | 5.45E−03 | 7 | 22 |
| LYD748 | 0.77 | 6.01E−03 | 5 | 3 | LYD748 | 0.72 | 6.87E−03 | 6 | 8 |
| LYD748 | 0.77 | 9.92E−03 | 7 | 48 | LYD749 | 0.74 | 9.45E−03 | 2 | 24 |
| LYD748 | 0.74 | 1.50E−02 | 7 | 3 | LYD749 | 0.87 | 1.18E−02 | 2 | 27 |
| LYD748 | 0.73 | 6.50E−03 | 6 | 46 | LYD749 | 0.80 | 3.28E−03 | 2 | 48 |
| LYD749 | 0.79 | 3.60E−03 | 2 | 25 | LYD749 | 0.78 | 4.63E−03 | 2 | 3 |
| LYD749 | 0.75 | 7.69E−03 | 2 | 5 | LYD749 | 0.73 | 6.83E−03 | 9 | 39 |
| LYD749 | 0.74 | 8.97E−03 | 2 | 22 | LYD749 | 0.73 | 1.71E−02 | 7 | 18 |
| LYD749 | 0.80 | 1.00E−02 | 9 | 21 | LYD750 | 0.70 | 2.52E−03 | 1 | 31 |
| LYD749 | 0.77 | 5.32E−03 | 5 | 41 | LYD750 | 0.80 | 5.94E−03 | 7 | 26 |
| LYD749 | 0.80 | 3.18E−03 | 3 | 48 | LYD750 | 0.77 | 9.21E−03 | 7 | 46 |
| LYD750 | 0.76 | 4.10E−03 | 9 | 12 | LYD751 | 0.78 | 2.96E−03 | 4 | 14 |
| LYD750 | 0.71 | 2.09E−02 | 7 | 22 | LYD751 | 0.75 | 3.09E−02 | 5 | 1 |
| LYD751 | 0.74 | 6.04E−03 | 4 | 20 | LYD751 | 0.75 | 1.21E−02 | 7 | 38 |
| LYD751 | 0.74 | 3.76E−02 | 5 | 21 | LYD751 | 0.78 | 2.22E−02 | 6 | 21 |
| LYD751 | 0.78 | 4.37E−03 | 5 | 40 | LYD751 | 0.72 | 4.23E−02 | 6 | 1 |
| LYD751 | 0.81 | 2.72E−03 | 3 | 15 | LYD752 | 0.79 | 1.96E−02 | 5 | 21 |
| LYD751 | 0.76 | 8.14E−02 | 6 | 27 | LYD752 | 0.86 | 1.26E−03 | 7 | 13 |
| LYD751 | 0.70 | 1.12E−02 | 6 | 23 | LYD753 | 0.70 | 1.11E−02 | 4 | 34 |
| LYD752 | 0.71 | 2.10E−02 | 7 | 19 | LYD753 | 0.72 | 2.87E−02 | 9 | 21 |
| LYD752 | 0.83 | 2.11E−02 | 3 | 27 | LYD753 | 0.79 | 3.54E−03 | 5 | 43 |
| LYD753 | 0.75 | 8.16E−03 | 2 | 41 | LYD753 | 0.75 | 1.91E−02 | 5 | 44 |
| LYD753 | 0.77 | 1.43E−02 | 3 | 1 | LYD754 | 0.75 | 4.94E−03 | 4 | 16 |
| LYD753 | 0.90 | 1.66E−04 | 5 | 41 | LYD754 | 0.88 | 1.83E−04 | 9 | 37 |
| LYD753 | 0.77 | 9.33E−03 | 7 | 2 | LYD754 | 0.93 | 9.13E−05 | 7 | 16 |
| LYD754 | 0.74 | 6.00E−03 | 4 | 37 | LYD755 | 0.81 | 1.52E−03 | 9 | 10 |
| LYD754 | 0.76 | 8.11E−02 | 5 | 27 | LYD755 | 0.89 | 1.74E−02 | 5 | 27 |
| LYD755 | 0.74 | 9.55E−04 | 1 | 12 | LYD756 | 0.72 | 8.20E−03 | 4 | 14 |
| LYD755 | 0.77 | 5.93E−03 | 5 | 38 | LYD756 | 0.75 | 7.91E−03 | 2 | 46 |
| LYD755 | 0.87 | 2.48E−03 | 7 | 21 | LYD756 | 0.76 | 7.21E−03 | 5 | 34 |
| LYD756 | 0.70 | 1.58E−02 | 4 | 8 | LYD756 | 0.78 | 1.35E−02 | 5 | 8 |
| LYD756 | 0.78 | 1.33E−02 | 9 | 1 | LYD756 | 0.78 | 2.36E−02 | 3 | 44 |
| LYD756 | 0.72 | 1.21E−02 | 5 | 17 | LYD756 | 0.77 | 3.11E−03 | 6 | 12 |
| LYD756 | 0.76 | 6.09E−03 | 3 | 43 | LYD757 | 0.75 | 1.30E−02 | 2 | 44 |
| LYD756 | 0.75 | 5.34E−03 | 6 | 39 | LYD757 | 0.80 | 3.29E−03 | 5 | 17 |
| LYD756 | 0.81 | 1.53E−02 | 6 | 23 | LYD757 | 0.80 | 4.98E−03 | 7 | 48 |
| LYD757 | 0.77 | 3.74E−03 | 9 | 10 | LYD757 | 0.73 | 1.10E−02 | 3 | 4 |
| LYD757 | 0.80 | 9.24E−03 | 5 | 8 | LYD757 | 0.80 | 1.62E−02 | 6 | 21 |
| LYD757 | 0.75 | 1.19E−02 | 7 | 22 | LYD758 | 0.75 | 5.14E−03 | 9 | 32 |
| LYD757 | 0.82 | 1.23E−02 | 3 | 8 | LYD758 | 0.84 | 1.91E−02 | 3 | 27 |
| LYD757 | 0.84 | 9.88E−03 | 6 | 1 | LYD758 | 0.83 | 1.70E−03 | 3 | 48 |
| LYD758 | 0.79 | 3.72E−03 | 3 | 42 | LYD758 | 0.77 | 3.61E−03 | 6 | 9 |
| LYD758 | 0.71 | 1.36E−02 | 3 | 31 | LYD758 | 0.70 | 1.07E−02 | 6 | 30 |
| LYD758 | 0.73 | 7.31E−03 | 6 | 42 | LYD758 | 0.70 | 1.12E−02 | 4 | 9 |
| LYD758 | 0.76 | 3.94E−03 | 6 | 36 | LYD760 | 0.77 | 5.34E−03 | 2 | 5 |
| LYD760 | 0.78 | 7.24E−03 | 1 | 27 | LYD760 | 0.86 | 3.16E−03 | 9 | 21 |
| LYD760 | 0.72 | 8.19E−03 | 4 | 33 | LYD760 | 0.79 | 3.61E−03 | 5 | 41 |
| LYD760 | 0.72 | 8.79E−03 | 9 | 32 | LYD760 | 0.84 | 1.82E−02 | 3 | 27 |
| LYD760 | 0.85 | 1.51E−02 | 9 | 27 | LYD760 | 0.78 | 2.10E−02 | 6 | 21 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD760 | 0.72 | 1.31E−02 | 5 | 5 | LYD761 | 0.79 | 2.44E−03 | 4 | 14 |
| LYD760 | 0.72 | 4.33E−02 | 3 | 11 | LYD761 | 0.79 | 4.01E−03 | 5 | 48 |
| LYD760 | 0.83 | 4.17E−02 | 6 | 27 | LYD761 | 0.78 | 1.37E−02 | 7 | 8 |
| LYD761 | 0.80 | 1.67E−03 | 9 | 32 | LYD761 | 0.75 | 1.27E−02 | 7 | 46 |
| LYD761 | 0.77 | 5.18E−03 | 5 | 6 | LYD762 | 0.73 | 1.25E−03 | 1 | 29 |
| LYD761 | 0.77 | 9.65E−03 | 7 | 40 | LYD762 | 0.83 | 8.25E−04 | 9 | 32 |
| LYD762 | 0.78 | 3.16E−04 | 1 | 4 | LYD762 | 0.71 | 1.40E−02 | 5 | 26 |
| LYD762 | 0.77 | 5.23E−03 | 2 | 3 | LYD762 | 0.83 | 2.95E−03 | 7 | 18 |
| LYD762 | 0.75 | 4.74E−03 | 9 | 39 | LYD762 | 0.75 | 7.33E−03 | 1 | 46 |
| LYD762 | 0.77 | 5.77E−03 | 5 | 13 | LYD763 | 0.75 | 8.61E−04 | 1 | 6 |
| LYD762 | 0.77 | 9.17E−03 | 7 | 13 | LYD763 | 0.72 | 2.84E−02 | 9 | 1 |
| LYD763 | 0.71 | 2.20E−03 | 1 | 19 | LYD763 | 0.79 | 6.48E−03 | 7 | 17 |
| LYD763 | 0.73 | 2.49E−02 | 9 | 21 | LYD763 | 0.78 | 8.20E−03 | 7 | 6 |
| LYD763 | 0.83 | 4.18E−02 | 5 | 27 | LYD763 | 0.75 | 7.61E−03 | 3 | 46 |
| LYD763 | 0.84 | 4.96E−03 | 7 | 8 | LYD764 | 0.72 | 8.27E−03 | 4 | 37 |
| LYD763 | 0.72 | 1.93E−02 | 7 | 40 | LYD764 | 0.77 | 5.73E−03 | 5 | 41 |
| LYD763 | 0.74 | 1.42E−02 | 6 | 11 | LYD764 | 0.81 | 8.84E−03 | 5 | 44 |
| LYD764 | 0.83 | 1.61E−03 | 5 | 43 | LYD764 | 0.85 | 8.99E−04 | 3 | 45 |
| LYD764 | 0.71 | 1.37E−02 | 5 | 40 | LYD765 | 0.76 | 6.02E−04 | 1 | 9 |
| LYD764 | 0.74 | 1.37E−02 | 7 | 48 | LYD765 | 0.74 | 6.21E−03 | 4 | 4 |
| LYD764 | 0.86 | 1.60E−03 | 6 | 11 | LYD765 | 0.77 | 3.21E−03 | 4 | 35 |
| LYD765 | 0.75 | 8.25E−04 | 1 | 19 | LYD765 | 0.71 | 2.06E−02 | 4 | 11 |
| LYD765 | 0.75 | 4.87E−03 | 4 | 20 | LYD765 | 0.73 | 1.06E−02 | 2 | 20 |
| LYD765 | 0.75 | 5.07E−03 | 4 | 7 | LYD765 | 0.86 | 6.08E−04 | 2 | 7 |
| LYD765 | 0.73 | 1.11E−02 | 2 | 24 | LYD765 | 0.81 | 2.75E−03 | 2 | 3 |
| LYD765 | 0.75 | 7.72E−03 | 2 | 35 | LYD765 | 0.80 | 1.03E−02 | 2 | 11 |
| LYD765 | 0.75 | 8.40E−03 | 2 | 22 | LYD765 | 0.70 | 1.56E−02 | 5 | 37 |
| LYD765 | 0.84 | 1.20E−03 | 2 | 6 | LYD765 | 0.75 | 1.21E−02 | 7 | 24 |
| LYD765 | 0.81 | 2.25E−03 | 5 | 5 | LYD765 | 0.74 | 1.44E−02 | 7 | 20 |
| LYD765 | 0.71 | 1.45E−02 | 5 | 17 | LYD765 | 0.81 | 4.70E−03 | 7 | 22 |
| LYD765 | 0.75 | 1.25E−02 | 7 | 4 | LYD765 | 0.85 | 1.96E−03 | 7 | 23 |
| LYD765 | 0.91 | 2.23E−04 | 7 | 7 | LYD765 | 0.71 | 1.53E−02 | 3 | 4 |
| LYD765 | 0.77 | 8.52E−03 | 7 | 3 | LYD765 | 0.73 | 1.06E−02 | 3 | 7 |
| LYD765 | 0.80 | 1.71E−03 | 7 | 11 | LYD765 | 0.74 | 9.05E−03 | 3 | 48 |
| LYD765 | 0.71 | 1.42E−02 | 3 | 20 | LYD765 | 0.88 | 4.00E−04 | 3 | 3 |
| LYD765 | 0.72 | 1.16E−02 | 3 | 15 | LYD765 | 0.80 | 1.80E−03 | 6 | 4 |
| LYD765 | 0.83 | 1.73E−03 | 3 | 22 | LYD765 | 0.79 | 2.18E−03 | 6 | 37 |
| LYD765 | 0.73 | 1.14E−02 | 3 | 6 | LYD767 | 0.74 | 1.41E−02 | 7 | 4 |
| LYD765 | 0.78 | 2.78E−03 | 6 | 9 | LYD767 | 0.79 | 6.17E−03 | 7 | 29 |
| LYD767 | 0.71 | 1.03E−02 | 4 | 16 | LYD767 | 0.78 | 4.39E−03 | 3 | 16 |
| LYD767 | 0.72 | 1.81E−02 | 7 | 30 | LYD768 | 0.85 | 1.05E−03 | 2 | 19 |
| LYD767 | 0.73 | 1.02E−02 | 3 | 32 | LYD768 | 0.94 | 1.58E−04 | 2 | 11 |
| LYD768 | 0.73 | 6.82E−03 | 4 | 37 | LYD768 | 0.71 | 1.45E−02 | 5 | 41 |
| LYD768 | 0.74 | 8.60E−03 | 2 | 20 | LYD768 | 0.73 | 1.14E−02 | 3 | 35 |
| LYD768 | 0.79 | 3.59E−03 | 2 | 13 | LYD768 | 0.78 | 5.07E−03 | 3 | 13 |
| LYD768 | 0.74 | 8.90E−03 | 5 | 31 | LYD769 | 0.73 | 1.16E−02 | 2 | 25 |
| LYD768 | 0.96 | 1.25E−04 | 3 | 11 | LYD769 | 0.82 | 1.96E−03 | 2 | 3 |
| LYD769 | 0.93 | 3.60E−05 | 2 | 2 | LYD769 | 0.83 | 1.50E−03 | 5 | 36 |
| LYD769 | 0.75 | 7.30E−03 | 2 | 22 | LYD769 | 0.89 | 2.83E−03 | 7 | 11 |
| LYD769 | 0.72 | 1.25E−02 | 2 | 13 | LYD771 | 0.75 | 8.32E−03 | 2 | 43 |
| LYD769 | 0.91 | 2.88E−04 | 7 | 46 | LYD771 | 0.74 | 5.85E−03 | 9 | 10 |
| LYD769 | 0.78 | 4.36E−03 | 3 | 48 | LYD771 | 0.72 | 1.19E−02 | 3 | 43 |
| LYD771 | 0.77 | 5.56E−03 | 4 | 47 | LYD771 | 0.72 | 8.28E−03 | 6 | 38 |
| LYD771 | 0.82 | 3.83E−03 | 2 | 44 | LYD772 | 0.75 | 4.61E−03 | 9 | 32 |
| LYD771 | 0.73 | 6.39E−02 | 7 | 27 | LYD772 | 0.76 | 6.88E−03 | 3 | 37 |
| LYD771 | 0.76 | 6.22E−03 | 3 | 41 | LYD773 | 0.73 | 1.14E−02 | 2 | 40 |
| LYD772 | 0.82 | 2.03E−03 | 2 | 26 | LYD773 | 0.92 | 5.51E−05 | 5 | 43 |
| LYD772 | 0.71 | 1.38E−02 | 3 | 42 | LYD773 | 0.90 | 1.10E−03 | 5 | 44 |
| LYD772 | 0.92 | 1.01E−02 | 6 | 27 | LYD773 | 0.75 | 1.27E−02 | 7 | 39 |
| LYD773 | 0.78 | 5.03E−03 | 2 | 46 | LYD773 | 0.72 | 1.31E−02 | 3 | 41 |
| LYD773 | 0.89 | 2.21E−04 | 5 | 41 | LYD774 | 0.85 | 8.28E−04 | 2 | 46 |
| LYD773 | 0.71 | 3.35E−02 | 7 | 21 | LYD774 | 0.72 | 8.07E−03 | 9 | 26 |
| LYD773 | 0.73 | 1.13E−02 | 3 | 43 | LYD774 | 0.76 | 6.85E−03 | 5 | 41 |
| LYD774 | 0.81 | 1.45E−04 | 1 | 25 | LYD774 | 0.75 | 9.25E−04 | 8 | 48 |
| LYD774 | 0.71 | 9.59E−03 | 9 | 42 | LYD774 | 0.74 | 9.40E−02 | 6 | 27 |
| LYD774 | 0.72 | 8.79E−03 | 9 | 48 | LYD776 | 0.79 | 3.49E−03 | 9 | 8 |
| LYD774 | 0.77 | 5.55E−04 | 8 | 5 | LYD776 | 0.81 | 2.52E−03 | 5 | 43 |
| LYD774 | 0.70 | 2.41E−02 | 7 | 5 | LYD776 | 0.81 | 4.20E−03 | 7 | 14 |
| LYD776 | 0.77 | 3.65E−03 | 4 | 13 | LYD776 | 0.78 | 4.41E−03 | 3 | 43 |
| LYD776 | 0.87 | 4.31E−04 | 2 | 46 | LYD777 | 0.89 | 6.68E−03 | 4 | 27 |
| LYD776 | 0.71 | 2.17E−02 | 9 | 11 | LYD777 | 0.71 | 2.07E−02 | 2 | 44 |
| LYD776 | 0.89 | 1.31E−03 | 5 | 44 | LYD777 | 0.85 | 4.94E−04 | 9 | 33 |

TABLE 158-continued

Correlation between the expression level of selected genes of some
embodiments of the invention in various tissues and the phenotypic
performance under normal conditions across 16 bean varieties
("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD776 | 0.79 | 7.09E−03 | 7 | 15 | LYD777 | 0.80 | 1.76E−02 | 3 | 8 |
| LYD776 | 0.81 | 2.72E−03 | 3 | 41 | LYD778 | 0.75 | 8.06E−03 | 2 | 9 |
| LYD777 | 0.70 | 1.55E−02 | 2 | 7 | LYD778 | 0.77 | 5.19E−03 | 5 | 6 |
| LYD777 | 0.90 | 5.68E−05 | 9 | 9 | LYD778 | 0.76 | 1.11E−02 | 7 | 15 |
| LYD777 | 0.73 | 2.62E−02 | 3 | 21 | LYD779 | 0.71 | 9.66E−03 | 4 | 38 |
| LYD778 | 0.71 | 9.48E−03 | 4 | 4 | LYD779 | 0.77 | 3.57E−03 | 9 | 48 |
| LYD778 | 0.73 | 1.06E−02 | 5 | 25 | LYD779 | 0.74 | 9.94E−03 | 5 | 46 |
| LYD778 | 0.72 | 1.49E−03 | 8 | 38 | LYD779 | 0.85 | 8.46E−04 | 3 | 43 |
| LYD778 | 0.84 | 1.94E−02 | 6 | 44 | LYD779 | 0.82 | 2.44E−02 | 3 | 27 |
| LYD779 | 0.82 | 3.49E−03 | 2 | 45 | LYD780 | 0.87 | 2.09E−04 | 4 | 48 |
| LYD779 | 0.76 | 1.72E−02 | 9 | 1 | LYD780 | 0.71 | 9.18E−03 | 4 | 13 |
| LYD779 | 0.79 | 1.17E−02 | 7 | 1 | LYD780 | 0.70 | 1.59E−02 | 2 | 46 |
| LYD779 | 0.78 | 4.27E−03 | 3 | 41 | LYD780 | 0.90 | 1.41E−04 | 5 | 41 |
| LYD779 | 0.74 | 3.42E−02 | 3 | 44 | LYD780 | 0.74 | 5.85E−03 | 8 | 1 |
| LYD780 | 0.72 | 8.09E−03 | 4 | 6 | LYD780 | 0.73 | 1.66E−02 | 7 | 22 |
| LYD780 | 0.75 | 1.27E−02 | 2 | 45 | LYD780 | 0.83 | 2.79E−03 | 7 | 13 |
| LYD780 | 0.89 | 2.49E−04 | 5 | 43 | LYD780 | 0.73 | 1.67E−02 | 6 | 11 |
| LYD780 | 0.74 | 9.39E−03 | 5 | 27 | LYD781 | 0.79 | 4.05E−03 | 9 | 8 |
| LYD780 | 0.76 | 1.05E−02 | 7 | 2 | LYD781 | 0.78 | 7.34E−03 | 9 | 11 |
| LYD780 | 0.75 | 1.20E−02 | 7 | 3 | LYD781 | 0.86 | 1.28E−03 | 7 | 24 |
| LYD780 | 0.83 | 1.62E−03 | 3 | 46 | LYD781 | 0.80 | 5.19E−03 | 7 | 7 |
| LYD781 | 0.71 | 1.35E−02 | 4 | 44 | LYD781 | 0.78 | 8.17E−03 | 7 | 5 |
| LYD781 | 0.83 | 8.15E−04 | 9 | 46 | LYD781 | 0.75 | 1.21E−02 | 7 | 3 |
| LYD781 | 0.80 | 2.93E−03 | 5 | 2 | LYD782 | 0.74 | 5.72E−03 | 4 | 18 |
| LYD781 | 0.83 | 2.91E−03 | 7 | 25 | LYD782 | 0.74 | 9.75E−03 | 4 | 45 |
| LYD781 | 0.74 | 1.52E−02 | 7 | 12 | LYD782 | 0.87 | 4.52E−04 | 5 | 43 |
| LYD781 | 0.78 | 7.34E−03 | 7 | 22 | LYD782 | 0.80 | 3.13E−03 | 5 | 38 |
| LYD781 | 0.87 | 1.21E−03 | 7 | 23 | LYD782 | 0.87 | 2.42E−03 | 7 | 8 |
| LYD782 | 0.72 | 8.10E−03 | 4 | 38 | LYD782 | 0.77 | 4.13E−02 | 3 | 27 |
| LYD782 | 0.71 | 1.39E−02 | 2 | 32 | LYD783 | 0.85 | 4.25E−04 | 9 | 32 |
| LYD782 | 0.80 | 3.38E−03 | 5 | 41 | LYD783 | 0.82 | 1.04E−03 | 9 | 39 |
| LYD782 | 0.87 | 2.45E−03 | 5 | 44 | LYD783 | 0.85 | 3.15E−05 | 8 | 5 |
| LYD782 | 0.80 | 5.88E−03 | 7 | 40 | LYD783 | 0.80 | 5.93E−03 | 7 | 4 |
| LYD782 | 0.72 | 8.50E−03 | 6 | 38 | LYD783 | 0.71 | 3.29E−02 | 7 | 8 |
| LYD783 | 0.77 | 1.46E−02 | 9 | 21 | LYD783 | 0.71 | 9.78E−03 | 6 | 30 |
| LYD783 | 0.86 | 2.87E−02 | 5 | 27 | LYD784 | 0.79 | 2.08E−03 | 4 | 38 |
| LYD783 | 0.72 | 1.66E−03 | 8 | 48 | LYD784 | 0.71 | 1.41E−02 | 5 | 26 |
| LYD783 | 0.74 | 1.37E−02 | 7 | 35 | LYD784 | 0.75 | 7.79E−03 | 5 | 3 |
| LYD783 | 0.76 | 2.83E−02 | 7 | 11 | LYD784 | 0.73 | 1.04E−02 | 5 | 13 |
| LYD783 | 0.72 | 8.47E−03 | 6 | 5 | LYD785 | 0.78 | 2.82E−03 | 4 | 46 |
| LYD784 | 0.81 | 2.42E−03 | 4 | 44 | LYD785 | 0.79 | 1.11E−02 | 5 | 44 |
| LYD784 | 0.73 | 1.01E−02 | 5 | 22 | LYD785 | 0.74 | 3.75E−02 | 6 | 21 |
| LYD784 | 0.80 | 9.83E−03 | 5 | 8 | LYD785 | 0.83 | 2.08E−02 | 6 | 44 |
| LYD785 | 0.73 | 1.10E−02 | 4 | 45 | LYD786 | 0.81 | 2.49E−03 | 5 | 41 |
| LYD785 | 0.75 | 8.27E−03 | 5 | 41 | LYD786 | 0.79 | 3.83E−03 | 3 | 46 |
| LYD785 | 0.81 | 2.50E−03 | 3 | 35 | LYD786 | 0.72 | 1.07E−01 | 6 | 27 |
| LYD785 | 0.87 | 2.57E−02 | 6 | 27 | LYD788 | 0.70 | 1.64E−02 | 4 | 44 |
| LYD786 | 0.71 | 9.70E−03 | 4 | 34 | LYD788 | 0.75 | 8.31E−03 | 5 | 43 |
| LYD786 | 0.79 | 6.83E−03 | 7 | 18 | LYD788 | 0.77 | 5.69E−03 | 5 | 38 |
| LYD786 | 0.72 | 7.98E−03 | 6 | 24 | LYD788 | 0.71 | 2.10E−02 | 7 | 32 |
| LYD788 | 0.75 | 1.19E−02 | 4 | 11 | LYD788 | 0.72 | 1.96E−02 | 7 | 39 |
| LYD788 | 0.73 | 1.11E−02 | 2 | 32 | LYD788 | 0.86 | 2.67E−03 | 3 | 21 |
| LYD788 | 0.77 | 6.00E−03 | 5 | 41 | LYD788 | 0.84 | 8.61E−03 | 3 | 44 |
| LYD788 | 0.96 | 6.07E−05 | 5 | 44 | LYD789 | 0.74 | 9.44E−03 | 2 | 46 |
| LYD788 | 0.72 | 2.95E−02 | 7 | 21 | LYD789 | 0.74 | 9.87E−03 | 3 | 46 |
| LYD788 | 0.75 | 8.13E−03 | 3 | 43 | LYD790 | 0.78 | 1.28E−02 | 2 | 11 |
| LYD788 | 0.72 | 1.24E−02 | 3 | 41 | LYD790 | 0.71 | 9.08E−03 | 9 | 10 |
| LYD789 | 0.84 | 5.66E−04 | 4 | 38 | LYD790 | 0.70 | 2.37E−02 | 7 | 47 |
| LYD789 | 0.74 | 9.83E−03 | 5 | 37 | LYD790 | 0.71 | 1.44E−02 | 3 | 5 |
| LYD789 | 0.81 | 1.24E−02 | 6 | 37 | LYD791 | 0.71 | 1.48E−02 | 2 | 19 |
| LYD790 | 0.76 | 3.92E−03 | 9 | 33 | LYD791 | 0.71 | 1.52E−02 | 2 | 15 |
| LYD790 | 0.74 | 9.30E−03 | 5 | 41 | LYD791 | 0.73 | 1.03E−02 | 2 | 3 |
| LYD790 | 0.71 | 1.51E−02 | 3 | 19 | LYD791 | 0.89 | 1.08E−04 | 9 | 9 |
| LYD790 | 0.72 | 4.28E−02 | 3 | 11 | LYD791 | 0.74 | 1.09E−03 | 8 | 5 |
| LYD791 | 0.73 | 1.12E−02 | 2 | 25 | LYD791 | 0.83 | 2.84E−03 | 7 | 35 |
| LYD791 | 0.74 | 8.56E−03 | 2 | 22 | LYD792 | 0.93 | 3.75E−05 | 2 | 46 |
| LYD791 | 0.78 | 4.58E−03 | 2 | 6 | LYD792 | 0.84 | 7.06E−04 | 9 | 37 |
| LYD791 | 0.85 | 5.29E−04 | 9 | 33 | LYD792 | 0.74 | 1.44E−02 | 7 | 6 |
| LYD791 | 0.73 | 1.57E−02 | 7 | 19 | LYD792 | 0.72 | 4.39E−02 | 3 | 11 |
| LYD791 | 0.90 | 2.26E−03 | 3 | 11 | LYD793 | 0.71 | 1.42E−02 | 2 | 41 |
| LYD792 | 0.70 | 1.09E−02 | 9 | 33 | LYD793 | 0.75 | 7.31E−03 | 5 | 43 |
| LYD792 | 0.80 | 5.35E−03 | 7 | 20 | LYD793 | 0.70 | 1.54E−02 | 3 | 43 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD792 | 0.80 | 1.79E−02 | 7 | 11 | LYD794 | 0.72 | 1.62E−03 | 1 | 41 |
| LYD792 | 0.88 | 9.01E−03 | 6 | 8 | LYD794 | 0.71 | 1.01E−02 | 4 | 6 |
| LYD793 | 0.72 | 1.32E−02 | 5 | 18 | LYD794 | 0.77 | 4.38E−02 | 2 | 27 |
| LYD793 | 0.75 | 7.65E−03 | 5 | 41 | LYD794 | 0.81 | 1.43E−02 | 7 | 11 |
| LYD793 | 0.73 | 6.75E−03 | 6 | 13 | LYD794 | 0.73 | 1.05E−02 | 3 | 7 |
| LYD794 | 0.75 | 7.97E−03 | 4 | 8 | LYD794 | 0.76 | 7.16E−03 | 3 | 22 |
| LYD794 | 0.79 | 7.06E−03 | 4 | 11 | LYD794 | 0.75 | 4.59E−03 | 6 | 19 |
| LYD794 | 0.89 | 5.43E−04 | 7 | 19 | LYD794 | 0.78 | 2.72E−03 | 6 | 17 |
| LYD794 | 0.83 | 1.39E−03 | 3 | 25 | LYD795 | 0.85 | 8.86E−04 | 5 | 43 |
| LYD794 | 0.83 | 1.50E−03 | 3 | 12 | LYD795 | 0.77 | 1.46E−02 | 5 | 44 |
| LYD794 | 0.88 | 3.52E−04 | 3 | 23 | LYD795 | 0.71 | 2.04E−02 | 7 | 28 |
| LYD794 | 0.73 | 6.98E−03 | 6 | 16 | LYD795 | 0.72 | 1.98E−02 | 7 | 48 |
| LYD795 | 0.91 | 4.00E−03 | 4 | 27 | LYD795 | 0.81 | 2.70E−03 | 3 | 43 |
| LYD795 | 0.83 | 1.45E−03 | 5 | 41 | LYD795 | 0.88 | 4.31E−03 | 3 | 44 |
| LYD795 | 0.71 | 1.93E−03 | 8 | 28 | LYD796 | 0.77 | 4.52E−04 | 1 | 32 |
| LYD795 | 0.86 | 1.25E−03 | 7 | 14 | LYD796 | 0.84 | 1.20E−03 | 2 | 41 |
| LYD795 | 0.83 | 5.94E−03 | 7 | 1 | LYD796 | 0.75 | 1.22E−02 | 7 | 35 |
| LYD795 | 0.79 | 3.88E−03 | 3 | 41 | LYD796 | 0.77 | 9.43E−03 | 7 | 15 |
| LYD795 | 0.77 | 2.43E−02 | 6 | 21 | LYD796 | 0.70 | 1.55E−02 | 3 | 37 |
| LYD796 | 0.73 | 1.11E−02 | 2 | 43 | LYD797 | 0.71 | 9.03E−03 | 4 | 14 |
| LYD796 | 0.81 | 4.12E−03 | 7 | 4 | LYD797 | 0.89 | 2.06E−04 | 2 | 38 |
| LYD796 | 0.71 | 2.01E−02 | 7 | 7 | LYD797 | 0.71 | 5.08E−02 | 7 | 11 |
| LYD796 | 0.73 | 1.15E−02 | 3 | 9 | LYD797 | 0.81 | 1.53E−02 | 3 | 44 |
| LYD797 | 0.74 | 1.06E−03 | 1 | 38 | LYD798 | 0.78 | 4.66E−03 | 2 | 19 |
| LYD797 | 0.73 | 1.07E−02 | 4 | 44 | LYD798 | 0.75 | 7.85E−04 | 8 | 5 |
| LYD797 | 0.73 | 1.65E−02 | 7 | 28 | LYD798 | 0.71 | 2.08E−02 | 7 | 36 |
| LYD797 | 0.86 | 6.09E−04 | 3 | 38 | LYD798 | 0.72 | 1.28E−02 | 3 | 31 |
| LYD798 | 0.76 | 3.94E−03 | 4 | 19 | LYD799 | 0.84 | 6.27E−04 | 4 | 46 |
| LYD798 | 0.82 | 9.95E−04 | 9 | 32 | LYD799 | 0.79 | 3.93E−03 | 5 | 43 |
| LYD798 | 0.72 | 1.29E−02 | 8 | 8 | LYD799 | 0.82 | 3.38E−03 | 7 | 14 |
| LYD798 | 0.78 | 1.37E−02 | 7 | 8 | LYD799 | 0.78 | 4.49E−03 | 3 | 43 |
| LYD798 | 0.78 | 2.77E−03 | 6 | 19 | LYD799 | 0.71 | 1.39E−02 | 3 | 46 |
| LYD799 | 0.86 | 3.24E−03 | 9 | 1 | LYD799 | 0.82 | 3.64E−03 | 6 | 11 |
| LYD799 | 0.71 | 1.40E−02 | 5 | 41 | LYD800 | 0.85 | 8.80E−04 | 4 | 8 |
| LYD799 | 0.91 | 7.41E−04 | 7 | 1 | LYD800 | 0.78 | 4.47E−03 | 8 | 8 |
| LYD799 | 0.72 | 1.32E−02 | 3 | 41 | LYD800 | 0.72 | 1.78E−02 | 7 | 4 |
| LYD799 | 0.87 | 4.79E−03 | 3 | 44 | LYD800 | 0.79 | 2.18E−03 | 6 | 32 |
| LYD800 | 0.71 | 9.55E−03 | 4 | 4 | LYD801 | 0.71 | 1.42E−02 | 2 | 43 |
| LYD800 | 0.72 | 8.27E−03 | 4 | 46 | LYD801 | 0.80 | 1.82E−03 | 9 | 37 |
| LYD800 | 0.70 | 2.28E−02 | 7 | 32 | LYD801 | 0.80 | 3.39E−03 | 5 | 41 |
| LYD800 | 0.70 | 3.52E−02 | 7 | 8 | LYD801 | 0.80 | 3.38E−03 | 3 | 46 |
| LYD801 | 0.75 | 5.10E−03 | 4 | 34 | LYD802 | 0.73 | 1.03E−02 | 4 | 44 |
| LYD801 | 0.84 | 2.12E−03 | 2 | 44 | LYD802 | 0.92 | 2.26E−05 | 9 | 46 |
| LYD801 | 0.81 | 2.59E−03 | 5 | 43 | LYD802 | 0.73 | 1.11E−02 | 5 | 25 |
| LYD801 | 0.83 | 5.82E−03 | 5 | 44 | LYD802 | 0.85 | 8.22E−04 | 5 | 12 |
| LYD802 | 0.73 | 7.51E−03 | 4 | 43 | LYD802 | 0.89 | 2.02E−04 | 5 | 23 |
| LYD802 | 0.73 | 1.08E−02 | 9 | 8 | LYD802 | 0.80 | 5.04E−03 | 7 | 46 |
| LYD802 | 0.79 | 7.05E−03 | 9 | 11 | LYD803 | 0.77 | 4.77E−04 | 1 | 4 |
| LYD802 | 0.74 | 8.99E−03 | 5 | 7 | LYD803 | 0.72 | 7.74E−03 | 4 | 32 |
| LYD802 | 0.73 | 9.88E−02 | 5 | 27 | LYD803 | 0.71 | 9.28E−03 | 4 | 14 |
| LYD802 | 0.87 | 2.35E−03 | 7 | 8 | LYD803 | 0.75 | 7.40E−03 | 4 | 8 |
| LYD802 | 0.71 | 4.87E−02 | 7 | 11 | LYD803 | 0.72 | 8.80E−03 | 9 | 39 |
| LYD803 | 0.71 | 1.87E−03 | 1 | 35 | LYD803 | 0.84 | 1.22E−03 | 5 | 32 |
| LYD803 | 0.76 | 3.88E−03 | 4 | 4 | LYD803 | 0.85 | 9.21E−04 | 5 | 20 |
| LYD803 | 0.82 | 9.83E−04 | 4 | 39 | LYD803 | 0.83 | 5.35E−03 | 5 | 8 |
| LYD803 | 0.82 | 1.85E−03 | 2 | 35 | LYD803 | 0.72 | 1.83E−03 | 8 | 22 |
| LYD803 | 0.70 | 3.51E−02 | 9 | 1 | LYD803 | 0.77 | 8.81E−03 | 7 | 4 |
| LYD803 | 0.75 | 7.75E−03 | 5 | 4 | LYD803 | 0.92 | 5.06E−04 | 7 | 8 |
| LYD803 | 0.83 | 1.50E−03 | 5 | 39 | LYD803 | 0.73 | 1.74E−02 | 7 | 46 |
| LYD803 | 0.74 | 9.62E−04 | 8 | 4 | LYD803 | 0.71 | 1.53E−02 | 3 | 4 |
| LYD803 | 0.71 | 2.10E−03 | 8 | 3 | LYD803 | 0.75 | 7.43E−03 | 3 | 46 |
| LYD803 | 0.77 | 9.08E−03 | 7 | 7 | LYD803 | 0.76 | 2.81E−02 | 3 | 44 |
| LYD803 | 0.77 | 8.48E−03 | 7 | 40 | LYD804 | 0.74 | 9.77E−03 | 9 | 8 |
| LYD803 | 0.78 | 2.31E−02 | 7 | 11 | LYD804 | 0.72 | 1.25E−02 | 5 | 22 |
| LYD803 | 0.86 | 6.05E−03 | 3 | 8 | LYD806 | 0.74 | 1.07E−03 | 1 | 42 |
| LYD803 | 0.71 | 4.98E−02 | 3 | 11 | LYD806 | 0.86 | 7.26E−04 | 5 | 31 |
| LYD804 | 0.70 | 1.54E−02 | 4 | 44 | LYD806 | 0.72 | 1.90E−02 | 7 | 20 |
| LYD804 | 0.81 | 2.52E−03 | 5 | 25 | LYD806 | 0.82 | 2.21E−03 | 3 | 43 |
| LYD804 | 0.72 | 1.19E−02 | 5 | 23 | LYD806 | 0.86 | 6.57E−03 | 3 | 44 |
| LYD806 | 0.70 | 2.47E−03 | 1 | 9 | LYD806 | 0.78 | 2.66E−03 | 6 | 9 |
| LYD806 | 0.74 | 1.35E−02 | 7 | 2 | LYD806 | 0.71 | 9.37E−03 | 6 | 29 |
| LYD806 | 0.89 | 6.00E−04 | 7 | 14 | LYD807 | 0.71 | 2.17E−03 | 1 | 12 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD806 | 0.82 | 2.08E−03 | 3 | 41 | LYD807 | 0.73 | 7.60E−03 | 8 | 1 |
| LYD806 | 0.81 | 1.50E−03 | 6 | 42 | LYD807 | 0.74 | 1.49E−02 | 7 | 20 |
| LYD806 | 0.76 | 4.37E−03 | 6 | 30 | LYD807 | 0.83 | 3.17E−03 | 7 | 14 |
| LYD807 | 0.72 | 1.50E−03 | 1 | 24 | LYD807 | 0.85 | 1.73E−03 | 7 | 48 |
| LYD807 | 0.71 | 3.09E−02 | 9 | 21 | LYD807 | 0.75 | 1.98E−02 | 7 | 1 |
| LYD807 | 0.71 | 2.06E−02 | 7 | 2 | LYD807 | 0.72 | 1.99E−02 | 7 | 6 |
| LYD807 | 0.82 | 3.62E−03 | 7 | 28 | LYD809 | 0.77 | 3.32E−03 | 4 | 36 |
| LYD807 | 0.73 | 1.64E−02 | 7 | 15 | LYD809 | 0.74 | 8.72E−03 | 2 | 6 |
| LYD807 | 0.80 | 5.24E−03 | 7 | 22 | LYD809 | 0.80 | 1.81E−03 | 9 | 26 |
| LYD807 | 0.80 | 5.34E−03 | 7 | 3 | LYD809 | 0.72 | 8.28E−03 | 9 | 30 |
| LYD809 | 0.72 | 8.41E−03 | 4 | 26 | LYD809 | 0.93 | 2.21E−04 | 5 | 44 |
| LYD809 | 0.82 | 3.58E−03 | 2 | 8 | LYD809 | 0.81 | 4.24E−03 | 7 | 48 |
| LYD809 | 0.72 | 8.34E−03 | 9 | 42 | LYD809 | 0.71 | 3.33E−02 | 7 | 8 |
| LYD809 | 0.76 | 3.87E−03 | 9 | 36 | LYD809 | 0.82 | 1.16E−03 | 6 | 48 |
| LYD809 | 0.78 | 4.68E−03 | 5 | 43 | LYD810 | 0.83 | 1.70E−03 | 2 | 46 |
| LYD809 | 0.75 | 1.25E−02 | 7 | 14 | LYD810 | 0.83 | 8.94E−04 | 9 | 4 |
| LYD809 | 0.90 | 8.70E−04 | 7 | 1 | LYD810 | 0.71 | 9.42E−03 | 9 | 39 |
| LYD809 | 0.79 | 1.95E−02 | 3 | 11 | LYD810 | 0.73 | 1.04E−02 | 5 | 43 |
| LYD810 | 0.70 | 1.09E−02 | 4 | 34 | LYD810 | 0.71 | 2.03E−02 | 7 | 4 |
| LYD810 | 0.77 | 3.16E−03 | 9 | 32 | LYD810 | 0.70 | 2.37E−02 | 7 | 7 |
| LYD810 | 0.72 | 8.14E−03 | 9 | 14 | LYD810 | 0.77 | 9.93E−03 | 7 | 48 |
| LYD810 | 0.84 | 1.08E−03 | 9 | 8 | LYD810 | 0.76 | 6.16E−03 | 3 | 43 |
| LYD810 | 0.79 | 3.81E−03 | 5 | 41 | LYD810 | 0.85 | 2.02E−03 | 6 | 11 |
| LYD810 | 0.74 | 1.54E−02 | 7 | 14 | LYD811 | 0.86 | 2.84E−04 | 4 | 48 |
| LYD810 | 0.73 | 1.61E−02 | 7 | 15 | LYD811 | 0.94 | 1.61E−05 | 2 | 48 |
| LYD810 | 0.85 | 4.08E−03 | 7 | 8 | LYD811 | 0.78 | 4.92E−03 | 5 | 43 |
| LYD810 | 0.85 | 9.73E−04 | 3 | 41 | LYD811 | 0.76 | 6.50E−03 | 3 | 48 |
| LYD810 | 0.70 | 1.08E−02 | 6 | 13 | LYD811 | 0.85 | 5.02E−04 | 6 | 48 |
| LYD811 | 0.74 | 9.27E−03 | 2 | 43 | LYD812 | 0.74 | 9.41E−03 | 1 | 8 |
| LYD811 | 0.79 | 2.40E−03 | 9 | 37 | LYD812 | 0.70 | 2.39E−02 | 4 | 11 |
| LYD811 | 0.79 | 1.89E−02 | 7 | 11 | LYD812 | 0.78 | 2.89E−03 | 9 | 32 |
| LYD811 | 0.71 | 9.01E−03 | 6 | 10 | LYD812 | 0.77 | 1.54E−02 | 9 | 1 |
| LYD812 | 0.76 | 6.83E−04 | 1 | 4 | LYD812 | 0.76 | 6.48E−03 | 5 | 20 |
| LYD812 | 0.70 | 2.37E−03 | 1 | 6 | LYD812 | 0.74 | 9.37E−03 | 5 | 29 |
| LYD812 | 0.78 | 4.34E−03 | 4 | 44 | LYD812 | 0.71 | 2.06E−02 | 7 | 7 |
| LYD812 | 0.74 | 6.08E−03 | 9 | 39 | LYD812 | 0.73 | 1.72E−02 | 7 | 40 |
| LYD812 | 0.73 | 1.02E−02 | 5 | 24 | LYD812 | 0.84 | 1.29E−03 | 3 | 46 |
| LYD812 | 0.76 | 7.21E−03 | 5 | 30 | LYD813 | 0.71 | 4.48E−03 | 1 | 47 |
| LYD812 | 0.74 | 8.87E−03 | 5 | 46 | LYD813 | 0.78 | 1.26E−02 | 9 | 1 |
| LYD812 | 0.93 | 3.37E−04 | 7 | 8 | LYD813 | 0.73 | 1.05E−02 | 5 | 37 |
| LYD812 | 0.72 | 1.29E−02 | 3 | 32 | LYD813 | 0.77 | 9.57E−03 | 7 | 38 |
| LYD812 | 0.73 | 1.67E−02 | 6 | 11 | LYD813 | 0.75 | 4.76E−03 | 6 | 38 |
| LYD813 | 0.72 | 2.79E−02 | 2 | 11 | LYD814 | 0.75 | 4.58E−03 | 4 | 32 |
| LYD813 | 0.76 | 6.56E−03 | 9 | 8 | LYD814 | 0.81 | 2.66E−03 | 2 | 46 |
| LYD813 | 0.71 | 2.04E−03 | 8 | 28 | LYD814 | 0.76 | 1.85E−02 | 9 | 1 |
| LYD813 | 0.83 | 8.49E−04 | 6 | 9 | LYD814 | 0.72 | 1.25E−02 | 5 | 41 |
| LYD813 | 0.79 | 3.54E−02 | 6 | 44 | LYD814 | 0.70 | 2.41E−02 | 7 | 32 |
| LYD814 | 0.74 | 2.35E−02 | 4 | 21 | LYD814 | 0.71 | 1.44E−02 | 3 | 43 |
| LYD814 | 0.84 | 4.57E−03 | 9 | 21 | LYD814 | 0.85 | 7.69E−03 | 3 | 44 |
| LYD814 | 0.76 | 6.56E−03 | 5 | 43 | LYD815 | 0.80 | 3.19E−03 | 5 | 24 |
| LYD814 | 0.81 | 7.79E−03 | 5 | 44 | LYD815 | 0.74 | 9.13E−03 | 5 | 25 |
| LYD814 | 0.76 | 1.06E−02 | 7 | 39 | LYD815 | 0.77 | 7.21E−02 | 5 | 27 |
| LYD814 | 0.76 | 6.95E−03 | 3 | 41 | LYD815 | 0.72 | 1.16E−02 | 5 | 3 |
| LYD814 | 0.79 | 3.44E−02 | 6 | 44 | LYD815 | 0.76 | 1.08E−02 | 5 | 11 |
| LYD815 | 0.74 | 9.13E−03 | 5 | 4 | LYD815 | 0.79 | 7.02E−03 | 7 | 23 |
| LYD815 | 0.77 | 5.60E−03 | 5 | 7 | LYD815 | 0.82 | 1.92E−03 | 3 | 9 |
| LYD815 | 0.74 | 9.93E−03 | 5 | 15 | LYD816 | 0.90 | 1.85E−04 | 4 | 8 |
| LYD815 | 0.78 | 4.96E−03 | 5 | 6 | LYD816 | 0.78 | 4.72E−03 | 2 | 34 |
| LYD815 | 0.83 | 2.79E−03 | 7 | 7 | LYD816 | 0.77 | 3.16E−03 | 9 | 32 |
| LYD815 | 0.85 | 6.95E−03 | 7 | 11 | LYD816 | 0.71 | 9.24E−03 | 9 | 39 |
| LYD816 | 0.77 | 3.73E−03 | 4 | 2 | LYD816 | 0.80 | 2.89E−03 | 5 | 41 |
| LYD816 | 0.72 | 1.23E−02 | 2 | 4 | LYD816 | 0.81 | 7.97E−03 | 5 | 44 |
| LYD816 | 0.85 | 1.88E−03 | 2 | 8 | LYD816 | 0.72 | 1.78E−02 | 7 | 9 |
| LYD816 | 0.74 | 6.08E−03 | 9 | 34 | LYD816 | 0.75 | 7.38E−03 | 3 | 43 |
| LYD816 | 0.89 | 2.05E−04 | 5 | 43 | LYD816 | 0.73 | 1.13E−02 | 3 | 41 |
| LYD816 | 0.81 | 2.40E−03 | 5 | 38 | LYD816 | 0.86 | 1.28E−02 | 3 | 27 |
| LYD816 | 0.77 | 5.11E−04 | 8 | 9 | LYD816 | 0.78 | 4.05E−02 | 6 | 44 |
| LYD816 | 0.90 | 1.80E−04 | 3 | 9 | LYD817 | 0.75 | 1.18E−02 | 4 | 11 |
| LYD816 | 0.75 | 8.34E−03 | 3 | 33 | LYD817 | 0.74 | 2.25E−02 | 3 | 21 |
| LYD816 | 0.74 | 8.53E−03 | 3 | 38 | LYD818 | 0.78 | 4.29E−03 | 2 | 31 |
| LYD816 | 0.70 | 1.12E−02 | 6 | 38 | LYD818 | 0.76 | 6.20E−03 | 3 | 43 |
| LYD817 | 0.70 | 1.10E−02 | 4 | 20 | LYD818 | 0.76 | 3.95E−03 | 6 | 18 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD817 | 0.72 | 1.22E-02 | 2 | 38 | LYD819 | 0.76 | 4.02E-03 | 1 | 1 |
| LYD817 | 0.72 | 7.73E-03 | 6 | 9 | LYD819 | 0.86 | 7.81E-04 | 2 | 37 |
| LYD818 | 0.74 | 1.12E-03 | 8 | 42 | LYD819 | 0.91 | 7.76E-04 | 9 | 1 |
| LYD818 | 0.83 | 1.44E-03 | 3 | 41 | LYD821 | 0.70 | 1.56E-02 | 2 | 46 |
| LYD818 | 0.80 | 5.46E-02 | 6 | 27 | LYD821 | 0.75 | 4.68E-03 | 9 | 40 |
| LYD819 | 0.77 | 3.40E-03 | 4 | 38 | LYD821 | 0.73 | 1.24E-03 | 8 | 48 |
| LYD819 | 0.72 | 2.98E-02 | 9 | 21 | LYD821 | 0.74 | 6.24E-03 | 6 | 12 |
| LYD819 | 0.96 | 2.14E-03 | 6 | 27 | LYD821 | 0.72 | 6.97E-02 | 6 | 44 |
| LYD821 | 0.73 | 7.54E-03 | 9 | 32 | LYD822 | 0.80 | 3.08E-03 | 2 | 9 |
| LYD821 | 0.82 | 1.93E-03 | 5 | 41 | LYD822 | 0.86 | 3.67E-04 | 9 | 4 |
| LYD821 | 0.78 | 3.78E-02 | 3 | 27 | LYD822 | 0.72 | 8.50E-03 | 9 | 15 |
| LYD821 | 0.88 | 2.21E-02 | 6 | 27 | LYD822 | 0.71 | 1.44E-02 | 5 | 2 |
| LYD822 | 0.78 | 4.23E-03 | 4 | 44 | LYD822 | 0.83 | 1.38E-03 | 5 | 48 |
| LYD822 | 0.84 | 1.09E-03 | 2 | 33 | LYD822 | 0.73 | 1.66E-02 | 7 | 23 |
| LYD822 | 0.75 | 4.93E-03 | 9 | 7 | LYD822 | 0.72 | 4.32E-02 | 7 | 11 |
| LYD822 | 0.73 | 7.30E-03 | 9 | 22 | LYD823 | 0.88 | 8.16E-04 | 4 | 11 |
| LYD822 | 0.75 | 7.72E-03 | 5 | 36 | LYD823 | 0.76 | 4.45E-03 | 9 | 35 |
| LYD822 | 0.73 | 1.76E-02 | 7 | 12 | LYD823 | 0.77 | 3.52E-03 | 9 | 7 |
| LYD822 | 0.71 | 2.16E-02 | 7 | 46 | LYD823 | 0.71 | 1.03E-02 | 9 | 38 |
| LYD823 | 0.75 | 5.16E-03 | 4 | 20 | LYD823 | 0.71 | 1.48E-02 | 5 | 24 |
| LYD823 | 0.73 | 6.54E-03 | 9 | 4 | LYD823 | 0.75 | 8.44E-03 | 5 | 30 |
| LYD823 | 0.72 | 8.71E-03 | 9 | 14 | LYD823 | 0.72 | 1.19E-02 | 5 | 48 |
| LYD823 | 0.72 | 7.82E-03 | 9 | 39 | LYD823 | 0.81 | 2.65E-03 | 5 | 46 |
| LYD823 | 0.88 | 4.16E-04 | 9 | 44 | LYD823 | 0.94 | 7.00E-08 | 8 | 5 |
| LYD823 | 0.79 | 4.12E-03 | 5 | 4 | LYD823 | 0.77 | 4.54E-04 | 8 | 22 |
| LYD823 | 0.86 | 6.88E-04 | 5 | 5 | LYD823 | 0.82 | 3.74E-03 | 7 | 4 |
| LYD823 | 0.70 | 1.59E-02 | 5 | 3 | LYD823 | 0.81 | 4.31E-03 | 7 | 7 |
| LYD823 | 0.72 | 1.97E-02 | 5 | 11 | LYD823 | 0.74 | 1.53E-02 | 7 | 48 |
| LYD823 | 0.73 | 1.34E-03 | 8 | 15 | LYD823 | 0.72 | 1.88E-02 | 7 | 3 |
| LYD823 | 0.71 | 2.04E-03 | 8 | 3 | LYD823 | 0.76 | 1.02E-02 | 7 | 6 |
| LYD823 | 0.80 | 5.05E-03 | 7 | 14 | LYD824 | 0.71 | 1.03E-02 | 9 | 40 |
| LYD823 | 0.87 | 1.21E-03 | 7 | 15 | LYD824 | 0.86 | 1.46E-03 | 7 | 25 |
| LYD823 | 0.79 | 7.05E-03 | 7 | 22 | LYD824 | 0.91 | 3.00E-04 | 7 | 5 |
| LYD823 | 0.76 | 1.75E-02 | 7 | 8 | LYD824 | 0.74 | 1.53E-02 | 7 | 22 |
| LYD824 | 0.84 | 1.19E-02 | 9 | 8 | LYD824 | 0.74 | 1.49E-02 | 7 | 23 |
| LYD824 | 0.77 | 8.74E-03 | 7 | 24 | LYD824 | 0.74 | 3.41E-02 | 7 | 11 |
| LYD824 | 0.85 | 1.79E-03 | 7 | 7 | LYD825 | 0.71 | 1.52E-02 | 2 | 19 |
| LYD824 | 0.74 | 1.38E-02 | 7 | 48 | LYD825 | 0.73 | 1.09E-02 | 5 | 43 |
| LYD824 | 0.73 | 1.72E-02 | 7 | 3 | LYD825 | 0.72 | 1.32E-02 | 5 | 31 |
| LYD824 | 0.74 | 1.50E-02 | 7 | 6 | LYD825 | 0.71 | 2.25E-03 | 8 | 5 |
| LYD824 | 0.84 | 1.81E-02 | 6 | 44 | LYD825 | 0.78 | 7.16E-03 | 7 | 40 |
| LYD825 | 0.89 | 1.40E-03 | 2 | 11 | LYD825 | 0.79 | 2.07E-02 | 3 | 11 |
| LYD825 | 0.83 | 1.58E-03 | 5 | 41 | LYD826 | 0.84 | 1.12E-03 | 2 | 5 |
| LYD825 | 0.75 | 1.27E-02 | 8 | 27 | LYD826 | 0.81 | 2.47E-03 | 5 | 41 |
| LYD825 | 0.89 | 1.16E-03 | 7 | 8 | LYD826 | 0.87 | 1.18E-02 | 7 | 27 |
| LYD825 | 0.76 | 7.05E-03 | 4 | 48 | LYD826 | 0.72 | 7.81E-03 | 4 | 43 |
| LYD826 | 0.83 | 9.25E-04 | 4 | 19 | LYD827 | 0.73 | 1.04E-02 | 2 | 18 |
| LYD826 | 0.83 | 1.58E-03 | 5 | 43 | LYD827 | 0.81 | 5.02E-02 | 6 | 27 |
| LYD826 | 0.87 | 2.54E-02 | 5 | 27 | LYD828 | 0.78 | 3.43E-04 | 1 | 29 |
| LYD826 | 0.84 | 9.37E-03 | 3 | 44 | LYD828 | 0.75 | 1.22E-02 | 7 | 18 |
| LYD827 | 0.83 | 1.45E-03 | 4 | 44 | LYD828 | 0.77 | 3.28E-03 | 6 | 26 |
| LYD827 | 0.74 | 9.14E-02 | 5 | 27 | LYD829 | 0.81 | 1.40E-04 | 1 | 48 |
| LYD828 | 0.75 | 8.59E-04 | 1 | 41 | LYD829 | 0.78 | 4.72E-03 | 3 | 25 |
| LYD828 | 0.82 | 2.02E-03 | 2 | 46 | LYD830 | 0.79 | 4.08E-03 | 2 | 43 |
| LYD828 | 0.87 | 4.62E-04 | 3 | 48 | LYD830 | 0.87 | 1.10E-03 | 2 | 44 |
| LYD828 | 0.72 | 6.59E-02 | 6 | 8 | LYD830 | 0.80 | 1.78E-03 | 9 | 33 |
| LYD829 | 0.72 | 8.53E-03 | 9 | 12 | LYD830 | 0.85 | 1.06E-03 | 5 | 41 |
| LYD830 | 0.78 | 3.78E-02 | 4 | 27 | LYD830 | 0.80 | 5.66E-03 | 7 | 14 |
| LYD830 | 0.74 | 8.76E-03 | 2 | 41 | LYD830 | 0.80 | 3.15E-03 | 3 | 43 |
| LYD830 | 0.77 | 3.15E-03 | 9 | 9 | LYD830 | 0.84 | 8.85E-03 | 3 | 44 |
| LYD830 | 0.77 | 5.27E-03 | 5 | 43 | LYD926 | 0.83 | 2.76E-03 | 2 | 44 |
| LYD830 | 0.81 | 4.70E-03 | 7 | 2 | LYD926 | 0.77 | 5.13E-03 | 5 | 33 |
| LYD830 | 0.87 | 2.47E-03 | 7 | 1 | LYD926 | 0.71 | 1.39E-02 | 3 | 28 |
| LYD830 | 0.79 | 3.55E-03 | 3 | 41 | LYD926 | 0.73 | 1.02E-02 | 3 | 6 |
| LYD926 | 0.82 | 1.79E-03 | 2 | 43 | LYD929 | 0.77 | 6.08E-03 | 2 | 15 |
| LYD926 | 0.87 | 5.46E-04 | 5 | 9 | LYD929 | 0.71 | 1.42E-02 | 2 | 22 |
| LYD926 | 0.81 | 2.65E-03 | 7 | 27 | LYD929 | 0.74 | 5.73E-03 | 9 | 37 |
| LYD926 | 0.76 | 6.24E-03 | 3 | 48 | LYD929 | 0.98 | 3.41E-07 | 5 | 41 |
| LYD926 | 0.71 | 7.57E-02 | 6 | 44 | LYD929 | 0.70 | 3.47E-02 | 7 | 1 |
| LYD929 | 0.79 | 3.39E-02 | 2 | 27 | LYD929 | 0.77 | 4.08E-02 | 6 | 44 |
| LYD929 | 0.80 | 3.27E-03 | 2 | 48 | LYD930 | 0.73 | 1.14E-02 | 2 | 24 |
| LYD929 | 0.73 | 1.09E-02 | 2 | 3 | LYD930 | 0.79 | 3.90E-03 | 2 | 25 |

TABLE 158-continued

Correlation between the expression level of selected genes of some embodiments of the invention in various tissues and the phenotypic performance under normal conditions across 16 bean varieties ("fine" and "extra fine")

| Gene Name | R | P value | Exp. set | Corr. Set ID | Gene Name | R | P value | Exp. set | Corr. Set ID |
|---|---|---|---|---|---|---|---|---|---|
| LYD929 | 0.88 | 3.69E−04 | 5 | 43 | LYD930 | 0.91 | 8.29E−05 | 2 | 15 |
| LYD929 | 0.89 | 1.12E−03 | 5 | 44 | LYD930 | 0.82 | 2.07E−03 | 2 | 22 |
| LYD929 | 0.81 | 1.56E−02 | 6 | 21 | LYD930 | 0.75 | 7.64E−03 | 2 | 6 |
| LYD930 | 0.72 | 1.51E−03 | 1 | 9 | LYD930 | 0.74 | 6.45E−03 | 9 | 33 |
| LYD930 | 0.85 | 8.97E−04 | 2 | 43 | LYD930 | 0.73 | 1.07E−02 | 5 | 32 |
| LYD930 | 0.86 | 6.10E−04 | 2 | 41 | LYD930 | 0.78 | 8.06E−03 | 7 | 2 |
| LYD930 | 0.70 | 1.58E−02 | 2 | 17 | LYD930 | 0.76 | 6.19E−03 | 3 | 48 |
| LYD930 | 0.83 | 1.66E−03 | 2 | 3 | MGP10 | 0.81 | 4.32E−03 | 7 | 25 |
| LYD930 | 0.82 | 3.86E−03 | 2 | 44 | MGP10 | 0.84 | 2.48E−03 | 7 | 5 |
| LYD930 | 0.84 | 6.93E−04 | 9 | 10 | MGP10 | 0.73 | 1.64E−02 | 7 | 48 |
| LYD930 | 0.87 | 2.01E−03 | 5 | 44 | MGP10 | 0.75 | 1.20E−02 | 7 | 3 |
| LYD930 | 0.72 | 2.01E−02 | 7 | 18 | MGP10 | 0.90 | 1.40E−04 | 3 | 48 |
| MGP10 | 0.78 | 4.91E−03 | 9 | 47 | MGP10 | 0.86 | 3.18E−04 | 6 | 9 |
| MGP10 | 0.85 | 1.84E−03 | 7 | 7 | | | | | |
| MGP10 | 0.90 | 4.33E−04 | 7 | 15 | | | | | |
| MGP10 | 0.81 | 4.41E−03 | 7 | 22 | | | | | |
| MGP10 | 0.77 | 8.50E−03 | 7 | 6 | | | | | |
| MGP10 | 0.71 | 9.58E−03 | 6 | 42 | | | | | |

Table 158. Provided are the correlations (R) between the expression levels yield improving genes and their homologs in various tissues [Expression (Exp) sets] and the phenotypic performance [yield, biomass, and plant architecture (Correlation vector (Cor))] under normal conditions across bean varieties.
P = p value.

Example 20

Production of B. Juncea Transcriptome and High Throughput Correlation Analysis with Yield Parameters Using 34K B. juncea Oligonucleotide Micro-Arrays In order to produce a high throughput correlation analysis, the present inventors utilized a *B. juncea* oligonucleotide micro-array, produced by Agilent Technologies [chem. (dot) agilent (dot) com/Scripts/PDS (dot) asp?1Page=50879]. The array oligonucleotide represents about 34,000 *B. juncea* genes and transcripts. In order to define correlations between the levels of RNA expression with yield components, various plant characteristics of 41 different *B. juncea* lines were analyzed and used for RNA expression analysis. The correlation between the RNA levels and the characterized parameters was analyzed using Pearson correlation test.

Correlation of *B. juncea* Genes' Expression Levels with Phenotypic Characteristics Across Ecotype Experimental Procedures 41 *B. juncea* varieties were grown in four repetitive plots, in field. Briefly, the growing protocol was as follows: *B. juncea* seeds were sown in soil and grown under normal conditions until harvest (field experiment; normal growth conditions which included irrigation 2-3 times a week, and fertilization given in the first month of the growth period). In order to define correlations between the levels of RNA expression with yield components, 41 different *B. juncea* varieties were analyzed and used for gene expression analyses. Analysis was performed at flowering stage.

TABLE 159

| B. juncea transcriptome expression sets | |
|---|---|
| Expression Set | Set ID |
| flower at pod setting stage under normal growth conditions | 1 |
| Leaf at pod setting stage under normal growth conditions | 2 |
| Pods and developing seeds pod setting stage under normal growth conditions | 3 |
| stem at pod setting stage under normal growth conditions | 4 |

Table 159.

RNA extraction—All 41 selected *B. juncea* varieties were sampled per treatment. Plant tissues [fully expended leaf, stem, flowers and pods] growing under normal conditions were sampled and RNA was extracted as described above.

The collected data parameters were as follows (summarized in Table 160):

Average shoot DW—Average weight of shoot per plant.
Average plant DW (Flowering) [g]—Average weight of all the plant at flowering (Stem DW+leaves DW).
Biomass per plant [Kg]—Average biomass at harvest above ground at dry mature stage.
Grain yield [gr]—Seed weight per unit area.
Harvest index—Average seed yield per plant/Average dry weight.
Inflorescence height [cm]—Measure main raceme (Inflorescence) length.
Leaf area per plant [$cm^2$]—Measurement was performed using a Leaf area-meter.
Leaves DW [gr]—Weight leaves after drying at flowering.
Number days 50% flowering [number]—Calculate days from day 1.
Number of reproductive lateral branches (Flowering) [number].
Plant height [cm]—Height of main stem measure from first node above ground to last node before apex.
Plants number at harvest [number]—Count number of plants per plot.
Pod length [mm]—Measure lowest pods length.
Pods per main inflorescence [number]—Count number of pods on main raceme.

Reproductive period [number]—Calculate number of days from bolting to harvest.

Relative growth rate [gr/day]—the relative growth rate (RGR) based on dry weight is calculated using Formula XXXIV above.

Seeds yield per plant [Kg]—Weight seeds per plot and normalized to 0% RH.

Specific leaf area (Flowering) [cm²/g]—Leaf area per gram leaf dry weight.

Stem DW (flowering) [gr]—Weight stem after drying at flowering.

Stem thickness [mm]—Measure Thickness of main branch base.

Experimental Results 41 different *B. juncea* varieties (i.e., Var1-41) were grown and characterized for 20 parameters as specified above. The average for each of the measured parameters was calculated using the JMP software and values are summarized in Tables 161-165 below. Subsequent correlation analysis between the various transcriptome expression sets and the average parameters was conducted. Results were then integrated to the database (Table 166).

TABLE 160

*B. juncea* correlated parameters (vectors)

| Correlated parameter with | Correlation ID |
|---|---|
| Avr Shoot DW [gr] | 1 |
| Avr plant DW (F) [gr] | 2 |
| Biomass per plant [kg] | 3 |
| Harvest index | 4 |
| Inflorescence height [cm] | 5 |
| Leaf area per plant [cm²] | 6 |
| Leaves DW (flowering) [gr] | 7 |
| Num days 50% flowering | 8 |
| Num of reproductive Lateral branches | 9 |
| Plant height [cm] | 10 |
| Plants num at harvest [number] | 11 |
| Pod length [mm] | 12 |
| Pods per main inflorescence [number] | 13 |
| Relative growth rate [gr/day] | 14 |
| Reproductive period [number] | 15 |
| Seeds yield per plant [kg] | 16 |
| Specific leaf area (F) [cm²/gr] | 17 |
| Stem DW (flowering) [gr] | 18 |
| Stem thickness [mm] | 19 |
| Grain yield [gr] | 20 |

Table 160. "F" = Flowering. "Num" = number. "Avr" = average.

TABLE 161

Measured parameters in *B. juncea* varieties (lines 1-8)

| Ecotype/Treatment | Line-1 | Line-2 | Line-3 | Line-4 | Line-5 | Line-6 | Line-7 | Line-8 |
|---|---|---|---|---|---|---|---|---|
| 1 | 0.71 | 0.83 | 0.82 | 0.60 | 1.00 | 0.96 | 1.27 | 0.88 |
| 2 | 7.46 | 11.93 | 4.27 | 11.91 | 5.28 | 4.66 | 8.44 | 13.57 |
| 3 | 0.03 | 0.02 | 0.01 | 0.05 | 0.02 | 0.02 | 0.02 | 0.02 |
| 4 | 0.13 | 0.15 | 0.17 | 0.11 | 0.11 | 0.12 | 0.16 | 0.19 |
| 5 | 45.02 | 44.15 | 40.56 | 42.42 | 44.04 | 51.13 | 57.92 | 47.94 |
| 6 | 811.00 | 587.00 | 472.10 | 406.75 | 335.36 | 391.62 | 454.50 | 777.75 |
| 7 | 5.45 | 4.65 | 4.75 | 3.85 | 4.30 | 5.19 | 4.45 | 8.32 |
| 8 | 39.00 | 32.50 | 32.00 | 32.67 | 26.00 | 30.00 | 32.50 | 33.00 |
| 9 | 7.17 | 7.42 | 6.75 | 6.75 | 6.75 | 7.58 | 5.33 | 6.83 |
| 10 | 91.42 | 90.79 | 100.23 | 103.06 | 58.65 | 86.02 | 98.56 | 109.42 |
| 11 | 165.75 | 193.50 | 231.00 | 98.75 | 221.50 | 259.50 | 205.00 | 145.50 |
| 12 | 43.23 | 40.21 | 41.30 | 48.20 | 37.74 | 38.95 | 43.77 | 45.51 |
| 13 | 35.71 | 34.75 | 26.38 | 14.78 | 27.63 | 31.46 | 31.58 | 28.38 |
| 14 | 0.17 | 0.19 | 0.13 | 0.16 | 0.18 | 0.17 | 0.22 | 0.17 |
| 15 | 52.00 | 58.50 | 71.00 | 62.67 | 58.00 | 61.00 | 61.50 | 61.00 |
| 16 | 3.10 | 2.73 | 2.15 | 4.93 | 1.36 | 1.87 | 2.84 | 4.12 |
| 17 | 323.35 | 402.48 | 300.95 | 307.41 | 244.34 | 242.62 | 308.33 | 300.53 |
| 18 | 16.93 | 31.14 | 8.06 | 31.88 | 11.55 | 8.78 | 20.86 | 32.39 |
| 19 | 7.70 | 7.63 | 6.35 | 8.54 | 5.47 | 6.95 | 8.05 | 7.55 |
| 20 | 550.50 | 572.75 | 516.75 | 517.50 | 330.00 | 526.25 | 608.00 | 616.00 |

Table 161.

TABLE 162

Measured parameters in *B. juncea* varieties (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 1 | 0.85 | 0.83 | 1.06 | 1.33 | 0.87 | 1.08 | 1.09 | 1.31 |
| 2 | 12.03 | 8.35 | 11.19 | 10.80 | 7.84 | 9.11 | 11.69 | 5.43 |
| 3 | 0.02 | 0.02 | 0.03 | 0.02 | 0.02 | 0.03 | 0.02 | 0.02 |
| 4 | 0.15 | 0.17 | 0.13 | 0.16 | 0.15 | 0.12 | 0.17 | 0.18 |
| 5 | 42.58 | 32.41 | 31.34 | 47.00 | 50.94 | 40.88 | 50.00 | 41.14 |
| 6 | 657.67 | 440.75 | 564.00 | 396.42 | 551.00 | 507.25 | 765.17 | 552.16 |
| 7 | 4.80 | 3.87 | 6.25 | 3.85 | 3.45 | 3.92 | 5.25 | 6.51 |
| 8 | NA | NA | 34.25 | 32.00 | 32.50 | 33.75 | 32.50 | 26.50 |
| 9 | 6.83 | 6.08 | 7.00 | 5.92 | 5.42 | 5.83 | 6.25 | 7.00 |
| 10 | 80.19 | 110.31 | 127.00 | 105.44 | 121.75 | 104.35 | 98.46 | 62.98 |
| 11 | 148.75 | 177.75 | 193.50 | 176.25 | 210.75 | 189.50 | 223.75 | 222.00 |

TABLE 162-continued

Measured parameters in *B. juncea* varieties (lines 9-16)

| Ecotype/Treatment | Line-9 | Line-10 | Line-11 | Line-12 | Line-13 | Line-14 | Line-15 | Line-16 |
|---|---|---|---|---|---|---|---|---|
| 12 | 42.74 | 36.30 | 34.44 | 45.74 | 42.57 | 47.01 | 41.34 | 37.35 |
| 13 | 22.22 | 32.11 | 35.50 | 26.54 | 29.08 | 25.29 | 31.79 | 27.75 |
| 14 | 0.23 | 0.18 | 0.21 | 0.23 | 0.17 | 0.18 | 0.21 | 0.19 |
| 15 | NA | NA | 62.75 | 59.00 | 64.50 | 60.25 | 64.50 | 67.25 |
| 16 | 2.95 | 3.33 | 2.57 | 3.61 | 2.94 | 2.66 | 2.81 | 2.78 |
| 17 | 395.43 | 358.58 | 249.28 | 364.49 | 448.65 | 423.41 | 434.68 | 267.71 |
| 18 | 31.29 | 21.18 | 27.33 | 28.56 | 20.08 | 23.40 | 29.81 | 11.41 |
| 19 | 7.05 | 9.65 | 7.84 | 8.08 | 8.59 | 7.45 | 7.09 | 5.66 |
| 20 | 462.75 | 648.50 | 527.50 | 607.25 | 666.50 | 534.00 | 681.00 | 556.75 |

Table 162.

TABLE 163

Measured parameters in *B. juncea* varieties (lines 17-24)

| Ecotype/Treatment | Line-17 | Line-18 | Line-19 | Line-20 | Line-21 | Line-22 | Line-23 | Line-24 |
|---|---|---|---|---|---|---|---|---|
| 1 | 0.82 | 1.04 | 0.95 | 1.42 | 1.16 | 1.08 | 0.76 | 1.06 |
| 2 | 4.75 | 6.14 | 10.32 | 8.15 | 4.10 | 4.47 | 9.35 | 10.49 |
| 3 | 0.01 | 0.01 | 0.01 | 0.01 | 0.01 | 0.01 | 0.01 | 0.02 |
| 4 | 0.19 | 0.18 | 0.15 | 0.17 | 0.10 | 0.17 | 0.17 | 0.13 |
| 5 | 44.75 | 42.83 | 41.67 | 45.90 | 47.11 | 39.64 | 46.38 | 40.42 |
| 6 | 374.51 | 694.62 | 657.67 | 234.75 | 405.43 | 470.64 | 688.42 | 632.92 |
| 7 | 4.40 | 6.72 | 7.79 | 2.52 | 4.10 | 5.20 | 6.32 | 8.33 |
| 8 | 26.50 | 32.00 | 31.50 | 30.33 | 31.00 | 31.00 | 33.75 | 31.50 |
| 9 | 5.25 | 7.75 | 6.67 | 5.50 | 6.17 | 6.25 | 7.58 | 7.17 |
| 10 | 67.48 | 97.56 | 90.65 | 90.06 | 82.49 | 96.47 | 89.77 | 131.83 |
| 11 | 220.75 | 255.50 | 254.25 | 223.33 | 261.75 | 217.00 | 216.75 | 232.33 |
| 12 | 50.54 | 44.27 | 48.28 | 50.36 | 49.56 | 50.65 | 43.43 | 35.63 |
| 13 | 23.83 | 25.28 | 22.42 | 24.53 | 27.13 | 23.21 | 29.96 | 33.44 |
| 14 | 0.17 | 0.17 | 0.19 | 0.23 | 0.26 | 0.23 | 0.18 | 0.21 |
| 15 | 64.67 | 64.75 | 58.50 | 64.33 | 46.00 | 65.50 | 59.75 | 59.00 |
| 16 | 2.46 | 2.46 | 2.07 | 2.42 | 1.30 | 2.46 | 2.68 | 2.25 |
| 17 | 252.49 | 319.29 | 253.13 | 252.16 | 300.97 | 290.18 | 327.41 | 234.17 |
| 18 | 9.87 | 11.70 | 23.16 | 21.94 | 8.19 | 8.22 | 21.74 | 23.12 |
| 19 | 6.40 | 7.19 | 7.27 | 7.98 | 6.83 | 6.95 | 7.66 | 8.71 |
| 20 | 581.75 | 668.50 | 561.00 | 574.00 | 360.75 | 478.67 | 626.50 | 585.00 |

Table 163.

TABLE 164

Measured parameters in *B. juncea* varieties (lines 25-32)

| Ecotype/Treatment | Line-25 | Line-26 | Line-27 | Line-28 | Line-29 | Line-30 | Line-31 | Line-32 |
|---|---|---|---|---|---|---|---|---|
| 1 | 0.84 | 1.06 | 1.20 | 1.17 | 0.97 | 0.86 | 0.98 | 1.18 |
| 2 | 9.54 | 10.72 | 5.21 | 6.71 | 9.34 | 5.64 | 11.58 | 4.55 |
| 3 | 0.02 | 0.01 | 0.02 | 0.01 | 0.02 | 0.01 | 0.01 | 0.01 |
| 4 | 0.13 | 0.18 | 0.15 | 0.18 | 0.18 | 0.20 | 0.17 | 0.11 |
| 5 | 42.58 | 45.25 | 50.29 | 42.52 | 57.61 | 42.94 | 43.94 | 45.65 |
| 6 | 369.83 | 353.58 | 370.50 | 485.81 | 612.00 | 581.42 | 427.00 | 463.19 |
| 7 | 3.40 | 2.70 | 2.87 | 5.07 | 6.38 | 4.42 | 3.61 | 5.16 |
| 8 | 31.67 | 30.50 | 28.50 | 28.50 | 31.00 | 32.40 | 31.50 | 28.00 |
| 9 | 5.83 | 5.42 | 5.58 | 6.58 | 6.17 | 7.25 | 5.58 | 6.42 |
| 10 | 88.05 | 90.19 | 61.17 | 85.50 | 81.12 | 92.92 | 92.10 | 79.96 |
| 11 | 191.00 | 251.33 | 212.25 | 225.00 | 175.00 | 243.17 | 263.75 | 240.75 |
| 12 | 42.30 | 39.88 | 39.10 | 45.99 | 49.78 | 43.28 | 50.39 | 52.52 |
| 13 | 28.42 | 26.33 | 34.04 | 25.75 | 28.00 | 30.61 | 26.00 | 25.79 |
| 14 | 0.16 | 0.24 | 0.26 | 0.22 | 0.17 | 0.19 | 0.15 | 0.20 |
| 15 | 65.17 | 53.00 | 65.00 | 61.50 | 62.50 | 60.83 | 61.75 | 65.25 |
| 16 | 2.59 | 2.41 | 2.07 | 2.37 | 3.20 | 2.56 | 2.29 | 1.44 |
| 17 | 342.65 | 395.55 | 376.46 | 286.95 | 282.95 | 385.46 | 358.73 | 266.19 |
| 18 | 25.23 | 29.47 | 12.77 | 15.06 | 21.65 | 13.39 | 31.14 | 8.49 |

TABLE 164-continued

Measured parameters in *B. juncea* varieties (lines 25-32)

| Ecotype/Treatment | Line-25 | Line-26 | Line-27 | Line-28 | Line-29 | Line-30 | Line-31 | Line-32 |
|---|---|---|---|---|---|---|---|---|
| 19 | 7.56 | 7.61 | 6.43 | 6.79 | 8.22 | 7.83 | 6.96 | 6.83 |
| 20 | 542.67 | 703.50 | 479.50 | 564.00 | 580.00 | 671.00 | 628.25 | 378.75 |

Table 164.

TABLE 165

Measured parameters in *B. juncea* varieties (lines 33-41)

| Ecotype/Treatment | Line-33 | Line-34 | Line-35 | Line-36 | Line-37 | Line-38 | Line-39 | Line-40 | Line-41 |
|---|---|---|---|---|---|---|---|---|---|
| 1 | 1.22 | 1.33 | 0.74 | 0.93 | 1.08 | 0.99 | 0.98 | 1.27 | 0.65 |
| 2 | 7.74 | 6.36 | 6.52 | 8.42 | 14.27 | 6.45 | 9.53 | 12.55 | 9.49 |
| 3 | 0.01 | 0.01 | 0.03 | 0.02 | 0.02 | 0.01 | 0.02 | 0.01 | 0.03 |
| 4 | 0.17 | 0.19 | 0.10 | 0.20 | 0.18 | 0.18 | 0.16 | 0.15 | 0.18 |
| 5 | 44.76 | 48.54 | 49.81 | 45.60 | 46.22 | 47.89 | 34.23 | 48.13 | 51.75 |
| 6 | 416.58 | 373.00 | 893.81 | 480.42 | 608.42 | 513.71 | 698.83 | 724.92 | 819.58 |
| 7 | 4.63 | 4.14 | 9.35 | 2.93 | 5.65 | 4.56 | 4.05 | 8.97 | 6.50 |
| 8 | 27.50 | 27.50 | 31.00 | 33.00 | 33.00 | 32.50 | 34.00 | 30.50 | NA |
| 9 | 6.75 | 6.08 | 7.58 | 5.50 | 5.92 | 5.58 | 5.83 | 6.42 | 5.42 |
| 10 | 85.83 | 77.79 | 81.81 | 115.75 | 90.61 | 82.67 | 143.75 | 92.69 | 148.63 |
| 11 | 210.00 | 227.25 | 186.00 | 192.83 | 189.25 | 290.50 | 141.00 | 223.50 | 109.00 |
| 12 | 55.81 | 49.04 | 54.29 | 43.09 | 47.41 | 47.21 | 31.18 | 48.49 | 35.43 |
| 13 | 24.92 | 28.21 | 39.87 | 33.06 | 24.89 | 27.67 | 36.88 | 25.08 | 42.75 |
| 14 | 0.19 | 0.19 | 0.12 | 0.18 | 0.28 | 0.19 | 0.23 | 0.22 | 0.17 |
| 15 | 65.75 | 62.50 | 75.50 | 70.00 | 70.00 | 58.00 | 69.00 | 62.75 | NA |
| 16 | 2.24 | 2.51 | 2.30 | 3.61 | 3.18 | 1.81 | 4.01 | 2.02 | 4.93 |
| 17 | 261.49 | 261.55 | 291.77 | 512.56 | 317.47 | 323.08 | 353.77 | 242.76 | 370.04 |
| 18 | 18.59 | 14.93 | 10.22 | 22.34 | 37.15 | 14.81 | 24.55 | 28.69 | 21.96 |
| 19 | 6.27 | 7.30 | 8.93 | 8.43 | 7.43 | 7.49 | 11.17 | 7.36 | 9.45 |
| 20 | 493.00 | 601.25 | 438.75 | 747.17 | 661.00 | 550.25 | 487.25 | 483.25 | 570.50 |

Table 165.

TABLE 166

Correlation between the expression level of selected genes of some embodiments of the invention in various tissues and the phenotypic performance under normal conditions across *B. juncea* varieties

| Gene Name | R | P value | Exp. set | Corr. Set ID | Gene Name | R | P value | Exp. set | Corr. Set ID |
|---|---|---|---|---|---|---|---|---|---|
| LYD694 | 0.73 | 2.82E−04 | 1 | 17 | LYD694 | 0.73 | 2.70E−04 | 3 | 19 |
| LYD695 | 0.71 | 4.58E−04 | 1 | 17 | LYD695 | 0.72 | 2.58E−04 | 2 | 20 |
| LYD695 | 0.73 | 1.53E−04 | 2 | 17 | | | | | |

Table 166.

Example 21

Production of *B. Juncea* Transcriptome and High Throughput Correlation Analysis with Yield Parameters Using 60K *B. Juncea* Oligonucleotide Micro-Arrays In order to produce a high throughput correlation analysis, the present inventors utilized a *B. juncea* oligonucleotide micro-array, produced by Agilent Technologies [chem. (dot) agilent (dot) com/Scripts/PDS (dot) asp?1Page=50879]. The array oligonucleotide represents about 60,000 *B. juncea* genes and transcripts. In order to define correlations between the levels of RNA expression with yield components or vigor related parameters, various plant characteristics of 11 different *B. juncea* varieties were analyzed and used for RNA expression analysis. The correlation between the RNA levels and the characterized parameters was analyzed using Pearson correlation test.

Correlation of *B. juncea* Genes' Expression Levels with Phenotypic Characteristics Across Ecotype Experimental Procedures 11 *B. juncea* varieties were grown in three repetitive plots, in field. Briefly, the growing protocol was as follows: *B. juncea* seeds were sown in soil and grown under normal condition till harvest [field experiment, normal growth conditions which included irrigation 2-3 times a week with 861 $m^3$ water per dunam (1000 square meters) per entire growth period, and fertilization of 12 units of nitrogen given in the first month of the growth period]. In order to define correlations between the levels of RNA expression with yield components or vigor related parameters, the 11 different *B. juncea* varieties were analyzed and used for gene expression analyses.

TABLE 167

Tissues used for *B. juncea* transcriptome expression sets

| Description | Expression Set |
|---|---|
| Pod (R4-R5) under normal growth conditions | 1 |
| Flower at flowering stage under normal growth conditions | 2 |
| Pod (R4-R5) under normal growth conditions | 3 |
| Meristem at vegetative stage under normal growth conditions | 4 |
| Leaf at vegetative stage under normal growth conditions | 5 |

Table 167: Provided are the identification (ID) digits of each of the *B. juncea* expression sets.

RNA extraction—All 11 selected *B. juncea* varieties were sample per each treatment. Plant tissues [leaf, Pod, Lateral meristem and flower] growing under normal conditions were sampled and RNA was extracted as described above.

The collected data parameters were as follows:

Fresh weight (plot-harvest) [gr/plant]—total fresh weight per plot at harvest time normalized to the number of plants per plot.

Seed Weight [milligrams/plant]—total seeds from each plot was extracted, weighted and normalized for plant number in each plot.

Harvest index—The harvest index was calculated: seed weight/fresh weight.

Days till bolting/flowering—number of days till 50% bolting/flowering for each plot.

SPAD—Chlorophyll content was determined using a Minolta SPAD 502 chlorophyll meter and measurement was performed at time of flowering. SPAD meter readings were done on young fully developed leaf. Three measurements per leaf were taken for each plot.

Main branch-average node length—total length/total number of nods on main branch.

Lateral branch-average node length—total length/total number of nods on lateral branch.

Main branch-20th length—the length of the pod on the $20^{th}$ node from the apex of main branch.

Lateral branch-20th length—the length of the pod on the $20^{th}$ node from the apex of lateral branch.

Main branch-20th seed No.—number of seeds in the pod on the $20^{th}$ node from the apex of main branch.

Lateral branch-20th seed number—number of seeds in the pod on the $20^{th}$ node from the apex of lateral branch.

Number of lateral branches—total number of lateral branches, average of three plants per plot.

Main branch height [cm]—total length of main branch.

Min-lateral branch position—lowest node on the main branch that has developed lateral branch.

Max-lateral branch position [#node of main branch]—highest node on the main branch that has developed lateral branch.

Max-number of nodes in lateral branch—the highest number of node that a lateral branch had per plant.

Max length of lateral branch [cm]—the highest length of lateral branch per plant.

Max diameter of lateral branch [mm]—the highest base diameter that a lateral branch had per plant.

Oil Content—Indirect oil content analysis was carried out using Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)];

Fresh weight (single plant) (gr/plant)—average fresh weight of three plants per plot taken at the middle of the season.

Main branch base diameter [mm]—the based diameter of main branch, average of three plants per plot.

1000 Seeds [gr]—weight of 1000 seeds per plot.

Experimental Results

Eleven different *B. juncea* varieties were grown and characterized for 23 parameters as specified above and summarized in Table 168. The average for each of the measured parameters was calculated using the JMP software and values are summarized in Tables 169-170 below. Subsequent correlation analysis between the various transcriptome expression sets and the average parameters was conducted. Results were then integrated to the database (Table 171).

TABLE 168

Measured parameters in *B. juncea* accessions

| Correlated parameter with | Correlation ID |
|---|---|
| 1000 Seeds [gr.] | 1 |
| Days till bolting (days) | 2 |
| Days till flowering (days) | 3 |
| Fresh weight (plot-harvest) [gr./plant] | 4 |
| Fresh weight (single plant) [gr./plant] | 5 |
| Harvest index (ratio) | 6 |
| Lateral branch - 20th length (cm) | 7 |
| Lateral branch - 20th seed number (number) | 8 |
| Lateral branch - average node length (cm) | 9 |
| Main branch - 20th length (cm) | 10 |
| Main branch - 20th seed number (number) | 11 |
| Main branch - average node length (cm) | 12 |
| Main branch base diameter [mm] | 13 |
| Main branch height [cm] | 14 |
| Max-Diameter of lateral branch [mm] | 15 |
| Max-Lateral branch position [# node of main branch] | 16 |
| Max-Length of lateral branch [cm] | 17 |
| Max-Number of nodes in lateral branch (number) | 18 |
| Min-Lateral branch position (#node of main branch) | 19 |
| Number of lateral branches (number) | 20 |
| Oil content (mg) | 21 |
| SPAD | 22 |
| Seed weight per plant (gr.) | 23 |

Table 168. Provided are the *B. juncea* correlated parameters. "gr." = grams; mm = millimeters; "cm" = centimeters; "mg" = milligrams; "SPAD" = chlorophyll levels; "#" = number.

TABLE 169

Measured parameters in B. juncea accessions (lines 1-6)

| Ecotype/Treatment | Line-1 | Line-2 | Line-3 | Line-4 | Line-5 | Line-6 |
|---|---|---|---|---|---|---|
| 1 | 3.76 | 2.21 | 3.26 | 2.36 | 2.00 | 3.12 |
| 2 | 57.33 | 60.33 | 59.67 | 56.33 | 55.00 | 46.67 |
| 3 | 66.00 | 69.67 | 69.33 | 66.00 | 61.33 | 53.00 |
| 4 | 69.24 | 45.22 | 39.27 | 49.11 | 43.95 | 46.42 |
| 5 | 197.78 | 142.22 | 147.22 | 243.33 | 192.33 | 163.78 |
| 6 | 0.00006 | 0.00013 | 0.00014 | 0.00014 | 0.00013 | 0.00014 |
| 7 | 4.32 | 3.69 | 4.14 | 3.37 | 3.06 | 3.96 |
| 8 | 13.00 | 14.00 | 13.22 | 13.44 | 11.00 | 13.11 |
| 9 | 0.65 | 0.43 | 0.74 | 0.57 | 0.56 | 0.79 |
| 10 | 4.28 | 3.72 | 3.62 | 3.50 | 2.74 | 5.20 |
| 11 | 13.22 | 13.67 | 10.44 | 14.11 | 9.78 | 15.22 |
| 12 | 0.48 | 0.41 | 0.63 | 0.43 | 0.38 | 0.68 |
| 13 | 14.53 | 11.99 | 19.91 | 14.32 | 12.59 | 12.30 |
| 14 | 140.72 | 125.22 | 112.44 | 133.39 | 142.00 | 101.50 |
| 15 | 4.20 | 4.85 | 4.34 | 5.74 | 5.87 | 5.68 |
| 16 | 15.22 | 14.89 | 13.56 | 14.89 | 14.00 | 10.89 |
| 17 | 40.44 | 47.22 | 41.61 | 60.50 | 59.78 | 59.44 |
| 18 | 5.22 | 7.00 | 5.22 | 7.00 | 6.56 | 9.44 |
| 19 | 6.78 | 6.33 | 5.56 | 3.67 | 3.00 | 3.11 |
| 20 | 15.22 | 14.89 | 13.56 | 14.89 | 14.00 | 9.78 |
| 21 | 40.19 | 40.71 | 40.91 | 38.57 | 40.14 | 42.63 |
| 22 | 33.02 | 30.01 | 32.83 | 37.53 | 41.44 | 35.41 |
| 23 | 0.00438 | 0.00572 | 0.00553 | 0.00687 | 0.00581 | 0.00628 |

Table 169.

TABLE 170

Measured parameters in B. juncea accessions (lines 7-11)

| Ecotype/Treatment | Line-7 | Line-8 | Line-9 | Line-10 | Line-11 |
|---|---|---|---|---|---|
| 1 | 3.34 | 3.09 | 3.39 | 3.40 | 2.39 |
| 2 | 59.00 | 54.33 | 59.67 | 57.33 | 53.00 |
| 3 | 69.67 | 63.67 | 69.67 | 71.00 | 58.33 |
| 4 | 36.14 | 32.58 | 33.16 | 63.23 | 60.94 |
| 5 | 164.44 | 181.11 | 176.22 | 217.89 | 261.11 |
| 6 | 0.00013 | 0.00013 | 0.00014 | 0.00009 | 0.00012 |
| 7 | 4.33 | 4.21 | 4.14 | 4.04 | 3.88 |
| 8 | 11.89 | 13.44 | 11.22 | 13.22 | 14.00 |
| 9 | 0.57 | 0.76 | 0.96 | 0.78 | 0.90 |
| 10 | 3.91 | 3.98 | 3.46 | 3.73 | 4.04 |
| 11 | 12.00 | 12.67 | 9.89 | 11.56 | 15.56 |
| 12 | 0.40 | 0.63 | 0.57 | 0.59 | 1.55 |
| 13 | 12.60 | 12.91 | 12.56 | 13.77 | 13.56 |
| 14 | 145.39 | 131.56 | 129.89 | 131.56 | 116.44 |
| 15 | 4.52 | 4.89 | 4.68 | 5.56 | 5.49 |
| 16 | 16.44 | 14.33 | 14.56 | 14.11 | 16.78 |
| 17 | 47.28 | 47.33 | 44.67 | 58.67 | 47.17 |
| 18 | 6.11 | 5.22 | 5.67 | 6.56 | 6.00 |
| 19 | 7.78 | 6.22 | 5.56 | 4.89 | 5.33 |
| 20 | 16.44 | 14.33 | 14.56 | 14.11 | 16.78 |
| 21 | 41.34 | 40.82 | 40.82 | 38.14 | 37.21 |
| 22 | 33.17 | 32.87 | 34.80 | 31.82 | 41.49 |
| 23 | 0.00458 | 0.00437 | 0.00448 | 0.00566 | 0.00706 |

Table 170: Provided are the values of each of the parameters (as described above) measured in B. juncea accessions (Seed ID) under normal conditions.

TABLE 171

Correlation between the expression level of selected genes of some embodiments of the invention in various tissues and the phenotypic performance under normal or normal conditions across B. Juncea accessions

| Gene Name | R | P value | Exp. set | Corr. Set ID | Gene Name | R | P value | Exp. set | Corr. Set ID |
|---|---|---|---|---|---|---|---|---|---|
| LGP19 | 0.72 | 2.85E−02 | 4 | 4 | LGP19 | 0.74 | 9.33E−02 | 2 | 9 |
| LGP19 | 0.76 | 6.77E−03 | 1 | 9 | LGP45 | 0.76 | 7.92E−02 | 2 | 15 |
| LGP45 | 0.75 | 8.72E−02 | 2 | 5 | LGP45 | 0.87 | 2.55E−02 | 2 | 23 |
| LGP45 | 0.86 | 2.68E−02 | 2 | 4 | LYD694 | 0.72 | 2.83E−02 | 4 | 5 |
| LYD694 | 0.73 | 2.56E−02 | 4 | 4 | LYD694 | 0.73 | 1.01E−01 | 2 | 4 |
| LYD694 | 0.70 | 2.33E−02 | 5 | 1 | LYD694 | 0.72 | 1.21E−02 | 1 | 12 |
| LYD695 | 0.95 | 4.06E−03 | 2 | 22 | LYD696 | 0.96 | 8.60E−03 | 1 | 9 |
| LYD696 | 0.97 | 7.40E−03 | 1 | 12 | | | | | |

Table 171. Provided are the correlations (R) between the expression levels of yield improving genes and their homologues in tissues [Leaves, meristem, flower and pods; Expression sets (Exp)] and the phenotypic performance in various yield, biomass, growth rate and/or vigor components [Correlation vector (corr.)] under stress conditions or normal conditions across B, juncea accessions. P = p value.

Example 22

Gene Cloning and Generation of Binary Vectors for Plant Expression

To validate their role in improving yield, selected genes were over-expressed in plants, as follows.

Cloning Strategy

Selected genes from those presented in Examples 1-21 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Usually, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested/undigested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase is needed.

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc) and the NOS terminator (SEQ ID NO: 15762) via digestion with appropriate restriction endonucleases.

Figure 9A:
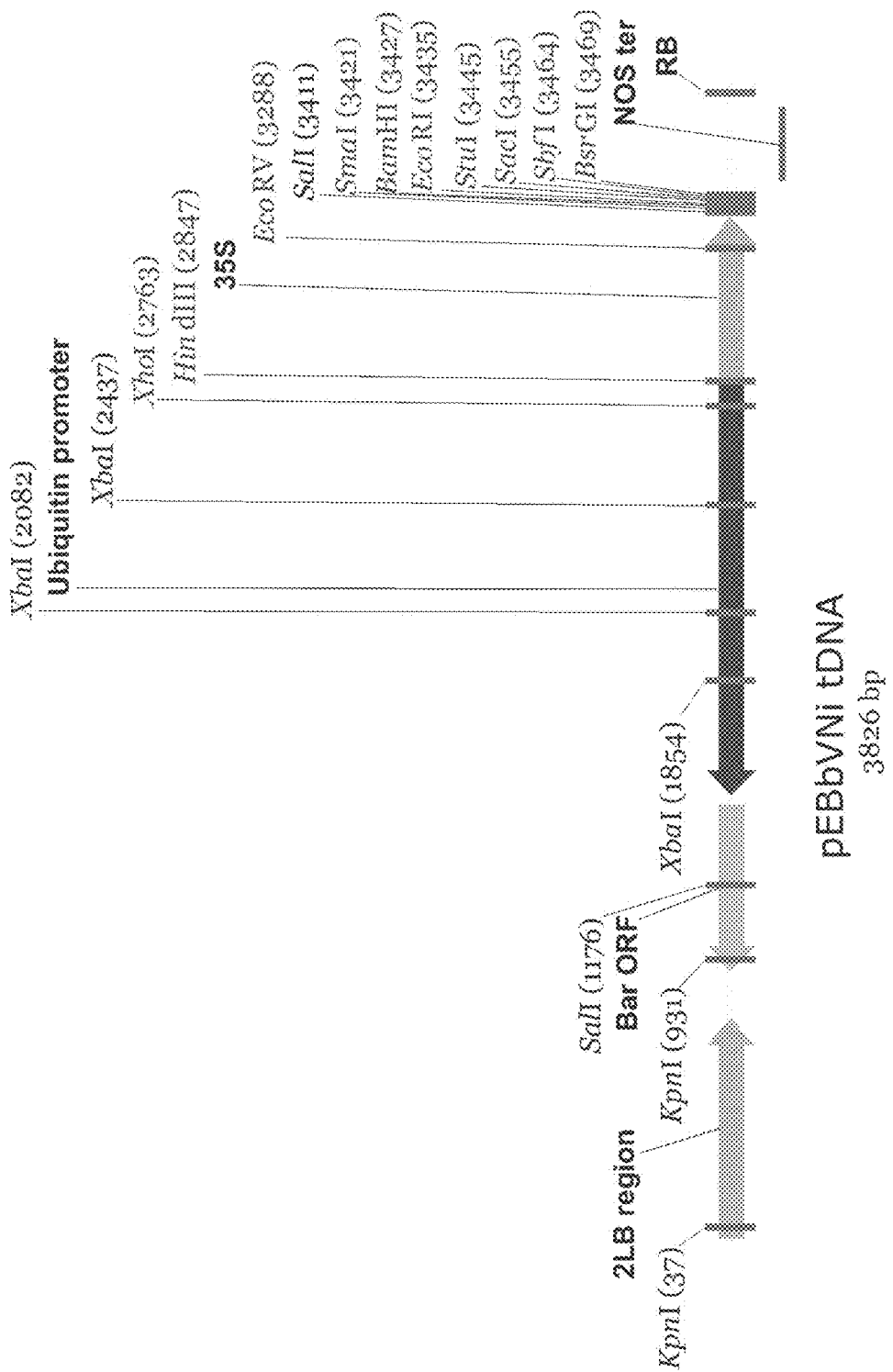
FIGS. 9A-B are schematic illustrations of the pEBbVNi tDNA (FIG. 9A) and the pEBbNi tDNA (FIG. 9B) plasmids used in the *Brachypodium* experiments. pEBbVNi tDNA (FIG. 9A) was used for expression of the isolated polynucleotide sequences of some embodiments of the invention in *Brachypodium*. pEBbNi tDNA (FIG. 9B) was used for transformation into *Brachypodium* as a negative control. "RB"=right border; "2LBregion"=2 repeats of left border; "35S"=35S promoter (SEQ ID NO: 15763); "NOS ter"=nopaline synthase terminator; "Bar ORF"—BAR open reading frame (GenBank Accession No. JQ293091.1; SEQ ID NO: 15764); The isolated polynucleotide sequences of some embodiments of the invention were cloned into the Multiple cloning site of the vector using one or more of the indicated restriction enzyme sites.
Figure 9B:
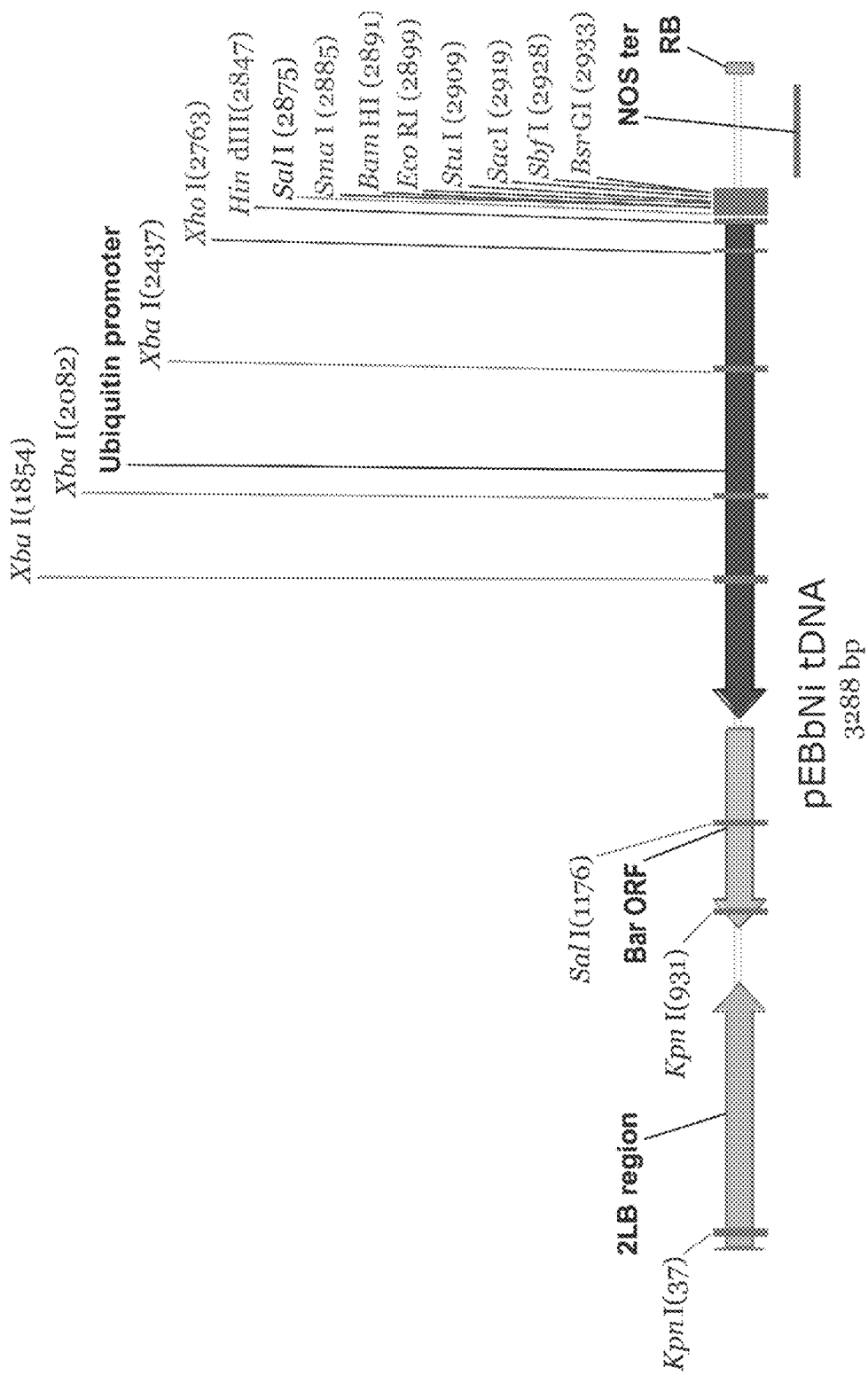

In case of *Brachypodium* transformation, after confirming the sequences of the cloned genes, the cloned cDNAs were introduced into pEBbVNi (FIG. 9A) containing 35S promoter (SEQ ID NO: 15763) and the NOS terminator (SEQ ID NO: 15762) via digestion with appropriate restriction endonucleases. The genes were cloned downstream to the 35S promoter and upstream to the NOS terminator.

Several DNA sequences of the selected genes were synthesized by GeneArt (Life Technologies, Grand Island, N.Y., USA). Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQYN_6669, pQNa_RP, pQFYN or pQXNc) is a modified version of the pGI vector in which the cassette is inverted between the left and right borders so the gene and its corresponding promoter are close to the right border and the NPTII gene is close to the left border.

At6669, the new *Arabidopsis thaliana* promoter sequence (SEQ ID NO: 15751) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

pEBbVNi (FIG. 9A) is a modified version of pJJ2LB in which the Hygromycin resistance gene was replaced with the BAR gene which confers resistance to the BASTA herbicide [BAR gene coding sequence is provided in GenBank Accession No. JQ293091.1 (SEQ ID NO: 15764); further description is provided in Akama K, et al. "*Efficient Agrobacterium-mediated transformation of Arabidopsis thaliana using the bar gene as selectable marker*", Plant Cell Rep. 1995, 14(7):450-4; Christiansen P, et al. "*A rapid and efficient transformation protocol for the grass Brachypodium distachyon*", Plant Cell Rep. 2005 March; 23(10-11): 751-8. Epub 2004 Oct. 19; and Păcurar D I, et al. "*A high-throughput Agrobacterium-mediated transformation system for the grass model species Brachypodium distachyon L*", Transgenic Res. 2008 17(5):965-75; each of which is fully incorporated herein by reference in its entirety]. The pEBbVNi construct contains the 35S promoter (SEQ ID NO: 15763). pJJ2LB is a modified version of pCambia0305.2 (Cambia).

In case genomic DNA was cloned, the genes were amplified by direct PCR on genomic DNA extracted from leaf tissue using the DNAeasy kit (Qiagen Cat. No. 69104).

Selected genes cloned by the present inventors are provided in Table 172 below.

TABLE 172

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LGP1 | pUCsFN_LGP1 | ARABIDOPSIS Arabidopsis thalia | 16135, 15859, 16114, 15809 | 395 | 713 |
| LGP10 | pUCsFN_LGP10 | ARABIDOPSIS Arabidopsis thalia | 16027, 15820, 16040, 15855 | 400 | 718 |
| LGP100 | pMA_LGP100_GA | | | 466 | 786 |
| LGP101 | pUC19c_LGP101 | RICE Oryza sativa L. | 15800, 16288, 16466, 16204 | 467 | 787 |
| LGP102 | pMK_LGP102_GA | | | 468 | 788 |
| LGP103 | pUC19c_LGP103 | SORGHUM Sorghum bicolor | 16051, 16215, 16072, 16335 | 469 | 1090 |
| LGP104 | pQFNc_LGP104 | SOYBEAN Glycine max | 16015, 15832, 16181, 15858 | 470 | 790 |
| LGP105 | pUC19c_LGP105 | SOYBEAN Glycine max | 16001, 16334, 16001, 16334 | 471 | 791 |
| LGP106 | TopoB_LGP106 | SOYBEAN Glycine max | 16139, 15853, 16073, 15849 | 472 | 792 |
| LGP107 | pMA-RQ_LGP107_GA | | | 473 | 793 |
| LGP108 | pUC19_LGP108 | WHEAT Triticum aestivum L. | 16424, 15895, 16424, 15895 | 474 | 1091 |
| LGP109 | pUC19c_LGP109 | SOYBEAN Glycine max | 16003, 15802, 16034, 15846 | 475 | 1092 |
| LGP12 | pUCsFN_LGP12 | ARABIDOPSIS Arabidopsis thalia | 15969, 15810, 15945, 16472 | 401 | 719 |
| LGP18 | pUC57_LGP18_GA | | | 402 | 720 |
| LGP19 | pUCsFN_LGP19 | MUSTARD Brassica juncea | 15861, 15911, 15861, 15907 | 403 | 1067 |
| LGP20 | pUCsFN_LGP20 | BARLEY Hordeum vulgare L. | 16058, 16471, 16058, 16469 | 404 | 1068 |
| LGP21 | pUCsFN_LGP21 | BARLEY Hordeum vulgare L. | 16375, 16477, 16383, 15932 | 405 | 723 |
| LGP22 | pUCsFN_LGP22 | BARLEY Hordeum vulgare L. | 15836, 15864, 15836, 15864 | 406 | 724 |
| LGP24 | pUC19c_LGP24 | lettuce | 16173, 16308, 15934, 16242 | 407 | 725 |
| LGP25 | pUCsFN_LGP25 | MAIZE Zea mays L. | 16037, 16470, 15963, 15860 | 408 | 1069 |
| LGP27 | pUC19c_LGP27 | MAIZE Zea mays L. | 16024, 16219, 15982, 16189 | 409 | 1070 |
| LGP3 | pUCsFN_LGP3 | ARABIDOPSIS Arabidopsis thalia | 16410, 16172, 16410, 16172 | 396 | 714 |
| LGP32 | pUCsFN_LGP32 | TOMATO Lycopersicum esculentum | 16153, 15818, 15961, 15814 | 410 | 728 |
| LGP34 | pUCsFN_LGP34 | TOMATO Lycopersicum esculentum | 15960, 15869, 16099, 15869 | 411 | 729 |
| LGP35 | pUC19c_LGP35 | TOMATO Lycopersicum esculentum | 16079, 16225, 16081, 16318 | 412 | 1071 |
| LGP38 | pUC57_LGP38_GA | | | 413 | 731 |
| LGP39 | pUC57_LGP39_GA | | | 414 | 732 |
| LGP41 | pUC57_LGP41_GA | | | 415 | 733 |
| LGP42 | pUC19c_LGP42 | TOMATO Lycopersicum esculentum | 16120, 16196, 15940, 16247 | 416 | 1072 |
| LGP43 | pUCsFN_LGP43 | CANOLA Brassica napus | 16409, 16029, 16409, 16029 | 417 | 735 |
| LGP44 | pUCsFN_LGP44 | ARABIDOPSIS Arabidopsis thalia | 16025, 15829, 15953, 15823 | 418 | 736 |
| LGP45 | pUCsFN_LGP45 | MUSTARD Brassica juncea | 16076, 15826, 15996, 15804 | 419 | 737 |
| LGP46 | pUCsFN_LGP46 | ARABIDOPSIS Arabidopsis thalia | 16394, 15918, 16456, 15924 | 420 | 738 |
| LGP47 | pUCsFN_LGP47 | COTTON Gossypium hirsutum | 16036, 16467, 16125, 16473 | 421 | 1073 |
| LGP48 | pUCsFN_LGP48 | CANOLA Brassica napus | 15933, 16344, 16151, 16344 | 422 | 1074 |
| LGP49 | pUCsFN_LGP49 | CANOLA Brassica napus | 16448, 15783, 16448, 15769 | 423 | 741 |
| LGP52 | pUCsFN_LGP52 | SORGHUM Sorghum bicolor | 16454, 15885, 16441, 15904 | 424 | 742 |
| LGP53 | pUCsFN_LGP53 | ARABIDOPSIS Arabidopsis thalia | 15946, 15828, 16134, 15850 | 425 | 743 |
| LGP54 | pUCsFN_LGP54 | CANOLA Brassica napus | 16046, 16217, 16048, 16202 | 426 | 744 |
| LGP58 | pUCsFN_LGP58 | COTTON Gossypium hirsutum | 16170, 15831, 16170, 15831 | 427 | 1075 |
| LGP59 | pMA-RQ_LGP59_GA | | | 428 | 746 |
| LGP6 | pUCsFN_LGP6 | ARABIDOPSIS Arabidopsis thalia | 15942, 15837, 16096, 16474 | 397 | 715 |
| LGP60 | pMA_LGP60_GA | | | 429 | 747 |
| LGP61 | pMA-RQ_LGP61_GA | | | 430 | 748 |
| LGP62 | pMA-RQ_LGP62_GA | | | 431 | 749 |
| LGP63 | pMS-RQ_LGP63_GA | | | 432 | 750 |
| LGP64 | pMA-RQ_LGP64_GA | | | 433 | 751 |
| LGP65 | pUC19c_LGP65 | COTTON Gossypium hirsutum | 16451, 15884, 16402, 15906 | 434 | 752 |
| LGP66 | pQFNc_LGP66 | PHYSCOMITRELLA Physcomitrella | 16427, 15916, 16427, 15916 | 435 | 1076 |
| LGP67 | pQFNc_LGP67 | CANOLA Brassica napus | 16019, 16188, 16019, 16193 | 436 | 1077 |
| LGP68 | pMA-RQ_LGP68_GA | | | 437 | 755 |
| LGP69 | pUC19c_LGP69 | CANOLA Brassica napus | 15970, 16227, 16086, 16261 | 438 | 1078 |
| LGP71 | pUCsFN_LGP71 | Phaseolus vulgaris | 16137, 16294, 16108, 16236 | 439 | 757 |
| LGP72 | TopoB_LGP72 | MAIZE Zea mays L. | 16435, 15791, 16423, 16482 | 440 | 1079 |
| LGP73 | pMA-T_LGP73_GA | | | 441 | 759 |
| LGP74 | pMA-T_LGP74_GA | | | 442 | 760 |
| LGP75 | pUCsFN_LGP75 | MAIZE Zea mays L. | 16390, 15768, 16398, 15766 | 443 | 761 |
| LGP76 | pUCsFN_LGP76 | RICE Oryza sativa L. | 16087, 15803, 16087, 15803 | 444 | 762 |
| LGP77 | pMA-T_LGP77_GA | | | 445 | 763 |
| LGP78 | pUCsFN_LGP78 | SOYBEAN Glycine max | 15993, 15812, 16016, 15844 | 446 | 764 |
| LGP79 | pUCsFN_LGP79 | SOYBEAN Glycine max | 16160, 15808, 16100, 15841 | 447 | 1080 |
| LGP8 | pUCsFN_LGP8 | ARABIDOPSIS Arabidopsis thalia | 15956, 15835, 16056, 15857 | 398 | 716 |
| LGP80 | pUCsFN_LGP80 | MAIZE Zea mays L. | 16376, 15784, 16376, 15784 | 448 | 1081 |
| LGP81 | pUCsFN_LGP81 | SOYBEAN Glycine max | 16436, 15771, 16420, 15790 | 449 | 767 |
| LGP82 | pUCsFN_LGP82 | MAIZE Zea mays L. | 15821, 15865, 15807, 15880 | 450 | 768 |
| LGP83 | pUC19c_LGP83 | BARLEY Hordeum vulgare L. | 16021, 15840, 16021, 15822 | 451 | 769 |
| LGP84 | pQFNc_LGP84 | Phaseolus vulgaris | 16411, 15775, 16411, 15775 | 452 | 1082 |
| LGP85 | pUC19c_LGP85 | Phaseolus vulgaris | 16460, 16462, 16461, 16462 | 453 | 1083 |
| LGP86 | pMA-RQ_LGP86_GA | | | 454 | 772 |
| LGP87 | pQFNc_LGP87 | MAIZE Zea mays L. | 16430, 16476, 16452, 15923 | 455 | 773 |
| LGP88 | pQFNc_LGP88 | MAIZE Zea mays L. | 15917, 15897, 15917, 15897 | 456 | 1084 |
| LGP89 | pQFNc_LGP89 | MAIZE Zea mays L. | 16085, 16468, 16085, 16468 | 457 | 1085 |
| LGP9 | pUCsFN_LGP9 | ARABIDOPSIS Arabidopsis thalia | 15862, 15796, 15847, 16464 | 399 | 717 |
| LGP90 | pUC19c_LGP90 | MAIZE Zea mays L. | 16379, 15874, 16379, 15874 | 458 | 1086 |

TABLE 172-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LGP91 | pQFNc_LGP91 | MAIZE Zea mays L. | 16127, 16481, 16011, 16483 | 459 | 1087 |
| LGP94 | pUC19c_LGP94 | MAIZE Zea mays L. | 16006, 15851, 16109, 15830 | 460 | 780 |
| LGP95 | pMA_LGP95_GA | | | 461 | 781 |
| LGP96 | pUC19c_LGP96 | Medicago | 15972, 16304, 16078, 16304 | 462 | 1088 |
| LGP97 | pMA_LGP97_GA | | | 463 | 783 |
| LGP98 | pMA_LGP98_GA | | | 464 | 784 |
| LGP99 | pUC19c_LGP99 | RICE Oryza sativa L. | 16111, 15845, 16004, 15815 | 465 | 1089 |
| LYD237 | pMA-RQ_MGP14_GA | | | 477 | 797 |
| LYD694 | pMA-T_LYD694_GA | | | 489 | 809 |
| LYD695 | pUC19c_LYD695 | Brassica Juncea | 15935, 16201, 15935, 16201 | 490 | 810 |
| LYD696 | pQFNc_LYD696 | Brassica Juncea | 16084, 16325, 16084, 16325 | 491 | 1094 |
| LYD698 | pMA-T_LYD698_GA | | | 492 | 812 |
| LYD699 | pMA-T_LYD699_GA | | | 493 | 813 |
| LYD700 | pMA-T_LYD700_GA | | | 494 | 814 |
| LYD701 | pQFNc_LYD701 | Phaseolus vulgaris | 16028, 16191 | 495 | 815 |
| LYD702 | pUC19_LYD702 | Phaseolus vulgaris | 16103, 16220 | 496 | 816 |
| LYD703 | pMA-T_LYD703_GA | | | 497 | 817 |
| LYD704 | pUC19c_LYD704 | Phaseolus vulgaris | 16150, 16327, 16069, 16298 | 498 | 818 |
| LYD705 | pQFNc_LYD705 | Phaseolus vulgaris | 16032, 16289 | 499 | 819 |
| LYD706 | pUC19_LYD706 | Phaseolus vulgaris | 15801, 15834, 15798, 15816 | 500 | 1095 |
| LYD707 | pQFNc_LYD707 | Phaseolus vulgaris | 15848, 15795, 15819, 16465 | 501 | 821 |
| LYD708 | pQFNc_LYD708 | Phaseolus vulgaris | 16131, 16246, 16131, 16246 | 502 | 822 |
| LYD710 | pMA-T_LYD710_GA | | | 503 | 823 |
| LYD711 | pQFNc_LYD711 | Phaseolus vulgaris | 16414, 15973, 16385, 16063 | 504 | 1096 |
| LYD713 | pUC19c_LYD713 | Phaseolus vulgaris | 16133, 16186, 15977, 16312 | 505 | 825 |
| LYD714 | pQFNc_LYD714 | Phaseolus vulgaris | 16162, 16319, 16039, 16322 | 506 | 826 |
| LYD715 | pMA-T_LYD715_GA | | | 507 | 827 |
| LYD717 | pQFNc_LYD717 | Phaseolus vulgaris | 16026, 16258, 16026, 16258 | 508 | 828 |
| LYD718 | pUC19c_LYD718 | Phaseolus vulgaris | 16023, 16205, 16121, 16210 | 509 | 1097 |
| LYD719 | pQFNc_LYD719 | Phaseolus vulgaris | 15928, 16292, 15928, 16303 | 510 | 830 |
| LYD720 | pQFNc_LYD720 | Phaseolus vulgaris | 16372, 15908 | 511 | 831 |
| LYD721 | pQFNc_LYD721 | Phaseolus vulgaris | 15817, 15793, 15817, 15793 | 512 | 1098 |
| LYD722 | pQFNc_LYD722 | Phaseolus vulgaris | 16388, 16145, 16412, 16145 | 513 | 1099 |
| LYD723 | pQFNc_LYD723 | Phaseolus vulgaris | 15990, 15909, 15990, 15909 | 514 | 834 |
| LYD725 | pQFNc_LYD725 | Phaseolus vulgaris | 16075, 16300 | 515 | 1100 |
| LYD726 | pMA-T_LYD726_GA | | | 516 | 836 |
| LYD727 | pUC19c_LYD727 | Phaseolus vulgaris | 16035, 16207, 15980, 16293 | 517 | 837 |
| LYD729 | pMA-T_LYD729_GA | | | 518 | 838 |
| LYD730 | pUC19c_LYD730 | Phaseolus vulgaris | 16399, 15875, 16450, 15867 | 519 | 839 |
| LYD731 | pQFNc_LYD731 | Phaseolus vulgaris | 15978, 16321, 16148, 16341 | 520 | 840 |
| LYD733 | pQFNc_LYD733 | Phaseolus vulgaris | 16419, 15899 | 521 | 841 |
| LYD735 | pMA-T_LYD735_GA | | | 522 | 842 |
| LYD737 | pQFNc_LYD737 | Phaseolus vulgaris | 16429, 15892, 16429, 15892 | 523 | 844 |
| LYD738 | pQFNc_LYD738 | Phaseolus vulgaris | 16140, 16342, 16060, 16198 | 524 | 1101 |
| LYD739 | pQFNc_LYD739 | Phaseolus vulgaris | 16130, 16281, 16118, 16276 | 525 | 846 |
| LYD740 | pQFNc_LYD740 | Phaseolus vulgaris | 16431, 15903, 16443, 15890 | 526 | 847 |
| LYD741 | TopoB_LYD741 | Phaseolus vulgaris | 16045, 16309, 16045, 16309 | 527 | 848 |
| LYD742 | pQFNc_LYD742 | Phaseolus vulgaris | 15984, 16199, 16128, 16317 | 528 | 1102 |
| LYD744 | pUC19_LYD744 | Phaseolus vulgaris | 15805, 15913, 15813, 15913 | 529 | 1103 |
| LYD745 | pMA-T_LYD745_GA | | | 530 | 851 |
| LYD746 | pMA-T_LYD746_GA | | | 531 | 852 |
| LYD747 | pMA_LYD747_GA | | | 532 | 853 |
| LYD748 | pQFNc_LYD748 | Phaseolus vulgaris | 16062, 16274, 15950, 16234 | 533 | 1104 |
| LYD749 | pMA-T_LYD749_GA | | | 534 | 855 |
| LYD750 | pQFNc_LYD750 | Phaseolus vulgaris | 16152, 16184, 15966, 16347 | 535 | 856 |
| LYD751 | pQFNc_LYD751 | Phaseolus vulgaris | 16449, 16052, 16433, 16050 | 536 | 857 |
| LYD752 | TopoB_LYD752 | Phaseolus vulgaris | 16439, 15866 | 537 | 858 |
| LYD753 | pUC19c_LYD753 | Phaseolus vulgaris | 15986, 16356, 16053, 16345 | 538 | 1105 |
| LYD754 | pQFNc_LYD754 | Phaseolus vulgaris | 16041, 16187, 15958, 16229 | 539 | 860 |
| LYD755 | pQFNc_LYD755 | Phaseolus vulgaris | 15926, 16248, 16174, 16223 | 540 | 861 |
| LYD756 | pQFNc_LYD756 | Phaseolus vulgaris | 16090, 16297, 16093, 16299 | 541 | 862 |
| LYD757 | pQFNc_LYD757 | Phaseolus vulgaris | 16168, 16240, 15955, 16363 | 542 | 863 |
| LYD758 | pUC19c_LYD758 | Phaseolus vulgaris | 16407, 15773, 16407, 15773 | 543 | 1106 |
| LYD760 | pQFNc_LYD760 | Phaseolus vulgaris | 16095, 16251, 16095, 16365 | 544 | 1107 |
| LYD761 | pQFNc_LYD761 | Phaseolus vulgaris | 16180, 16316 | 545 | 866 |
| LYD762 | pUC19c_LYD762 | Phaseolus vulgaris | 16013, 16306, 15974, 16296 | 546 | 867 |
| LYD763 | pUC19c_LYD763 | Phaseolus vulgaris | 15929, 16185, 16147, 16249 | 547 | 1108 |
| LYD764 | pQFNc_LYD764 | Phaseolus vulgaris | 16403, 15898, 16422, 15887 | 548 | 1109 |
| LYD765 | pUC19_LYD765 | Phaseolus vulgaris | 16382, 15787, 16386, 15788 | 549 | 1110 |
| LYD767 | pQFNc_LYD767 | Phaseolus vulgaris | 16070, 16228, 16124, 16282 | 550 | 871 |
| LYD768 | pUC19_LYD768 | Phaseolus vulgaris | 16123, 16357, 16123, 16357 | 551 | 1111 |
| LYD769 | pMA-T_LYD769_GA | | | 552 | 873 |
| LYD771 | pUC19c_LYD771 | Phaseolus vulgaris | 16179, 16305, 15927, 16311 | 553 | 1112 |
| LYD772 | pQFNc_LYD772 | Phaseolus vulgaris | 16017, 16230, 16017, 16218 | 554 | 1113 |
| LYD773 | pMA-T_LYD773_GA | | | 555 | 876 |

TABLE 172-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LYD774 | pQFNc_LYD774 | Phaseolus vulgaris | 16175, 16280, 16110, 16266 | 556 | 877 |
| LYD776 | pQFNc_LYD776 | Phaseolus vulgaris | 16038, 16367, 16155, 16244 | 557 | 878 |
| LYD777 | pQFNc_LYD777 | Phaseolus vulgaris | 16098, 16337, 16122, 16192 | 558 | 879 |
| LYD778 | TopoB_LYD778 | Phaseolus vulgaris | 16054, 16206, 15983, 16232 | 559 | 1114 |
| LYD779 | pQFNc_LYD779 | Phaseolus vulgaris | 15827, 15777, 15827, 15770 | 560 | 1115 |
| LYD780 | pUC19_LYD780 | Phaseolus vulgaris | 15994, 16253, 16158, 16364 | 561 | 882 |
| LYD781 | pQFNc_LYD781 | Phaseolus vulgaris | 16101, 16290, 16101, 16268 | 562 | 1116 |
| LYD782 | pQFNc_LYD782 | Phaseolus vulgaris | 16178, 16352, 16163, 16336 | 563 | 1117 |
| LYD783 | pMA_LYD783_GA | | | 564 | 885 |
| LYD784 | pMK-T_LYD784_GA | | | 565 | 886 |
| LYD785 | TopoB_LYD785 | Phaseolus vulgaris | 16154, 16286, 15998, 16353 | 566 | 887 |
| LYD786 | pUC19_LYD786 | Phaseolus vulgaris | 15981, 16348 | 567 | 888 |
| LYD788 | pUC19c_LYD788 | Phaseolus vulgaris | 16373, 15871, 16373, 15882 | 568 | 889 |
| LYD789 | pMA-T_LYD789_GA | | | 569 | 890 |
| LYD790 | pQFNc_LYD790 | Phaseolus vulgaris | 16043, 16275, 15991, 16275 | 570 | 1118 |
| LYD791 | TopoB_LYD791 | Phaseolus vulgaris | 16018, 16273, 16042, 16260 | 571 | 892 |
| LYD792 | pUC19c_LYD792 | Phaseolus vulgaris | 16445, 15778, 16444, 15794 | 572 | 1119 |
| LYD793 | pQFNc_LYD793 | Phaseolus vulgaris | 16459, 15792, 16459, 15782 | 573 | 1120 |
| LYD794 | pQFNc_LYD794 | Phaseolus vulgaris | 16057, 16264, 16057, 16264 | 574 | 895 |
| LYD795 | pUC19_LYD795 | Phaseolus vulgaris | 16171, 16287, 16119, 16257 | 575 | 896 |
| LYD796 | pUC19c_LYD796 | Phaseolus vulgaris | 16141, 16233, 16141, 16233 | 576 | 897 |
| LYD798 | pQFNc_LYD798 | Phaseolus vulgaris | 16377, 15954, 16393, 16055 | 577 | 1121 |
| LYD799 | pQFNc_LYD799 | Phaseolus vulgaris | 16446, 15919, 16446, 15919 | 578 | 1122 |
| LYD800 | pUC19c_LYD800 | Phaseolus vulgaris | 16049, 16320, 16177, 16320 | 579 | 901 |
| LYD801 | pQFNc_LYD801 | Phaseolus vulgaris | 15987, 16241, 15999, 16241 | 580 | 902 |
| LYD802 | TopoB_LYD802 | Phaseolus vulgaris | 16405, 16020 | 581 | 903 |
| LYD803 | pQFNc_LYD803 | Phaseolus vulgaris | 16067, 16328, 16102, 16208 | 582 | 904 |
| LYD804 | pMA-T_LYD804_GA | | | 583 | 905 |
| LYD806 | pUC19c_LYD806 | Phaseolus vulgaris | 16432, 16088, 16401, 15967 | 584 | 1123 |
| LYD807 | pQFNc_LYD807 | Phaseolus vulgaris | 16392, 15863, 16371, 15881 | 585 | 1124 |
| LYD809 | pQFNc_LYD809 | Phaseolus vulgaris | 16077, 16332, 16161, 16235 | 586 | 908 |
| LYD810 | pUC19_LYD810 | Phaseolus vulgaris | 16009, 16255 | 587 | 1125 |
| LYD811 | pQFNc_LYD811 | Phaseolus vulgaris | 15997, 16350 | 588 | 1126 |
| LYD812 | pUC19c_LYD812 | Phaseolus vulgaris | 15839, 16197, 15839, 16197 | 589 | 911 |
| LYD813 | pQFNc_LYD813 | Phaseolus vulgaris | 15936, 16349, 15962, 16200 | 590 | 1127 |
| LYD814 | pQFNc_LYD814 | Phaseolus vulgaris | 16010, 16226, 16010, 16226 | 591 | 1128 |
| LYD815 | pUC19_LYD815 | Phaseolus vulgaris | 16059, 16326 | 592 | 914 |
| LYD816 | pUC19c_LYD816 | Phaseolus vulgaris | 16008, 16224, 16159, 16256 | 593 | 1129 |
| LYD817 | pQFNc_LYD817 | Phaseolus vulgaris | 15824, 16463, 15838, 16463 | 594 | 916 |
| LYD818 | pQFNc_LYD818 | Phaseolus vulgaris | 16438, 16164, 16438, 16164 | 595 | 1130 |
| LYD819 | pQFNc_LYD819 | Phaseolus vulgaris | 15951, 16338, 16176, 16252 | 596 | 918 |
| LYD821 | pQFNc_LYD821 | Phaseolus vulgaris | 16031, 16346 | 597 | 919 |
| LYD823 | pQFNc_LYD823 | Phaseolus vulgaris | 15944, 16485, 15944, 16485 | 598 | 921 |
| LYD824 | pMA-T_LYD824_GA | | | 599 | 922 |
| LYD825 | pQFNc_LYD825 | Phaseolus vulgaris | 16033, 16479, 16033, 16479 | 600 | 923 |
| LYD826 | pQFNc_LYD826 | Phaseolus vulgaris | 15952, 16278, 16104, 16278 | 601 | 924 |
| LYD828 | pQFNc_LYD828 | Phaseolus vulgaris | 16094, 16284, 16094, 16284 | 602 | 1131 |
| LYD829 | pUC19_LYD829 | Phaseolus vulgaris | 16146, 16302, 16146, 16245 | 603 | 1132 |
| LYD830 | pQFNc_LYD830 | Phaseolus vulgaris | 16113, 16296, 16071, 16221 | 604 | 928 |
| LYD831 | pUC19c_LYD831 | CANOLA Brassica napus | 15825, 15780, 15825, 15772 | 605 | 929 |
| LYD833 | pQFNc_LYD833 | CANOLA Brassica napus | 16132, 16339, 16064, 16307 | 606 | 930 |
| LYD834 | pQFNc_LYD834 | CANOLA Brassica napus | 15937, 16183, 15937, 16183 | 607 | 1133 |
| LYD835 | pMA-T_LYD835_GA | | | 608 | 932 |
| LYD836 | pQFNc_LYD836 | COTTON Gossypium hirsutum | 16406, 15868, 16434, 15912 | 609 | 933 |
| LYD837 | pQFNc_LYD837 | COTTON Gossypium hirsutum | 15965, 16271, 15965, 16272 | 610 | 934 |
| LYD838 | pQFNc_LYD838 | COTTON Gossypium hirsutum | 15931, 16194 | 611 | 935 |
| LYD839 | pQFNc_LYD839 | COTTON Gossypium hirsutum | 16455, 15873, 16455, 15873 | 612 | 936 |
| LYD840 | pQFNc_LYD840 | COTTON Gossypium hirsutum | 16397, 15896 | 613 | 937 |
| LYD841 | pQFNc_LYD841 | COTTON Gossypium hirsutum | 15949, 16254, 16047, 16358 | 614 | 1134 |
| LYD842 | pQFNc_LYD842 | COTTON Gossypium hirsutum | 16167, 16324, 15941, 16250 | 615 | 939 |
| LYD843 | pQFNc_LYD843 | COTTON Gossypium hirsutum | 16389, 15877, 16389, 15877 | 616 | 940 |
| LYD844 | pUC19c_LYD844 | COTTON Gossypium hirsutum | 16400, 15894, 16400, 15894 | 617 | 1135 |
| LYD845 | pQFNc_LYD845 | COTTON Gossypium hirsutum | 16143, 16182 | 618 | 1136 |
| LYD846 | pQFNc_LYD846 | COTTON Gossypium hirsutum | 16391, 15902, 16378, 15893 | 619 | 1137 |
| LYD847 | pQFNc_LYD847 | COTTON Gossypium hirsutum | 16030, 16343, 16030, 16343 | 620 | 1138 |
| LYD848 | pUC19_LYD848 | COTTON Gossypium hirsutum | 16426, 16061 | 621 | 945 |
| LYD849 | pQFNc_LYD849 | COTTON Gossypium hirsutum | 15842, 15888, 15856, 15889 | 622 | 1139 |
| LYD850 | pQFNc_LYD850 | COTTON Gossypium hirsutum | 16000, 16291, 16000, 16291 | 623 | 1140 |
| LYD851 | pMA-RQ_LYD851_GA | | | 624 | 948 |
| LYD852 | pUC19c_LYD852 | Medicago | 16415, 15910, 16447, 15886 | 625 | 1141 |
| LYD853 | pMA-T_LYD853_GA | | | 626 | 950 |
| LYD854 | pMA-T_LYD854_GA | | | 627 | 951 |
| LYD855 | pMA_LYD855_GA | | | 628 | 952 |
| LYD856 | pUC19c_LYD856 | Medicago | 16417, 16475, 16417, 16475 | 629 | 1142 |

TABLE 172-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| LYD857 | pMA-T_LYD857_GA | | | 630 | 954 |
| LYD858 | pUC19c_LYD858 | RICE *Oryza sativa* L. | 16091, 16262, 16091, 16262 | 631 | 955 |
| LYD859 | pQFNc_LYD859 | RICE *Oryza sativa* L. | 15988, 16211 | 632 | 956 |
| LYD860 | pQFNc_LYD860 | SOYBEAN *Glycine max* | 16065, 16222, 16014, 16243 | 633 | 957 |
| LYD861 | pUC19c_LYD861 | SOYBEAN *Glycine max* | 16458, 16478, 16458, 16478 | 634 | 958 |
| LYD863 | pMA-RQ_LYD863_GA | | | 635 | 959 |
| LYD864 | pQFNc_LYD864 | SOYBEAN *Glycine max* | 16089, 16231 | 636 | 960 |
| LYD865 | pQFNc_LYD865 | SOYBEAN *Glycine max* | 15957, 16331, 16044, 16216 | 637 | 1143 |
| LYD866 | pMA-RQ_LYD866_GA | | | 638 | 962 |
| LYD867 | pMA-RQ_LYD867_GA | | | 639 | 963 |
| LYD868 | pQFNc_LYD868 | SOYBEAN *Glycine max* | 15985, 16313, 15985, 16313 | 640 | 1144 |
| LYD869_H1 | pMA-RQ_LYD869_H1_GA | | | 696 | 1021 |
| LYD870 | pUC19_LYD870 | SOYBEAN *Glycine max* | 15971, 16362, 16136, 16269 | 641 | 966 |
| LYD871 | pQFNc_LYD871 | SOYBEAN *Glycine max* | 16066, 16323, 16066, 16329 | 642 | 967 |
| LYD872 | pUC19c_LYD872 | SOYBEAN *Glycine max* | 16165, 16351, 16165, 16351 | 643 | 968 |
| LYD873 | pQFNc_LYD873 | SOYBEAN *Glycine max* | 16112, 16368, 16022, 16270 | 644 | 969 |
| LYD874 | pUC19_LYD874 | SOYBEAN *Glycine max* | 16138, 16340, 15979, 16315 | 645 | 970 |
| LYD876 | pQFNc_LYD876 | SOYBEAN *Glycine max* | 16396, 16082, 16442, 15968 | 646 | 971 |
| LYD877 | pQFNc_LYD877 | SOYBEAN *Glycine max* | 15964, 16333, 16097, 16203 | 647 | 972 |
| LYD878 | pUC19_LYD878 | SOYBEAN *Glycine max* | 16416, 15789, 16440, 15767 | 648 | 973 |
| LYD879 | pMA_LYD879_GA | | | 649 | 974 |
| LYD880 | pMA-T_LYD880_GA | | | 650 | 975 |
| LYD881 | pQFNc_LYD881 | SOYBEAN *Glycine max* | 16007, 16259, 15947, 16259 | 651 | 1145 |
| LYD882 | pQFNc_LYD882 | SOYBEAN *Glycine max* | 16381, 15776, 16437, 15781 | 652 | 977 |
| LYD883 | pUC19_LYD883 | SOYBEAN *Glycine max* | 16105, 16212, 16105, 16354 | 653 | 978 |
| LYD884 | pQFNc_LYD884 | SOYBEAN *Glycine max* | 15989, 16214, 15976, 16369 | 654 | 979 |
| LYD886 | pQFNc_LYD886 | SOYBEAN *Glycine max* | 16106, 16355, 16115, 16195 | 655 | 980 |
| LYD887 | pUC19_LYD887 | SOYBEAN *Glycine max* | 16408, 15920, 16408, 15920 | 656 | 981 |
| LYD888 | pMA-RQ_LYD888_GA | | | 657 | 982 |
| LYD890 | pUC19_LYD890 | SOYBEAN *Glycine max* | 15930, 16370 | 658 | 983 |
| LYD891 | pUC19_LYD891 | SOYBEAN *Glycine max* | 15833, 15900, 15811, 15872 | 659 | 1146 |
| LYD892 | pMA-T_LYD892_GA | | | 660 | 985 |
| LYD893 | pQFNc_LYD893 | TOMATO *Lycopersicum* ND | 15878, 16285 | 661 | 986 |
| LYD894 | pQFNc_LYD894 | TOMATO *Lycopersicum* ND | 15925, 16361, 15925, 16361 | 662 | 987 |
| LYD895 | pQFNc_LYD895 | TOMATO *Lycopersicum* ND | 15948, 16283, 16149, 16265 | 663 | 988 |
| LYD896 | pQFNc_LYD896 | TOMATO *Lycopersicum* ND | 15779, 15914, 15779, 15915 | 664 | 989 |
| LYD897 | pUC19_LYD897 | TOMATO *Lycopersicum* ND | 16068, 16279, 16129, 16279 | 665 | 990 |
| LYD898 | pQFNc_LYD898 | TOMATO *Lycopersicum* ND | 16380, 15939, 16418, 16142 | 666 | 991 |
| LYD899 | pQFNc_LYD899 | TOMATO *Lycopersicum* ND | 15938, 16301 | 667 | 1147 |
| LYD900 | pQFNc_LYD900 | TOMATO *Lycopersicum* ND | 15995, 16267, 15995, 16263 | 668 | 1148 |
| LYD901 | pQFNc_LYD901 | TOMATO *Lycopersicum* ND | 15959, 16213, 15959, 16213 | 669 | 994 |
| LYD902 | pQFNc_LYD902 | TOMATO *Lycopersicum* ND | 16480, 16484, 16480, 16484 | 670 | 995 |
| LYD903 | TopoB_LYD903 | TOMATO *Lycopersicum* ND | 16425, 15786, 16387, 15785 | 671 | 996 |
| LYD904 | pUC19_LYD904 | TOMATO *Lycopersicum* ND | 16384, 15922, 16404, 15921 | 672 | 1149 |
| LYD905 | pMA_LYD905_GA | | | 673 | 998 |
| LYD906 | pUC19_LYD906 | TOMATO *Lycopersicum* ND | 16457, 15901 | 674 | 999 |
| LYD907 | pQFNc_LYD907 | TOMATO *Lycopersicum* ND | 15943, 15891, 15943, 15891 | 675 | 1000 |
| LYD908 | pQFNc_LYD908 | TOMATO *Lycopersicum* ND | 16374, 15905, 16374, 15905 | 676 | 1150 |
| LYD909 | pUC19c_LYD909 | TOMATO *Lycopersicum* ND | 16421, 15883, 16421, 15883 | 677 | 1002 |
| LYD910 | pMA-T_LYD910_GA | | | 678 | 1003 |
| LYD911 | pUC19_LYD911 | TOMATO *Lycopersicum* ND | 15992, 16209, 16107, 16237 | 679 | 1151 |
| LYD912 | pMA-T_LYD912_GA | | | 680 | 1005 |
| LYD913 | pQFNc_LYD913 | TOMATO *Lycopersicum* ND | 16083, 16310 | 681 | 1006 |
| LYD914 | pMA-T_LYD914_GA | | | 682 | 1007 |
| LYD915 | pMA-RQ_LYD915_GA | | | 683 | 1008 |
| LYD917 | pMA-T_LYD917_GA | | | 684 | 1009 |
| LYD918 | pQFNc_LYD918 | TOMATO *Lycopersicum* ND | 16156, 16238, 16117, 16314 | 685 | 1010 |
| LYD919 | pQFNc_LYD919 | TOMATO *Lycopersicum* ND | 16092, 16366, 16002, 16190 | 686 | 1011 |
| LYD920 | pQFNc_LYD920 | TOMATO *Lycopersicum* ND | 16126, 16295, 16157, 16295 | 687 | 1012 |
| LYD921 | TopoB_LYD921 | TOMATO *Lycopersicum* ND | 16413, 15765, 16453, 15774 | 688 | 1152 |
| LYD922 | pMA-T_LYD922_GA | | | 689 | 1014 |
| LYD923 | TopoB_LYD923 | TOMATO *Lycopersicum* ND | 15799, 15797, 15799, 15797 | 690 | 1153 |
| LYD924 | pUC19_LYD924 | TOMATO *Lycopersicum* ND | 16428, 16144, 16395, 15975 | 691 | 1016 |
| LYD925 | pQFNc_LYD925 | TOMATO *Lycopersicum* ND | 16116, 16330, 16012, 16277 | 692 | 1017 |
| LYD926 | pMA-T_LYD926_GA | | | 693 | 1018 |
| LYD929 | pQFNc_LYD929 | *Phaseolus vulgaris* | 15852, 15879, 15843, 15876 | 694 | 1019 |
| LYD930 | pMA-T_LYD930_GA | | | 695 | 1020 |
| MGP1 | pUCsFN_MGP1 | cotton | 16074, 16359, 16169, 16360 | 704 | 1029 |
| MGP14 | pMA-RQ_MGP14_GA | | | 477 | 797 |

TABLE 172-continued

Cloned genes

| Gene Name | High copy plasmid | Organism | Primers used SEQ ID NOs: | Polynucleotide SEQ ID NO: | Polypeptide SEQ ID NO: |
|---|---|---|---|---|---|
| MGP2 | pMA-T_MGP2_GA | | | 705 | 1030 |
| MGP4 | pUCsFN_MGP4 | Soybean | 16166, 15854, 16005, 15806 | 706 | 1031 |
| MGP5 | pMA-T_MGP5_GA | | | 707 | 1032 |
| MGP7 | pQFNc_MGP7 | SORGHUM Sorghum bicolor | 16080, 15870, 16080, 15870 | 708 | 1034 |
| MGP9 | pMA-RQ_MGP9_GA | | | 709 | 1035 |

Table 172: Provided are the gene names, cluster names, organisms from which they were derived, and polynucleotide and polypeptide sequence identifiers of selected genes of some embodiments of the invention. "GA"—Gene Art (synthetically prepared gene sequence).

Example 23

Transforming *Agrobacterium Tumefaciens* Cells with Binary Vectors Harboring Putative Genes Each of the binary vectors described in Example 22 above were used to transform *Agrobacterium* cells. Two additional binary constructs, having only the At6669 or the 35S promoter, or no additional promoter were used as negative controls.

The binary vectors were introduced to *Agrobacterium tumefaciens* GV301 or LB4404 (for *Arabidopsis*) or AGL1 (for *Brachypodium*) competent cells (about $10^9$ cells/mL) by electroporation. The electroporation was performed using a MicroPulser electroporator (Biorad), 0.2 cm cuvettes (Biorad) and EC-2 electroporation program (Biorad). The treated cells were cultured in LB liquid medium at 28° C. for 3 hours, then plated over LB agar supplemented with gentamycin (for *Arabidopsis;* 50 mg/L; for *Agrobacterium* strains GV301) or streptomycin (for *Arabidopsis;* 300 mg/L; for *Agrobacterium* strain LB4404); or with Carbenicillin (for *Brachypodium;* 50 mg/L) and kanamycin (for *Arabidopsis* and *Brachypodium;* 50 mg/L) at 28° C. for 48 hours. *Agrobacterium* colonies, which were developed on the selective media, were further analyzed by PCR using the primers designed to span the inserted sequence in the pPI plasmid. The resulting PCR products were isolated and sequenced to verify that the correct polynucleotide sequences of the invention are properly introduced to the *Agrobacterium* cells.

Example 24

Producing Transgenic *Arabidopsis* Plants Expressing Selected Genes According to Some Embodiments of the Invention Materials and Experimental Methods Plant transformation—The *Arabidopsis thaliana* var Columbia ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-904] with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained to half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 25

Transformation of *Brachypodium Distachyon* Plants with the Polynucleotides of the Invention Similar to the *Arabidopsis* model plant, *Brachypodium distachyon* has several features that recommend it as a model plant for functional genomic studies, especially in the grasses. Traits that make it an ideal model include its small genome (~160 Mbp for a diploid genome and 355 Mbp for a polyploidy genome), small physical stature, a short lifecycle, and few growth requirements. *Brachypodium* is related to the major cereal grain species but is understood to be more closely related to the Triticeae (wheat, barley) than to the other cereals. *Brachypodium*, with its polyploidy accessions, can serve as an ideal model for these grains (whose genomics size and complexity is a major barrier to biotechnological improvement).

*Brachypodium distachyon* embryogenic calli are transformed using the procedure described by Vogel and Hill (2008) [High-efficiency *Agrobacterium*-mediated transformation of *Brachypodium distachyon* inbred line Bd21-3. Plant Cell Rep 27:471-478], Vain et al (2008) [*Agrobacterium*-mediated transformation of the temperate grass *Brachypodium distachyon* (genotypeBd21) for T-DNA insertional mutagenesis. Plant Biotechnology J 6: 236-245], and Vogel J, et al. (2006) [*Agrobacterium* mediated transformation and inbred line development in the model grass *Brachypodium distachyon*. Plant Cell Tiss Org. Cult. 85:199-211], each of which is fully incorporated herein by reference, with some minor modifications, which are briefly summarized hereinbelow.

Callus initiation—Immature spikes (about 2 months after seeding) are harvested at the very beginning of seeds filling. Spikes are then husked and surface sterilized with 3% NaClO containing 0.1% Tween 20, shaken on a gyratory shaker at low speed for 20 minutes. Following three rinses with sterile distilled water, embryos are excised under a dissecting microscope in a laminar flow hood using fine forceps.

Excised embryos (size ~0.3 mm, bell shaped) are placed on callus induction medium (CIM) [LS salts (Linsmaier, E. M. & Skoog, F. 1965. Physiol. *Plantarum* 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] scutellar side down, 100 embryos on a plate, and incubated at 28° C. in the dark. One week later, the embryonic calli is cleaned from emerging roots, shoots and somatic calli, and was subcultured onto fresh CIM medium. During culture, yellowish embryogenic callus (EC) appeared and are further selected (e.g., picked and transferred) for further incubation in the same conditions for additional 2 weeks. Twenty-five pieces of sub-cultured calli are then separately placed on 90×15 mm petri plates, and incubated as before for three additional weeks.

Transformation—As described in Vogel and Hill (2008, Supra), *Agrobacterium* is scraped off 2-day-old MGL plates (plates with the MGL medium which contains: Tryptone 5 g/l, Yeast Extract 2.5 g/l, NaCl 5 g/l, D-Mannitol 5 g/l, $MgSO_4*7H_2O$ 0.204 g/l, $K_2HPO_4$ 0.25 g/l, Glutamic Acid 1.2 g/l, Plant Agar 7.5 g/l) and resuspended in liquid MS medium supplemented with 200 μM acetosyringone to an optic density (OD) at 600 nm ($OD_{600}$) of 0.6. Once the desired OD was attained, 1 ml of 10% Synperonic PE/F68 (Sigma) per 100 ml of inoculation medium is added.

To begin inoculation, 300 callus pieces are placed in approximately 12 plates (25 callus pieces in each plate) and covered with the *Agrobacterium* suspension (8-8.5 ml). The callus is incubated in the *Agrobacterium* suspension for 15 minutes with occasional gentle rocking. After incubation, the *Agrobacterium* suspension is aspirated off and the calli are then transferred into co-cultivation plates, prepared by placing a sterile 7-cm diameter filter paper in an empty 90×15 mm petri plate. The calli pieces are then gently distributed on the filter paper. One co-cultivation plate is used for two starting callus plates (50 initial calli pieces). The co-cultivation plates are then sealed with parafilm and incubated at 22° C. in the dark for 3 days.

The callus pieces are then individually transferred onto CIM medium as described above, which is further supplemented with 200 mg/l Ticarcillin (to kill the *Agrobacterium*) and Bialaphos (5 mg/L) (for selection of the transformed resistant embryogenic calli sections), and incubated at 28° C. in the dark for 14 days.

The calli pieces are then transferred to shoot induction media (SIM; LS salts and vitamins plus 3% Maltose monohydrate) supplemented with 200 mg/l Ticarcillin, Bialaphos (5 mg/L), Indol-3-acetic acid (IAA) (0.25 mg/L), and 6-Benzylaminopurine (BAP) (1 mg/L), and are sub-cultured in light to the same media after 10 days (total of 20 days). At each sub-culture all the pieces from a single callus are kept together to maintain their independence and are incubated under the following conditions: lighting to a level of 60 lE m−2 s−1, a 16-h light, 8-h dark photoperiod and a constant 24° C. temperature. Plantlets emerged from the transformed calli.

When plantlets are large enough to handle without damage, they are transferred to plates containing the above mentioned shoot induction media (SIM) without Bialaphos. Each plantlet is considered as a different event. The plantlets grew axillary tillers and eventually became bushy. Each bush from the same plant (event ID) is then divided to tissue culture boxes ("Humus") containing "rooting medium" [MS basal salts, 3% sucrose, 3 g/L phytagel, 2 mg/l α-Naphthalene Acetic Acid (NAA) and 1 mg/L IAA and Ticarcillin 200 mg/L, PH 5.8). All plants in a "Humus box" are different plants of the same transformation event.

When plantlets establish roots they are transplanted to soil and transferred to a greenhouse. To verify the transgenic status of plants containing the other constructs, T0 plants are subjected to PCR as previously described by Vogel et al. 2006 [*Agrobacterium* mediated transformation and inbred line development in the model grass *Brachypodium distachyon*. Plant Cell Tiss Org. Cult. 85:199-211].

Example 26

Evaluation of Transgenic *Arabidopsis* for Seed Yield and Plant Growth Rate Under Normal Conditions in Greenhouse Assays (GH-SM Assays)

Assay 1: seed yield, plant biomass and plant growth rate under normal greenhouse conditions—This assay follows seed yield production, the biomass formation and the rosette area growth of plants grown in the greenhouse at non-limiting nitrogen growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The plant were grown under normal growth conditions which included irrigation of the trays with a solution containing 6 mM inorganic nitrogen in the form of $KNO_3$ with 1 mM $KH_2PO_4$, 1 mM $MgSO_4$, 2 mM $CaCl_2$ and microelements. Under normal conditions the plants grow in a controlled environment in a closed transgenic greenhouse, temperature about 18-22° C., humidity around 70%. Irrigation was done by flooding with a water solution containing 6 mM N (nitrogen) (as described hereinabove), and flooding was repeated whenever water loss reached 50%. All plants were grown in the greenhouse until mature seeds. Seeds were harvested, extracted and weighted.

The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter (SEQ ID NO: 15751) and the selectable marker are used as control.

The plants were analyzed for their overall size, growth rate, flowering, seed yield, 1,000-seed weight, dry matter and harvest index (HI-seed yield/dry matter). Transgenic plants performance was compared to control plants grown in parallel under the same (e.g., identical) conditions. Mock-transgenic plants expressing the uidA reporter gene (GUS-Intron) or with no gene at all, under the same promoter were used as controls.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at/rsbweb (dot) nih (dot) gov/]. Images are captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number [Formula VIII (described above)], rosette area (Formula IX above), plot coverage (Formula XI above) and harvest index (Formula XV above) were calculated with the indicated formulas.

Seeds average weight—At the end of the experiment all seeds were collected. The seeds were scattered on a glass tray and a picture is taken. Using the digital analysis, the number of seeds in each sample was calculated.

Dry weight and seed yield—On about day 80 from sowing, the plants were harvested and left to dry at 30° C. in a drying chamber. The vegetative portion above ground was separated from the seeds. The total weight of the vegetative portion above ground and the seed weight of each plot were measured and divided by the number of plants.

Dry weight=total weight of the vegetative portion above ground (excluding roots) after drying at 30° C. in a drying chamber;

Seed yield per plant=total seed weight per plant (gr.)

1000 seed weight (the weight of 1000 seeds) (gr.).

Oil percentage in seeds—At the end of the experiment all seeds from each plot were collected. Seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) is used to create a calibration curve for the Low Resonance NMR. The content of oil of all seed samples was determined using the Low Resonance NMR (MARAN Ultra-Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 173-177 summarize the observed phenotypes of transgenic plants exogenously expressing the gene constructs using the seed maturation (GH-SM) assays under normal conditions. The evaluation of each gene was performed by testing the performance of different number of events. Event with p-value<0.1 was considered statistically significant.

TABLE 173

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGP77 | 81452.2 | — | — | — | 24.0 | 0.04 | −6 | — | — | — |
| CONT. | — | — | — | — | 25.4 | — | — | — | — | — |
| LGP53 | 76966.2 | 1068.2 | 0.26 | 9 | — | — | — | — | — | — |
| LGP53 | 76968.1 | 1135.9 | 0.20 | 16 | — | — | — | — | — | — |
| LGP52 | 76962.1 | 1075.0 | 0.16 | 10 | — | — | — | — | — | — |

TABLE 173-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGP52 | 76963.1 | — | — | — | 20.8 | 0.19 | −3 | 15.6 | 0.28 | −3 |
| LGP52 | 76963.3 | — | — | — | 20.7 | 0.18 | −3 | 14.6 | L | −9 |
| CONT. | — | — | — | — | 21.5 | — | — | 16.0 | — | — |
| LGP58 | 76971.1 | 1042.1 | 0.19 | 7 | — | — | — | — | — | — |
| LGP48 | 77202.1 | 1108.8 | L | 14 | — | — | — | — | — | — |
| LGP48 | 77203.2 | 1061.6 | 0.15 | 9 | — | — | — | — | — | — |
| LGP48 | 77204.6 | 1009.7 | 0.28 | 4 | — | — | — | — | — | — |
| LGP47 | 76960.1 | 1081.2 | L | 11 | — | — | — | — | — | — |
| LGP47 | 76960.2 | 1057.1 | 0.09 | 9 | — | — | — | — | — | — |
| LGP47 | 76960.3 | 1013.4 | 0.28 | 5 | — | — | — | — | — | — |
| CONT. | — | 969.7 | — | — | — | — | — | — | — | — |
| LYD930 | 83831.3 | 1766.2 | 0.14 | 22 | — | — | — | — | — | — |
| LYD930 | 83832.3 | 1621.2 | 0.13 | 12 | — | — | — | — | — | — |
| LYD930 | 83833.1 | 1588.8 | 0.05 | 10 | — | — | — | — | — | — |
| LYD930 | 83834.3 | 1566.7 | 0.11 | 8 | — | — | — | — | — | — |
| LYD881 | 84058.2 | 1517.5 | 0.28 | 5 | — | — | — | — | — | — |
| LYD877 | 83630.3 | 1810.0 | 0.23 | 25 | — | — | — | — | — | — |
| LYD877 | 83631.2 | 1598.8 | 0.04 | 10 | — | — | — | — | — | — |
| LYD863 | 83808.4 | 1778.1 | L | 23 | — | — | — | — | — | — |
| LYD863 | 83810.6 | 1744.2 | L | 20 | — | — | — | — | — | — |
| LYD863 | 83810.7 | 1630.0 | 0.09 | 12 | — | — | — | — | — | — |
| LYD846 | 83531.3 | 1526.2 | 0.22 | 5 | — | — | — | — | — | — |
| LYD846 | 83533.4 | 2084.4 | L | 44 | — | — | — | — | — | — |
| LYD831 | 83805.1 | 1538.1 | 0.20 | 6 | — | — | — | — | — | — |
| LYD788 | 83798.4 | — | — | — | 21.2 | 0.03 | −4 | — | — | — |
| LYD779 | 83704.1 | 1551.9 | 0.23 | 7 | — | — | — | — | — | — |
| LYD779 | 83704.2 | 1662.5 | 0.27 | 15 | — | — | — | — | — | — |
| LYD776 | 83944.1 | 1635.8 | 0.23 | 13 | — | — | — | — | — | — |
| LYD776 | 83947.6 | 1563.1 | 0.11 | 8 | — | — | — | — | — | — |
| LYD764 | 83479.4 | 1845.0 | L | 27 | — | — | — | — | — | — |
| LYD764 | 83480.1 | 1701.9 | L | 17 | — | — | — | — | — | — |
| LYD764 | 83483.1 | 1538.1 | 0.18 | 6 | — | — | — | — | — | — |
| LYD764 | 83483.6 | 1609.4 | 0.07 | 11 | — | — | — | — | — | — |
| LYD715 | 84158.1 | 1735.6 | 0.28 | 20 | 21.3 | 0.04 | −3 | — | — | — |
| LYD715 | 84158.3 | — | — | — | 21.5 | 0.22 | −2 | — | — | — |
| LYD710 | 83893.2 | 1704.9 | L | 18 | — | — | — | — | — | — |
| LYD710 | 83895.3 | 1765.6 | L | 22 | 21.2 | 0.18 | −4 | — | — | — |
| LYD710 | 83895.6 | 1726.9 | 0.08 | 19 | — | — | — | — | — | — |
| LYD710 | 83896.4 | 1551.9 | 0.12 | 7 | — | — | — | — | — | — |
| LYD708 | 83451.1 | 1572.4 | 0.07 | 8 | — | — | — | — | — | — |
| LYD708 | 83451.2 | 1636.9 | 0.14 | 13 | — | — | — | — | — | — |
| LYD708 | 83451.5 | 1611.7 | 0.03 | 11 | — | — | — | — | — | — |
| LYD700 | 84150.3 | 1870.0 | L | 29 | — | — | — | — | — | — |
| LYD698 | 83778.1 | 1630.0 | 0.02 | 12 | — | — | — | — | — | — |
| LYD698 | 83780.3 | 1558.1 | 0.23 | 7 | — | — | — | — | — | — |
| CONT. | — | 1450.2 | — | — | 22.0 | — | — | — | — | — |
| LGP77 | 81452.2 | 1327.4 | 0.18 | 14 | 20.7 | 0.18 | −3 | — | — | — |
| LGP77 | 81453.2 | — | — | — | 20.6 | 0.07 | −4 | — | — | — |
| LGP77 | 81453.3 | — | — | — | 20.6 | 0.07 | −4 | — | — | — |
| LGP77 | 81456.3 | — | — | — | 20.5 | 0.06 | −4 | — | — | — |
| CONT. | — | 1160.8 | — | — | 21.4 | — | — | — | — | — |
| LGP73 | 81449.7 | 1240.8 | 0.07 | 6 | — | — | — | — | — | — |
| LGP73 | 81449.8 | 1391.7 | L | 19 | 20.5 | 0.09 | −4 | — | — | — |
| CONT. | — | 1169.1 | — | — | 21.4 | — | — | — | — | — |
| LYD930 | 83831.3 | — | — | — | 19.1 | L | −10 | — | — | — |
| LYD930 | 83832.3 | 1219.4 | 0.08 | 5 | 20.1 | 0.03 | −6 | — | — | — |
| LYD881 | 84058.5 | — | — | — | 20.3 | 0.20 | −5 | — | — | — |
| LYD881 | 84058.6 | 1208.8 | 0.15 | 4 | — | — | — | — | — | — |
| LYD881 | 84060.4 | 1221.9 | 0.16 | 5 | — | — | — | — | — | — |
| LYD877 | 83630.2 | 1256.2 | 0.01 | 8 | — | — | — | — | — | — |
| LYD877 | 83630.3 | 1223.8 | 0.08 | 6 | — | — | — | — | — | — |
| LYD863 | 83808.2 | — | — | — | 20.5 | 0.30 | −4 | — | — | — |
| LYD863 | 83808.4 | 1251.9 | 0.02 | 8 | — | — | — | — | — | — |
| LYD863 | 83810.6 | 1420.0 | L | 23 | — | — | — | — | — | — |
| LYD863 | 83810.7 | 1326.9 | 0.08 | 14 | — | — | — | — | — | — |
| LYD846 | 83531.3 | 1266.2 | 0.09 | 9 | — | — | — | — | — | — |
| LYD846 | 83531.4 | 1255.6 | 0.04 | 8 | — | — | — | — | — | — |
| LYD831 | 83803.1 | 1208.8 | 0.13 | 4 | — | — | — | — | — | — |
| LYD831 | 83803.3 | — | — | — | 20.0 | 0.02 | −6 | — | — | — |
| LYD831 | 83803.5 | — | — | — | 20.8 | 0.29 | −3 | — | — | — |
| LYD831 | 83803.6 | 1236.9 | 0.16 | 7 | — | — | — | — | — | — |

TABLE 173-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYD788 | 83798.4 | 1360.6 | L | 17 | — | — | — | — | — | — |
| LYD788 | 83800.1 | 1206.2 | 0.22 | 4 | — | — | — | — | — | — |
| LYD788 | 83800.5 | 1207.5 | 0.16 | 4 | — | — | — | — | — | — |
| LYD783 | 84170.3 | 1327.6 | 0.04 | 15 | — | — | — | — | — | — |
| LYD783 | 84172.2 | 1290.0 | 0.15 | 11 | — | — | — | — | — | — |
| LYD779 | 83704.2 | 1286.9 | 0.28 | 11 | 20.2 | 0.04 | −6 | — | — | — |
| LYD764 | 83479.4 | 1370.6 | L | 18 | 20.2 | 0.04 | −6 | — | — | — |
| LYD764 | 83480.1 | 1291.9 | 0.05 | 11 | — | — | — | — | — | — |
| LYD764 | 83483.1 | 1194.4 | 0.29 | 3 | — | — | — | — | — | — |
| LYD740 | 83461.2 | 1228.1 | 0.18 | 6 | — | — | — | — | — | — |
| LYD740 | 83462.1 | 1272.5 | 0.17 | 10 | — | — | — | — | — | — |
| LYD715 | 84155.1 | 1223.8 | 0.06 | 6 | — | — | — | — | — | — |
| LYD715 | 84155.5 | — | — | — | 20.3 | 0.05 | −5 | — | — | — |
| LYD715 | 84156.5 | 1267.5 | L | 9 | — | — | — | — | — | — |
| LYD715 | 84158.1 | 1298.8 | 0.21 | 12 | — | — | — | — | — | — |
| LYD715 | 84158.3 | 1336.9 | 0.05 | 15 | — | — | — | — | — | — |
| LYD713 | 83788.1 | 1247.5 | 0.02 | 8 | — | — | — | — | — | — |
| LYD713 | 83788.3 | 1381.9 | 0.04 | 19 | — | — | — | — | — | — |
| LYD713 | 83789.2 | 1201.9 | 0.18 | 4 | — | — | — | — | — | — |
| LYD713 | 83789.3 | 1211.4 | 0.11 | 5 | — | — | — | — | — | — |
| LYD708 | 83451.1 | 1212.5 | 0.12 | 5 | — | — | — | — | — | — |
| LYD708 | 83451.6 | 1283.2 | 0.04 | 11 | — | — | — | — | — | — |
| LYD698 | 83778.1 | 1240.0 | 0.03 | 7 | — | — | — | — | — | — |
| CONT. | — | 1159.1 | — | — | 21.3 | — | — | — | — | — |
| LYD919 | 83642.2 | 1188.1 | 0.21 | 5 | — | — | — | — | — | — |
| LYD919 | 83644.3 | 1259.4 | 0.02 | 11 | — | — | — | — | — | — |
| LYD913 | 84195.2 | 1213.7 | 0.13 | 7 | — | — | — | — | — | — |
| LYD913 | 84195.4 | 1288.8 | 0.24 | 14 | 20.2 | L | −6 | — | — | — |
| LYD913 | 84198.4 | 1213.1 | 0.11 | 7 | — | — | — | — | — | — |
| LYD913 | 84198.7 | 1181.9 | 0.27 | 5 | — | — | — | 13.9 | 0.24 | −2 |
| LYD909 | 84174.1 | 1212.4 | 0.26 | 7 | — | — | — | 13.9 | 0.24 | −2 |
| LYD909 | 84174.2 | 1251.6 | 0.03 | 11 | — | — | — | — | — | — |
| LYD909 | 84174.4 | — | — | — | 20.4 | 0.02 | −6 | — | — | — |
| LYD909 | 84177.1 | — | — | — | — | — | — | 13.8 | 0.23 | −3 |
| LYD900 | 83738.10 | 1216.9 | 0.19 | 8 | — | — | — | — | — | — |
| LYD900 | 83738.14 | 1198.1 | 0.15 | 6 | 20.5 | 0.04 | −5 | 13.9 | 0.24 | −2 |
| LYD900 | 83738.8 | 1220.6 | 0.27 | 8 | 19.6 | 0.04 | −9 | — | — | — |
| LYD898 | 83640.1 | — | — | — | 19.9 | 0.19 | −8 | — | — | — |
| LYD898 | 83641.5 | 1323.1 | L | 17 | — | — | — | — | — | — |
| LYD898 | 83641.6 | 1200.0 | 0.14 | 6 | 20.4 | 0.02 | −6 | — | — | — |
| LYD898 | 83641.8 | — | — | — | 20.9 | 0.25 | −3 | — | — | — |
| LYD896 | 83659.2 | 1488.3 | 0.03 | 32 | 20.0 | L | −7 | — | — | — |
| LYD896 | 83661.1 | 1190.0 | 0.24 | 5 | — | — | — | — | — | — |
| LYD896 | 83661.2 | 1219.4 | 0.26 | 8 | — | — | — | — | — | — |
| LYD895 | 83537.4 | — | — | — | 20.4 | 0.11 | −6 | — | — | — |
| LYD893 | 83952.5 | — | — | — | 20.2 | L | −6 | — | — | — |
| LYD893 | 83952.6 | 1183.8 | 0.24 | 5 | 21.1 | 0.19 | −2 | — | — | — |
| LYD893 | 83952.7 | — | — | — | 19.9 | L | −8 | 13.9 | 0.24 | −2 |
| LYD886 | 83636.1 | 1199.3 | 0.29 | 6 | — | — | — | — | — | — |
| LYD882 | 84064.4 | — | — | — | 20.6 | 0.27 | −5 | — | — | — |
| LYD882 | 84065.1 | 1322.1 | L | 17 | — | — | — | — | — | — |
| LYD871 | 83715.4 | 1208.8 | 0.22 | 7 | — | — | — | — | — | — |
| LYD871 | 83716.2 | — | — | — | 20.3 | 0.01 | −6 | 13.9 | 0.24 | −2 |
| LYD848 | 84290.1 | — | — | — | — | — | — | 13.9 | 0.24 | −2 |
| LYD848 | 84290.3 | 1238.8 | 0.13 | 10 | 20.4 | 0.10 | −6 | — | — | — |
| LYD840 | 84081.1 | 1194.4 | 0.25 | 6 | 21.2 | 0.30 | −2 | 13.8 | 0.23 | −3 |
| LYD840 | 84085.2 | 1198.8 | 0.21 | 6 | — | — | — | 13.9 | 0.24 | −2 |
| LYD786 | 84582.1 | 1222.5 | 0.23 | 8 | — | — | — | 13.8 | 0.23 | −3 |
| LYD786 | 84582.2 | 1255.0 | 0.03 | 11 | — | — | — | — | — | — |
| LYD786 | 84584.4 | — | — | — | 20.6 | 0.18 | −5 | — | — | — |
| LYD786 | 84585.4 | 1214.4 | 0.09 | 8 | — | — | — | — | — | — |
| LYD746 | 83898.2 | — | — | — | 20.1 | L | −7 | — | — | — |
| LYD746 | 83902.4 | 1208.1 | 0.25 | 7 | 20.4 | 0.25 | −5 | — | — | — |
| LYD745 | 84261.1 | 1236.9 | 0.08 | 9 | — | — | — | — | — | — |
| LYD745 | 84262.1 | 1427.2 | 0.14 | 26 | 17.0 | L | −21 | 12.0 | 0.26 | −15 |
| LYD745 | 84263.1 | — | — | — | 20.4 | 0.02 | −6 | — | — | — |
| LYD745 | 84264.2 | — | — | — | — | — | — | 13.9 | 0.24 | −2 |
| LYD733 | 83766.2 | 1289.4 | 0.26 | 14 | — | — | — | — | — | — |
| LYD733 | 83768.1 | 1246.0 | 0.18 | 10 | — | — | — | — | — | — |
| LYD717 | 84353.1 | 1200.0 | 0.26 | 6 | — | — | — | — | — | — |
| LYD717 | 84356.1 | 1296.7 | 0.28 | 15 | 20.9 | 0.11 | −3 | — | — | — |

TABLE 173-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 1129.6 | — | — | 21.6 | — | — | 14.2 | — | — |
| LGP32 | 75394.2 | — | — | — | — | — | — | 23.1 | 0.20 | −2 |
| LGP32 | 75397.4 | — | — | — | 29.0 | 0.15 | −2 | 22.7 | 0.03 | −4 |
| CONT. | — | — | — | — | 29.6 | — | — | 23.5 | — | — |
| LGP74 | 81326.1 | — | — | — | 34.8 | L | −5 | 27.4 | 0.07 | −4 |
| LGP74 | 81328.1 | — | — | — | 35.5 | L | −3 | 27.3 | 0.03 | −4 |
| LGP74 | 81328.3 | — | — | — | — | — | — | 27.0 | L | −5 |
| CONT. | — | — | — | — | 36.7 | — | — | 28.6 | — | — |
| LGP43 | 76955.1 | — | — | — | — | — | — | 18.0 | 0.26 | −1 |
| LGP43 | 76955.2 | — | — | — | 21.9 | 0.23 | −2 | 18.0 | 0.26 | −1 |
| CONT. | — | — | — | — | 22.4 | — | — | 18.3 | — | — |
| LGP71 | 82500.4 | 1447.5 | 0.13 | 9 | — | — | — | — | — | — |
| LGP71 | 82502.4 | 1415.0 | 0.28 | 7 | — | — | — | — | — | — |
| LGP71 | 82503.1 | 1568.3 | 0.12 | 18 | 24.0 | 0.21 | −4 | — | — | — |
| CONT. | — | 1328.1 | — | — | 25.2 | — | — | — | — | — |
| LGP1 | 76250.4 | — | — | — | — | — | — | 18.0 | 0.18 | −0 |
| CONT. | — | — | — | — | — | — | — | 18.1 | — | — |
| LGP73 | 81449.8 | 1539.6 | 0.07 | 12 | — | — | — | — | — | — |
| CONT. | — | 1375.8 | — | — | — | — | — | — | — | — |
| LGP71 | 82503.1 | — | — | — | 24.0 | 0.03 | −8 | — | — | — |
| CONT. | — | — | — | — | 26.1 | — | — | — | — | — |
| LGP34 | 75739.3 | 909.4 | 0.17 | 4 | — | — | — | — | — | — |
| CONT. | — | 878.3 | — | — | — | — | — | — | — | — |
| LYD929 | 83647.2 | — | — | — | 22.0 | 0.06 | −3 | 15.0 | 0.09 | −1 |
| LYD929 | 83649.1 | — | — | — | 19.6 | L | −13 | 15.0 | 0.09 | −1 |
| LYD929 | 83650.3 | — | — | — | 21.8 | 0.07 | −4 | — | — | — |
| LYD922 | 83821.3 | — | — | — | — | — | — | 14.9 | 0.07 | −2 |
| LYD922 | 83823.6 | 1263.1 | 0.12 | 5 | 21.8 | 0.05 | −4 | — | — | — |
| LYD915 | 84657.1 | — | — | — | 22.0 | 0.08 | −3 | 15.0 | 0.09 | −1 |
| LYD915 | 84658.1 | — | — | — | 22.1 | 0.25 | −2 | — | — | — |
| LYD913 | 84195.1 | — | — | — | 22.1 | 0.09 | −3 | 15.0 | 0.09 | −1 |
| LYD913 | 84195.4 | — | — | — | 22.1 | 0.26 | −2 | — | — | — |
| LYD909 | 84174.1 | — | — | — | 21.9 | 0.18 | −4 | — | — | — |
| LYD909 | 84174.4 | — | — | — | 21.2 | 0.02 | −6 | 15.0 | 0.09 | −1 |
| LYD909 | 84177.1 | — | — | — | 22.0 | 0.08 | −3 | — | — | — |
| LYD909 | 84178.1 | — | — | — | 21.9 | 0.03 | −4 | 15.0 | 0.09 | −1 |
| LYD899 | 83722.1 | — | — | — | — | — | — | 15.0 | 0.09 | −1 |
| LYD899 | 83723.8 | — | — | — | — | — | — | 15.0 | 0.09 | −1 |
| LYD895 | 83535.3 | — | — | — | 22.0 | 0.08 | −3 | — | — | — |
| LYD895 | 83535.5 | 1288.8 | 0.08 | 7 | — | — | — | — | — | — |
| LYD895 | 83537.3 | — | — | — | 22.2 | 0.14 | −2 | — | — | — |
| LYD895 | 83537.4 | — | — | — | — | — | — | 15.0 | 0.09 | −1 |
| LYD893 | 83950.1 | — | — | — | 22.0 | 0.06 | −3 | 15.0 | 0.09 | −1 |
| LYD893 | 83952.5 | — | — | — | 21.8 | 0.15 | −4 | — | — | — |
| LYD893 | 83952.6 | — | — | — | 22.2 | 0.18 | −2 | 15.0 | 0.09 | −1 |
| LYD848 | 84290.1 | — | — | — | — | — | — | 15.0 | 0.09 | −1 |
| LYD848 | 84290.3 | — | — | — | 22.2 | 0.18 | −2 | 15.0 | 0.09 | −1 |
| LYD848 | 84292.1 | — | — | — | 22.1 | 0.09 | −3 | 15.0 | 0.09 | −1 |
| LYD848 | 84292.5 | 1341.5 | 0.26 | 12 | — | — | — | 14.9 | 0.07 | −2 |
| LYD840 | 84081.2 | — | — | — | 22.1 | 0.09 | −3 | — | — | — |
| LYD840 | 84085.2 | 1426.9 | 0.20 | 19 | 20.2 | L | −11 | 14.8 | 0.19 | −3 |
| LYD833 | 83511.1 | — | — | — | 21.6 | 0.03 | −5 | 15.0 | 0.09 | −1 |
| LYD833 | 83513.5 | — | — | — | — | — | — | 14.8 | 0.19 | −3 |
| LYD821 | 84053.3 | — | — | — | 22.0 | 0.06 | −3 | — | — | — |
| LYD821 | 84054.2 | — | — | — | 22.1 | 0.10 | −3 | — | — | — |
| LYD789 | 84131.3 | 1293.1 | 0.19 | 8 | 22.0 | 0.06 | −3 | — | — | — |
| LYD789 | 84132.2 | 1331.2 | L | 11 | — | — | — | — | — | — |
| LYD746 | 83898.2 | — | — | — | — | — | — | 15.0 | 0.09 | −1 |
| LYD733 | 83766.2 | 1290.6 | 0.05 | 7 | — | — | — | — | — | — |
| LYD733 | 83768.1 | — | — | — | 22.1 | 0.11 | −2 | — | — | — |
| LYD733 | 83768.4 | — | — | — | 21.9 | 0.14 | −3 | 15.0 | 0.09 | −1 |
| LYD717 | 84353.2 | — | — | — | — | — | — | 15.0 | 0.09 | −1 |
| LYD717 | 84356.1 | — | — | — | 22.0 | 0.25 | −3 | — | — | — |
| LYD717 | 84356.2 | — | — | — | — | — | — | 15.0 | 0.09 | −1 |
| LYD704 | 83781.1 | — | — | — | 22.2 | 0.21 | −2 | 15.0 | 0.09 | −1 |
| LYD704 | 83785.1 | — | — | — | 22.1 | 0.11 | −2 | — | — | — |
| LYD704 | 83785.2 | — | — | — | — | — | — | 15.0 | 0.09 | −1 |
| LYD704 | 83785.5 | — | — | — | 21.8 | 0.05 | −4 | — | — | — |
| CONT. | — | 1200.7 | — | — | 22.7 | — | — | 15.2 | — | — |
| LGP54 | 77040.4 | — | — | — | — | — | — | 16.4 | 0.01 | −3 |
| LGP53 | 76966.2 | 1166.4 | 0.01 | 16 | — | — | — | 16.1 | 0.08 | −5 |

TABLE 173-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LGP53 | 76968.1 | 1206.8 | 0.04 | 20 | — | — | — | — | — | — |
| LGP52 | 76962.1 | 1128.6 | 0.27 | 12 | — | — | — | — | — | — |
| LGP52 | 76963.1 | 1180.6 | 0.09 | 17 | — | — | — | 16.0 | 0.05 | −5 |
| LGP52 | 76963.3 | — | — | — | 20.8 | 0.04 | −5 | 15.6 | L | −8 |
| LGP52 | 76965.2 | 1102.1 | 0.08 | 10 | — | — | — | 16.5 | 0.25 | −3 |
| CONT. | — | 1004.9 | — | — | 21.9 | — | — | 16.9 | — | — |
| LYD919 | 83642.2 | — | — | — | 19.0 | 0.03 | −3 | 12.0 | 0.13 | −1 |
| LYD919 | 83644.3 | — | — | — | — | — | — | 12.0 | 0.13 | −1 |
| LYD900 | 83738.14 | — | — | — | 19.1 | 0.05 | −3 | — | — | — |
| LYD900 | 83738.8 | — | — | — | 17.8 | 0.26 | −9 | — | — | — |
| LYD898 | 83639.1 | — | — | — | — | — | — | 12.0 | 0.13 | −1 |
| LYD898 | 83640.1 | — | — | — | 19.1 | 0.22 | −3 | — | — | — |
| LYD898 | 83641.5 | 1399.4 | 0.26 | 9 | 19.1 | 0.22 | −3 | 12.0 | 0.13 | −1 |
| LYD898 | 83641.8 | — | — | — | 18.8 | 0.03 | −4 | 12.0 | 0.13 | −1 |
| LYD894 | 84360.1 | — | — | — | — | — | — | 11.9 | 0.20 | −2 |
| LYD894 | 84361.1 | — | — | — | 18.8 | 0.03 | −4 | 12.0 | 0.13 | −1 |
| LYD894 | 84362.1 | — | — | — | 18.4 | 0.14 | −6 | 12.0 | 0.13 | −1 |
| LYD894 | 84362.2 | — | — | — | 19.2 | 0.15 | −2 | 12.0 | 0.13 | −1 |
| LYD894 | 84362.3 | — | — | — | 18.8 | 0.24 | −4 | — | — | — |
| LYD886 | 83634.3 | — | — | — | — | — | — | 12.0 | 0.13 | −1 |
| LYD886 | 83635.4 | — | — | — | 18.8 | 0.08 | −4 | — | — | — |
| LYD886 | 83636.1 | — | — | — | 18.5 | 0.23 | −6 | 12.0 | 0.13 | −1 |
| LYD883 | 83911.2 | 1416.4 | 0.05 | 10 | — | — | — | — | — | — |
| LYD883 | 83911.4 | — | — | — | 19.1 | 0.22 | −3 | — | — | — |
| LYD883 | 83912.2 | 1382.1 | 0.15 | 7 | 18.6 | 0.16 | −5 | 12.0 | 0.13 | −1 |
| LYD883 | 83912.3 | — | — | — | 19.1 | 0.06 | −3 | — | — | — |
| LYD882 | 84061.4 | — | — | — | 19.1 | 0.22 | −3 | 12.0 | 0.13 | −1 |
| LYD882 | 84064.4 | — | — | — | 19.0 | 0.03 | −3 | 12.0 | 0.13 | −1 |
| LYD882 | 84065.1 | — | — | — | — | — | — | 12.0 | 0.13 | −1 |
| LYD882 | 84065.3 | — | — | — | — | — | — | 12.0 | 0.13 | −1 |
| LYD882 | 84065.7 | — | — | — | 19.3 | 0.16 | −2 | 12.0 | 0.13 | −1 |
| LYD871 | 83716.2 | — | — | — | 19.0 | 0.03 | −3 | 12.0 | 0.13 | −1 |
| LYD871 | 83716.4 | — | — | — | 18.9 | 0.02 | −4 | 12.0 | 0.13 | −1 |
| LYD871 | 83718.4 | — | — | — | 18.9 | 0.02 | −4 | — | — | — |
| LYD871 | 83718.6 | — | — | — | 19.0 | 0.05 | −3 | — | — | — |
| LYD865 | 83729.1 | — | — | — | — | — | — | 12.0 | 0.13 | −1 |
| LYD865 | 83730.1 | 1643.0 | 0.26 | 27 | — | — | — | 12.0 | 0.13 | −1 |
| LYD865 | 83731.1 | — | — | — | 18.6 | 0.04 | −5 | 12.0 | 0.13 | −1 |
| LYD865 | 83733.5 | — | — | — | — | — | — | 12.0 | 0.13 | −1 |
| LYD865 | 83733.6 | — | — | — | 19.1 | 0.06 | −3 | — | — | — |
| LYD839 | 83521.1 | 1376.2 | 0.20 | 7 | 18.8 | 0.03 | −4 | 12.0 | 0.13 | −1 |
| LYD839 | 83521.3 | — | — | — | 19.2 | 0.15 | −2 | 12.0 | 0.13 | −1 |
| LYD839 | 83522.1 | 1357.5 | 0.17 | 5 | 19.2 | 0.08 | −2 | — | — | — |
| LYD811 | 83711.4 | — | — | — | — | — | — | 12.0 | 0.13 | −1 |
| LYD811 | 83713.3 | — | — | — | 19.3 | 0.18 | −2 | — | — | — |
| LYD793 | 83499.7 | 1526.0 | 0.02 | 18 | 19.0 | 0.03 | −3 | — | — | — |
| LYD793 | 83500.1 | — | — | — | — | — | — | 12.0 | 0.13 | −1 |
| LYD793 | 83500.4 | — | — | — | — | — | — | 12.0 | 0.13 | −1 |
| LYD786 | 84582.1 | — | — | — | 19.3 | 0.21 | −2 | 12.0 | 0.13 | −1 |
| LYD786 | 84584.4 | — | — | — | 19.3 | 0.18 | −2 | 12.0 | 0.13 | −1 |
| LYD786 | 84585.3 | — | — | — | 18.6 | 0.16 | −5 | — | — | — |
| LYD786 | 84585.4 | — | — | — | 19.2 | 0.08 | −2 | 12.0 | 0.13 | −1 |
| LYD777 | 83489.3 | 1378.8 | 0.19 | 7 | — | — | — | 12.0 | 0.13 | −1 |
| LYD777 | 83493.3 | — | — | — | — | — | — | 12.0 | 0.13 | −1 |
| LYD772 | 84526.1 | — | — | — | — | — | — | 11.9 | 0.17 | −1 |
| LYD772 | 84529.2 | 1559.5 | 0.13 | 21 | — | — | — | 12.0 | 0.13 | −1 |
| LYD772 | 84529.3 | — | — | — | — | — | — | 12.0 | 0.13 | −1 |
| LYD748 | 84918.1 | — | — | — | — | — | — | 12.0 | 0.13 | −1 |
| LYD748 | 84918.3 | — | — | — | 19.3 | 0.23 | −1 | 12.0 | 0.13 | −1 |
| LYD748 | 84919.2 | — | — | — | 18.5 | 0.23 | −6 | 12.0 | 0.13 | −1 |
| LYD748 | 84919.4 | — | — | — | 18.7 | L | −5 | 12.0 | 0.13 | −1 |
| LYD747 | 85011.1 | — | — | — | 19.1 | 0.20 | −3 | 12.0 | 0.13 | −1 |
| LYD747 | 85011.3 | — | — | — | 19.0 | 0.03 | −3 | 12.0 | 0.13 | −1 |
| LYD747 | 85011.5 | — | — | — | 19.1 | 0.05 | −3 | 12.0 | 0.13 | −1 |
| LYD745 | 84261.4 | — | — | — | 18.9 | 0.02 | −4 | 12.0 | 0.13 | −1 |
| LYD745 | 84262.1 | 1361.9 | 0.24 | 6 | 16.6 | L | −15 | — | — | — |
| LYD745 | 84263.1 | — | — | — | 17.9 | 0.25 | −9 | — | — | — |
| LYD745 | 84264.2 | — | — | — | 18.9 | 0.02 | −4 | 12.0 | 0.13 | −1 |
| CONT. | — | 1289.0 | — | — | 19.6 | — | — | 12.1 | — | — |
| LGP9 | 75517.2 | — | — | — | 28.9 | 0.22 | −3 | 22.6 | 0.26 | −3 |
| LGP10 | 75385.3 | — | — | — | — | — | — | 22.5 | 0.23 | −3 |

TABLE 173-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | — | — | — | 29.6 | — | — | 23.3 | — | — |
| LGP45 | 77196.1 | 882.5 | L | 11 | — | — | — | — | — | — |
| LGP19 | 76938.3 | 874.7 | 0.05 | 10 | — | — | — | — | — | — |
| CONT. | — | 796.8 | — | — | — | — | — | — | — | — |
| LGP47 | 76960.1 | 1091.2 | 0.05 | 18 | — | — | — | — | — | — |
| CONT. | — | 927.0 | — | — | — | — | — | — | — | — |

Table 173. "CONT."—Control; "Ave."—Average; "% Incr." = % increment; "p-val."—p-value, L- p < 0.01.

TABLE 174

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LGP77 | 81452.2 | 0.949 | 0.03 | 15 | 9.54 | 0.25 | 4 | 56.2 | 0.06 | 18 |
| LGP77 | 81456.3 | 0.887 | 0.15 | 7 | — | — | — | — | — | — |
| CONT. | — | 0.826 | — | — | 9.16 | — | — | 47.8 | — | — |
| LGP52 | 76963.1 | — | — | — | — | — | — | 92.9 | 0.18 | 12 |
| LGP52 | 76965.2 | — | — | — | — | — | — | 91.7 | 0.19 | 10 |
| CONT. | — | — | — | — | — | — | — | 83.1 | — | — |
| LGP48 | 77203.2 | — | — | — | 11.5 | 0.06 | 7 | — | — | — |
| LGP47 | 76956.1 | — | — | — | 11.2 | 0.26 | 4 | — | — | — |
| CONT. | — | — | — | — | 10.8 | — | — | — | — | — |
| LYD930 | 83834.3 | — | — | — | 10.4 | 0.17 | 3 | — | — | — |
| LYD881 | 84058.5 | 1.97 | 0.29 | 8 | — | — | — | 106.1 | 0.23 | 10 |
| LYD881 | 84060.4 | — | — | — | 10.8 | 0.07 | 7 | — | — | — |
| LYD877 | 83630.1 | — | — | — | 10.8 | 0.30 | 6 | — | — | — |
| LYD877 | 83630.2 | — | — | — | 10.8 | 0.16 | 6 | — | — | — |
| LYD877 | 83630.3 | 2.19 | L | 21 | 10.6 | 0.04 | 5 | 119.8 | L | 24 |
| LYD877 | 83630.4 | — | — | — | 11.2 | 0.05 | 11 | 112.5 | 0.13 | 16 |
| LYD863 | 83808.1 | — | — | — | 10.7 | 0.03 | 6 | — | — | — |
| LYD863 | 83810.7 | — | — | — | 10.8 | 0.16 | 6 | — | — | — |
| LYD846 | 83531.3 | — | — | — | 10.5 | 0.15 | 4 | — | — | — |
| LYD846 | 83531.4 | — | — | — | — | — | — | 104.1 | 0.29 | 8 |
| LYD846 | 83533.4 | — | — | — | 11.1 | L | 10 | — | — | — |
| LYD831 | 83803.1 | 1.97 | 0.20 | 8 | — | — | — | 104.5 | 0.25 | 8 |
| LYD831 | 83803.3 | 2.00 | 0.12 | 10 | 10.9 | L | 8 | 107.2 | 0.15 | 11 |
| LYD831 | 83803.5 | — | — | — | — | — | — | 104.7 | 0.26 | 8 |
| LYD788 | 83798.4 | — | — | — | 10.9 | L | 8 | 119.0 | 0.12 | 23 |
| LYD788 | 83800.4 | — | — | — | 10.4 | 0.24 | 3 | — | — | — |
| LYD788 | 83800.5 | 2.04 | 0.07 | 12 | — | — | — | 109.0 | 0.10 | 13 |
| LYD783 | 84170.3 | 2.05 | 0.05 | 13 | — | — | — | 110.1 | 0.08 | 14 |
| LYD779 | 83704.1 | — | — | — | 10.5 | 0.15 | 4 | — | — | — |
| LYD779 | 83704.2 | 1.94 | 0.27 | 6 | 10.7 | 0.03 | 6 | 108.4 | 0.10 | 12 |
| LYD779 | 83708.2 | — | — | — | — | — | — | 111.5 | 0.06 | 15 |
| LYD776 | 83944.1 | — | — | — | 10.7 | 0.11 | 6 | — | — | — |
| LYD776 | 83947.1 | — | — | — | — | — | — | 106.0 | 0.25 | 9 |
| LYD776 | 83947.4 | — | — | — | 10.5 | 0.15 | 4 | — | — | — |
| LYD764 | 83479.2 | — | — | — | 10.6 | 0.07 | 5 | — | — | — |
| LYD764 | 83479.4 | 2.10 | 0.13 | 15 | 10.9 | 0.04 | 8 | 120.8 | 0.06 | 25 |
| LYD764 | 83483.1 | — | — | — | 10.6 | 0.07 | 5 | — | — | — |
| LYD731 | 83454.2 | — | — | — | 10.8 | 0.01 | 7 | — | — | — |
| LYD731 | 83456.1 | 2.05 | 0.12 | 13 | — | — | — | 111.7 | 0.24 | 15 |
| LYD715 | 84155.1 | — | — | — | 10.6 | 0.07 | 5 | — | — | — |
| LYD715 | 84158.1 | 1.99 | 0.15 | 9 | — | — | — | — | — | — |
| LYD715 | 84158.3 | 1.99 | 0.17 | 9 | 10.5 | 0.10 | 4 | 111.7 | 0.05 | 15 |
| LYD713 | 83786.4 | 2.09 | 0.30 | 15 | 11.1 | L | 9 | 114.1 | 0.17 | 18 |
| LYD713 | 83788.3 | 2.06 | 0.08 | 13 | 10.9 | 0.11 | 8 | 120.0 | L | 24 |
| LYD713 | 83789.2 | — | — | — | 10.6 | 0.04 | 5 | — | — | — |
| LYD713 | 83789.3 | — | — | — | 10.8 | 0.02 | 6 | — | — | — |
| LYD710 | 83893.2 | — | — | — | 10.4 | 0.24 | 3 | — | — | — |
| LYD710 | 83895.6 | 2.02 | 0.10 | 11 | 11.0 | L | 9 | 115.5 | 0.03 | 19 |
| LYD710 | 83896.1 | 2.03 | 0.24 | 12 | 10.6 | 0.07 | 5 | 112.3 | 0.21 | 16 |

TABLE 174-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD708 | 83451.7 | 2.06 | 0.23 | 13 | — | — | — | 112.8 | 0.21 | 17 |
| LYD698 | 83780.4 | 2.00 | 0.13 | 10 | — | — | — | 112.2 | 0.04 | 16 |
| CONT. | — | 1.82 | — | — | 10.1 | — | — | 96.8 | — | — |
| LGP77 | 81452.2 | 0.762 | 0.02 | 14 | — | — | — | — | — | — |
| LGP77 | 81453.3 | 0.711 | 0.11 | 6 | — | — | — | 39.5 | 0.16 | 6 |
| CONT. | — | 0.668 | — | — | — | — | — | 37.1 | — | — |
| LGP73 | 81449.7 | 1.09 | 0.22 | 7 | — | — | — | — | — | — |
| LGP73 | 81449.8 | 1.20 | 0.01 | 17 | 10.5 | 0.04 | 8 | 69.3 | L | 24 |
| CONT. | — | 1.02 | — | — | 9.72 | — | — | 56.0 | — | — |
| LYD930 | 83831.3 | 1.30 | 0.26 | 10 | — | — | — | — | — | — |
| LYD930 | 83832.3 | 1.46 | 0.02 | 24 | — | — | — | 81.7 | 0.24 | 26 |
| LYD930 | 83834.3 | 1.37 | 0.03 | 16 | — | — | — | 76.3 | 0.13 | 18 |
| LYD881 | 84057.2 | — | — | — | 10.5 | 0.15 | 5 | — | — | — |
| LYD877 | 83630.4 | — | — | — | 11.2 | 0.01 | 12 | — | — | — |
| LYD877 | 83631.2 | — | — | — | 11.1 | 0.20 | 12 | — | — | — |
| LYD863 | 83810.7 | 1.33 | 0.15 | 13 | 10.9 | 0.10 | 10 | 76.2 | 0.05 | 17 |
| LYD846 | 83531.3 | — | — | — | — | — | — | 70.5 | 0.29 | 9 |
| LYD831 | 83803.3 | 1.35 | 0.14 | 14 | — | — | — | 75.0 | 0.07 | 15 |
| LYD788 | 83800.4 | 1.45 | L | 23 | — | — | — | 81.4 | 0.01 | 25 |
| LYD783 | 84170.1 | — | — | — | 10.6 | 0.28 | 7 | 74.5 | 0.22 | 15 |
| LYD783 | 84170.3 | — | — | — | — | — | — | 71.6 | 0.24 | 10 |
| LYD779 | 83704.2 | — | — | — | 10.9 | 0.02 | 9 | 74.9 | 0.07 | 15 |
| LYD779 | 83708.2 | 1.29 | 0.17 | 10 | — | — | — | 72.5 | 0.18 | 12 |
| LYD764 | 83479.4 | — | — | — | 10.7 | 0.06 | 7 | 72.3 | 0.15 | 11 |
| LYD764 | 83483.1 | 1.34 | 0.06 | 14 | 11.0 | 0.02 | 10 | 78.6 | 0.03 | 21 |
| LYD740 | 83462.1 | 1.26 | 0.29 | 7 | — | — | — | 70.6 | 0.26 | 9 |
| LYD715 | 84155.5 | — | — | — | 11.2 | 0.01 | 12 | 85.6 | 0.10 | 32 |
| LYD715 | 84158.1 | — | — | — | — | — | — | 83.5 | 0.29 | 29 |
| LYD715 | 84158.3 | — | — | — | — | — | — | 72.1 | 0.16 | 11 |
| LYD713 | 83786.4 | — | — | — | 10.6 | 0.07 | 7 | — | — | — |
| LYD713 | 83788.3 | — | — | — | — | — | — | 72.3 | 0.15 | 11 |
| LYD713 | 83789.3 | — | — | — | 10.4 | 0.18 | 5 | 71.5 | 0.25 | 10 |
| CONT. | — | 1.18 | — | — | 9.96 | — | — | 64.9 | — | — |
| LGP49 | 77652.6 | — | — | — | 11.3 | 0.17 | 4 | 113.4 | 0.17 | 13 |
| CONT. | — | — | — | — | 10.8 | — | — | 100.2 | — | — |
| LYD919 | 83642.2 | 1.49 | 0.03 | 19 | 11.1 | 0.02 | 11 | 91.4 | 0.09 | 33 |
| LYD919 | 83644.3 | — | — | — | 10.8 | 0.25 | 8 | 74.8 | 0.22 | 9 |
| LYD919 | 83645.1 | — | — | — | 10.6 | 0.02 | 6 | 78.3 | 0.07 | 14 |
| LYD913 | 84195.2 | — | — | — | 10.6 | 0.03 | 6 | 75.9 | 0.27 | 11 |
| LYD913 | 84198.4 | 1.40 | 0.10 | 12 | 10.4 | 0.15 | 4 | 77.1 | 0.08 | 12 |
| LYD913 | 84198.7 | — | — | — | — | — | — | 85.0 | 0.24 | 24 |
| LYD909 | 84174.2 | 1.54 | 0.08 | 23 | 10.8 | L | 8 | 90.1 | 0.15 | 31 |
| LYD909 | 84174.4 | 1.57 | L | 25 | 10.9 | 0.03 | 9 | 92.4 | L | 35 |
| LYD909 | 84177.1 | 1.39 | 0.13 | 11 | 10.5 | 0.03 | 5 | 81.3 | 0.02 | 19 |
| LYD909 | 84178.3 | 1.38 | 0.15 | 10 | — | — | — | 79.6 | 0.03 | 16 |
| LYD900 | 83738.10 | 1.49 | 0.06 | 18 | 11.1 | 0.29 | 11 | 88.2 | 0.06 | 29 |
| LYD900 | 83738.14 | 1.48 | 0.08 | 18 | — | — | — | 85.2 | 0.09 | 24 |
| LYD900 | 83738.8 | 1.64 | 0.25 | 31 | 10.9 | 0.21 | 9 | 99.0 | 0.18 | 44 |
| LYD898 | 83639.1 | — | — | — | 10.8 | 0.28 | 8 | — | — | — |
| LYD898 | 83640.1 | 1.53 | 0.22 | 22 | — | — | — | 90.6 | 0.22 | 32 |
| LYD898 | 83641.6 | 1.38 | 0.15 | 10 | 10.6 | 0.17 | 6 | 81.6 | 0.02 | 19 |
| LYD896 | 83659.5 | — | — | — | — | — | — | 76.7 | 0.16 | 12 |
| LYD896 | 83661.1 | — | — | — | 10.8 | 0.25 | 8 | — | — | — |
| LYD896 | 83661.2 | 1.39 | 0.15 | 11 | — | — | — | 80.0 | 0.10 | 17 |
| LYD896 | 83661.4 | 1.37 | 0.22 | 9 | 10.9 | L | 9 | 80.8 | 0.02 | 18 |
| LYD895 | 83535.4 | 1.42 | 0.12 | 13 | 10.8 | L | 8 | 84.1 | 0.10 | 23 |
| LYD895 | 83537.3 | — | — | — | 10.4 | 0.15 | 4 | — | — | — |
| LYD895 | 83537.4 | — | — | — | 10.4 | 0.15 | 4 | — | — | — |
| LYD893 | 83951.1 | 1.48 | 0.04 | 18 | 10.8 | L | 8 | 88.7 | L | 29 |
| LYD893 | 83952.5 | 1.47 | 0.03 | 17 | 10.6 | 0.11 | 6 | 86.3 | 0.02 | 26 |
| LYD893 | 83952.6 | — | — | — | 10.8 | L | 8 | 85.5 | 0.25 | 25 |
| LYD893 | 83952.7 | — | — | — | 10.8 | L | 8 | 84.0 | 0.14 | 23 |
| LYD886 | 83635.4 | 1.45 | 0.06 | 15 | 10.4 | 0.06 | 4 | 84.2 | 0.03 | 23 |
| LYD886 | 83636.1 | — | — | — | — | — | — | 81.7 | 0.19 | 19 |
| LYD882 | 84061.1 | 1.53 | 0.01 | 22 | 10.9 | 0.09 | 9 | 90.3 | 0.04 | 32 |
| LYD882 | 84064.4 | 1.40 | 0.12 | 12 | — | — | — | 82.0 | 0.10 | 20 |
| LYD882 | 84065.1 | — | — | — | 10.4 | 0.15 | 4 | — | — | — |
| LYD882 | 84065.7 | 1.42 | 0.26 | 13 | 11.0 | 0.07 | 10 | 83.0 | 0.08 | 21 |
| LYD871 | 83715.4 | 1.35 | 0.24 | 8 | 10.6 | 0.28 | 6 | 77.3 | 0.07 | 13 |
| LYD871 | 83716.2 | 1.37 | 0.21 | 9 | — | — | — | 77.7 | 0.07 | 13 |
| LYD871 | 83718.6 | 1.36 | 0.21 | 9 | 10.6 | 0.17 | 6 | 78.3 | 0.07 | 14 |

TABLE 174-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD848 | 84290.3 | 1.53 | 0.07 | 22 | 11.1 | 0.24 | 11 | 92.8 | L | 35 |
| LYD848 | 84290.4 | — | — | — | — | — | — | 88.4 | 0.29 | 29 |
| LYD848 | 84292.5 | 1.36 | 0.27 | 8 | 10.8 | L | 8 | 85.6 | L | 25 |
| LYD840 | 84085.2 | — | — | — | 10.4 | 0.18 | 4 | 76.5 | 0.19 | 12 |
| LYD840 | 84085.4 | — | — | — | — | — | — | 75.7 | 0.13 | 10 |
| LYD786 | 84582.2 | — | — | — | — | — | — | 75.4 | 0.17 | 10 |
| LYD786 | 84584.4 | — | — | — | — | — | — | 76.5 | 0.15 | 12 |
| LYD786 | 84585.4 | 1.41 | 0.10 | 12 | 10.4 | 0.18 | 4 | 80.3 | 0.04 | 17 |
| LYD746 | 83898.2 | 1.46 | 0.04 | 16 | 10.9 | L | 9 | 84.8 | L | 24 |
| LYD746 | 83902.2 | 1.54 | 0.22 | 23 | 11.1 | 0.02 | 11 | 90.9 | 0.14 | 33 |
| LYD746 | 83902.4 | 1.41 | 0.15 | 12 | 10.5 | 0.07 | 5 | 83.0 | 0.01 | 21 |
| LYD745 | 84261.1 | — | — | — | 10.9 | L | 9 | 81.1 | 0.16 | 18 |
| LYD745 | 84261.4 | 1.53 | 0.01 | 22 | 10.6 | 0.03 | 6 | 88.4 | L | 29 |
| LYD745 | 84262.1 | 1.69 | L | 35 | 11.2 | L | 12 | 104.6 | L | 53 |
| LYD745 | 84264.2 | 1.41 | 0.19 | 13 | 10.5 | 0.07 | 5 | 82.9 | 0.01 | 21 |
| LYD733 | 83766.2 | — | — | — | — | — | — | 75.7 | 0.14 | 10 |
| LYD733 | 83768.3 | 1.48 | 0.03 | 18 | 10.8 | 0.12 | 8 | 89.3 | L | 30 |
| LYD717 | 84353.1 | — | — | — | — | — | — | 78.0 | 0.09 | 14 |
| LYD717 | 84354.2 | — | — | — | — | — | — | 76.4 | 0.10 | 11 |
| LYD717 | 84356.2 | 1.51 | 0.02 | 20 | 11.1 | L | 11 | 92.9 | L | 35 |
| CONT. | — | 1.25 | — | — | 10.0 | — | — | 68.6 | — | — |
| LGP6 | 75670.2 | 1.20 | 0.23 | 6 | — | — | — | — | — | — |
| LGP32 | 75397.4 | 1.29 | 0.10 | 14 | 11.1 | 0.06 | 9 | 81.3 | 0.08 | 20 |
| LGP12 | 78567.3 | 1.25 | 0.09 | 10 | — | — | — | — | — | — |
| CONT. | — | 1.13 | — | — | 10.1 | — | — | 67.5 | — | — |
| LGP74 | 81325.1 | — | — | — | 11.9 | 0.29 | 7 | — | — | — |
| LGP74 | 81328.3 | 1.59 | 0.06 | 15 | — | — | — | 94.1 | 0.06 | 18 |
| CONT. | — | 1.38 | — | — | 11.1 | — | — | 79.7 | — | — |
| LGP74 | 81325.1 | 1.29 | 0.18 | 6 | — | — | — | 77.2 | 0.20 | 8 |
| LGP74 | 81328.3 | 1.37 | 0.17 | 13 | 11.0 | 0.24 | 6 | 84.8 | 0.15 | 19 |
| CONT. | — | 1.22 | — | — | 10.4 | — | — | 71.3 | — | — |
| LGP71 | 82503.1 | 1.16 | 0.08 | 29 | 9.83 | 0.02 | 8 | 68.2 | 0.06 | 38 |
| CONT. | — | 0.902 | — | — | 9.12 | — | — | 49.5 | — | — |
| LYD911 | 86502.3 | — | — | — | 10.7 | 0.15 | 3 | — | — | — |
| LYD911 | 86503.1 | — | — | — | 11.3 | 0.03 | 9 | 101.8 | 0.04 | 21 |
| LYD907 | 84976.1 | 1.71 | 0.10 | 12 | 10.6 | 0.21 | 3 | 95.7 | 0.10 | 14 |
| LYD907 | 84979.1 | 1.64 | 0.30 | 7 | — | — | — | — | — | — |
| LYD907 | 84979.2 | — | — | — | 11.1 | 0.06 | 7 | — | — | — |
| LYD904 | 84497.2 | — | — | — | — | — | — | 94.3 | 0.11 | 12 |
| LYD904 | 84499.2 | 2.00 | L | 31 | 10.6 | 0.21 | 3 | 111.8 | L | 33 |
| LYD902 | 84948.5 | — | — | — | — | — | — | 105.2 | 0.28 | 25 |
| LYD899 | 83722.1 | — | — | — | 10.8 | 0.14 | 4 | — | — | — |
| LYD899 | 83723.8 | — | — | — | 11.3 | 0.23 | 9 | — | — | — |
| LYD896 | 83661.4 | — | — | — | 11.1 | L | 8 | — | — | — |
| LYD867 | 85536.2 | — | — | — | 11.1 | 0.06 | 7 | — | — | — |
| LYD867 | 85536.5 | — | — | — | — | — | — | 91.1 | 0.24 | 8 |
| LYD844 | 85192.1 | — | — | — | — | — | — | 93.9 | 0.16 | 12 |
| LYD844 | 85192.3 | 1.84 | 0.29 | 20 | — | — | — | — | — | — |
| LYD844 | 85192.4 | 1.65 | 0.23 | 8 | — | — | — | — | — | — |
| LYD844 | 85192.7 | 1.79 | 0.06 | 17 | — | — | — | 99.6 | 0.03 | 18 |
| LYD844 | 85192.8 | — | — | — | 10.8 | 0.06 | 5 | — | — | — |
| LYD825 | 85881.2 | — | — | — | 10.8 | 0.14 | 4 | — | — | — |
| LYD825 | 85883.1 | 1.82 | 0.02 | 19 | — | — | — | 100.3 | 0.02 | 19 |
| LYD825 | 85884.2 | 1.83 | 0.02 | 20 | — | — | — | 99.1 | 0.03 | 18 |
| LYD812 | 85560.1 | 1.65 | 0.27 | 8 | — | — | — | 91.6 | 0.25 | 9 |
| LYD812 | 85560.2 | 2.05 | L | 34 | — | — | — | 107.5 | L | 28 |
| LYD812 | 85564.1 | — | — | — | 10.6 | 0.28 | 3 | 94.5 | 0.30 | 12 |
| LYD778 | 85053.2 | — | — | — | 11.4 | L | 10 | — | — | — |
| LYD778 | 85053.3 | — | — | — | 10.9 | 0.25 | 6 | 91.9 | 0.21 | 9 |
| LYD778 | 85053.4 | — | — | — | — | — | — | 103.2 | 0.14 | 23 |
| LYD772 | 84526.1 | 1.87 | 0.28 | 22 | — | — | — | 102.0 | 0.29 | 21 |
| LYD730 | 84258.1 | — | — | — | 11.1 | 0.06 | 7 | — | — | — |
| LYD711 | 85316.3 | 2.02 | 0.24 | 32 | — | — | — | 107.1 | 0.25 | 27 |
| LYD711 | 85316.5 | — | — | — | 10.9 | 0.07 | 5 | 108.4 | 0.21 | 29 |
| CONT. | — | 1.53 | — | — | 10.3 | — | — | 84.1 | — | — |
| LGP1 | 76249.3 | — | — | — | 11.4 | 0.16 | 4 | — | — | — |
| CONT. | — | — | — | — | 11.0 | — | — | — | — | — |
| LGP71 | 82503.1 | — | — | — | 9.58 | 0.15 | 4 | 49.2 | 0.13 | 10 |
| CONT. | — | — | — | — | 9.25 | — | — | 44.5 | — | — |
| LYD929 | 83647.2 | — | — | — | 11.1 | 0.23 | 3 | — | — | — |
| LYD929 | 83649.1 | 1.81 | 0.18 | 11 | — | — | — | — | — | — |

TABLE 174-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYD929 | 83651.2 | — | — | — | 11.4 | 0.17 | 6 | 106.2 | 0.14 | 12 |
| LYD922 | 83823.6 | 1.83 | 0.06 | 12 | 11.4 | 0.22 | 6 | 106.4 | 0.13 | 12 |
| LYD915 | 84657.1 | 1.98 | 0.27 | 22 | — | — | — | 114.8 | 0.27 | 21 |
| LYD913 | 84195.1 | 2.00 | 0.13 | 23 | — | — | — | 114.0 | 0.03 | 20 |
| LYD909 | 84174.1 | 1.81 | 0.11 | 11 | 11.3 | 0.04 | 5 | 109.4 | 0.19 | 15 |
| LYD909 | 84174.4 | — | — | — | 11.6 | 0.17 | 7 | — | — | — |
| LYD909 | 84178.1 | — | — | — | 11.2 | 0.10 | 4 | — | — | — |
| LYD893 | 83950.1 | 1.79 | 0.13 | 10 | — | — | — | 107.7 | 0.21 | 13 |
| LYD893 | 83952.5 | — | — | — | 11.9 | 0.05 | 10 | 107.4 | 0.11 | 13 |
| LYD893 | 83952.6 | — | — | — | 11.4 | 0.02 | 6 | — | — | — |
| LYD848 | 84289.1 | 1.92 | 0.02 | 18 | 12.1 | 0.07 | 12 | 121.3 | 0.06 | 28 |
| LYD848 | 84292.1 | — | — | — | 11.2 | 0.10 | 4 | — | — | — |
| LYD848 | 84292.5 | — | — | — | 11.2 | 0.10 | 4 | — | — | — |
| LYD840 | 84081.2 | — | — | — | 11.4 | 0.02 | 6 | 107.6 | 0.30 | 13 |
| LYD840 | 84085.2 | 1.89 | 0.06 | 16 | 12.1 | L | 13 | 114.1 | 0.03 | 20 |
| LYD833 | 83511.4 | — | — | — | 11.6 | 0.05 | 7 | — | — | — |
| LYD833 | 83512.2 | — | — | — | 11.4 | 0.05 | 6 | — | — | — |
| LYD833 | 83513.5 | 1.92 | 0.02 | 18 | 11.5 | 0.02 | 7 | 124.4 | L | 31 |
| LYD821 | 84054.2 | 1.74 | 0.23 | 7 | — | — | — | 103.0 | 0.26 | 9 |
| LYD789 | 84132.3 | — | — | — | 11.3 | 0.04 | 5 | 102.7 | 0.28 | 8 |
| LYD733 | 83768.1 | — | — | — | 11.2 | 0.10 | 4 | — | — | — |
| LYD717 | 84354.2 | — | — | — | 11.3 | 0.13 | 5 | — | — | — |
| LYD717 | 84356.2 | — | — | — | 11.2 | 0.06 | 4 | — | — | — |
| LYD704 | 83785.2 | 1.74 | 0.25 | 7 | — | — | — | — | — | — |
| LYD704 | 83785.5 | — | — | — | 11.2 | 0.10 | 4 | — | — | — |
| CONT. | — | 1.63 | — | — | 10.8 | — | — | 94.9 | — | — |
| LGP52 | 76963.1 | 1.77 | 0.21 | 13 | — | — | — | 104.0 | 0.28 | 12 |
| CONT. | — | 1.57 | — | — | — | — | — | 92.8 | — | — |
| LYD919 | 83642.2 | 1.57 | 0.06 | 10 | 11.6 | 0.26 | 9 | 95.9 | L | 17 |
| LYD919 | 83644.3 | — | — | — | — | — | — | 89.5 | 0.28 | 9 |
| LYD919 | 83646.1 | 1.56 | 0.16 | 10 | 11.2 | 0.06 | 5 | 91.1 | 0.20 | 11 |
| LYD900 | 83738.10 | — | — | — | 10.9 | 0.26 | 3 | — | — | — |
| LYD900 | 83738.11 | — | — | — | 11.3 | 0.08 | 6 | — | — | — |
| LYD900 | 83738.14 | — | — | — | 11.2 | 0.13 | 5 | — | — | — |
| LYD900 | 83738.8 | — | — | — | 11.1 | 0.08 | 5 | — | — | — |
| LYD898 | 83641.5 | 1.53 | 0.27 | 8 | — | — | — | 90.0 | 0.24 | 10 |
| LYD898 | 83641.8 | — | — | — | — | — | — | 93.2 | 0.14 | 14 |
| LYD894 | 84361.1 | 1.53 | 0.21 | 8 | — | — | — | — | — | — |
| LYD894 | 84362.1 | — | — | — | 11.1 | 0.23 | 4 | — | — | — |
| LYD894 | 84362.2 | 1.52 | 0.08 | 7 | — | — | — | 87.3 | 0.11 | 7 |
| LYD886 | 83634.2 | — | — | — | — | — | — | 87.0 | 0.17 | 6 |
| LYD886 | 83634.3 | — | — | — | — | — | — | 87.6 | 0.26 | 7 |
| LYD886 | 83636.1 | 1.58 | 0.02 | 11 | — | — | — | 93.1 | L | 14 |
| LYD883 | 83911.4 | 1.49 | 0.24 | 5 | — | — | — | — | — | — |
| LYD883 | 83912.2 | 1.50 | 0.16 | 5 | — | — | — | — | — | — |
| LYD883 | 83912.3 | 1.75 | L | 23 | 11.0 | 0.22 | 3 | 101.4 | L | 24 |
| LYD882 | 84065.1 | 1.51 | 0.16 | 6 | — | — | — | 90.4 | 0.06 | 10 |
| LYD871 | 83716.2 | — | — | — | 11.5 | 0.02 | 8 | 95.8 | 0.03 | 17 |
| LYD871 | 83718.6 | 1.64 | 0.06 | 15 | 11.2 | 0.06 | 6 | 99.8 | 0.09 | 22 |
| LYD865 | 83731.1 | 1.70 | L | 20 | — | — | — | 103.1 | 0.10 | 26 |
| LYD865 | 83733.5 | 1.52 | 0.03 | 7 | 11.1 | 0.11 | 5 | 88.0 | 0.09 | 8 |
| LYD839 | 83521.1 | — | — | — | 11.3 | 0.03 | 6 | — | — | — |
| LYD839 | 83522.1 | — | — | — | — | — | — | 85.2 | 0.30 | 4 |
| LYD811 | 83711.4 | 1.52 | 0.27 | 7 | 11.1 | 0.25 | 5 | 88.2 | 0.29 | 8 |
| LYD811 | 83713.3 | 1.64 | 0.06 | 16 | 11.1 | 0.13 | 4 | 95.9 | 0.11 | 17 |
| LYD793 | 83499.2 | 1.61 | 0.12 | 13 | — | — | — | 91.6 | 0.02 | 12 |
| LYD793 | 83499.7 | — | — | — | — | — | — | 88.8 | 0.07 | 8 |
| LYD777 | 83489.3 | 1.59 | L | 12 | 11.7 | L | 10 | 96.5 | L | 18 |
| LYD777 | 83492.3 | — | — | — | 11.2 | 0.13 | 5 | — | — | — |
| LYD777 | 83493.3 | — | — | — | — | — | — | 85.6 | 0.25 | 5 |
| LYD772 | 84526.1 | 1.48 | 0.20 | 4 | — | — | — | 86.7 | 0.14 | 6 |
| LYD772 | 84529.2 | 1.57 | 0.21 | 10 | 11.3 | 0.03 | 6 | 92.0 | 0.21 | 12 |
| LYD772 | 84529.3 | — | — | — | 11.0 | 0.22 | 3 | — | — | — |
| LYD748 | 84919.1 | — | — | — | 11.2 | 0.13 | 5 | — | — | — |
| LYD748 | 84919.4 | 1.49 | 0.29 | 5 | — | — | — | — | — | — |
| LYD747 | 85011.3 | — | — | — | — | — | — | 85.6 | 0.25 | 5 |
| LYD747 | 85012.1 | — | — | — | 11.0 | 0.22 | 3 | — | — | — |
| LYD745 | 84261.1 | 1.56 | 0.09 | 10 | 11.2 | 0.06 | 6 | 89.5 | 0.12 | 9 |
| LYD745 | 84262.1 | 1.62 | L | 14 | — | — | — | 93.4 | 0.21 | 14 |
| LYD745 | 84263.1 | 1.58 | L | 12 | — | — | — | 93.5 | 0.05 | 14 |
| CONT. | — | 1.42 | — | — | 10.6 | — | — | 81.9 | — | — |

TABLE 174-continued

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LGP9 | 75515.1 | — | — | — | 10.2 | 0.09 | 5 | — | — | — |
| LGP44 | 75765.3 | — | — | — | 10.5 | 0.03 | 8 | — | — | — |
| LGP10 | 75385.3 | — | — | — | 10.5 | 0.07 | 8 | — | — | — |
| CONT. | — | — | — | — | 9.67 | — | — | — | — | — |
| LGP46 | 77258.3 | — | — | — | 9.75 | 0.11 | 3 | — | — | — |
| CONT. | — | — | — | — | 9.44 | — | — | — | — | — |

Table 174. "CONT."—Control; "Ave."—Average; "% Incr." = % increment; "p-val."—p-value, L- p < 0.01.

TABLE 175

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LGP77 | 81452.2 | — | — | — | 7.16 | 0.07 | 17 | — | — | — |
| CONT. | — | — | — | — | 6.10 | — | — | — | — | — |
| LGP52 | 76963.1 | — | — | — | 12.6 | 0.23 | 10 | — | — | — |
| LGP52 | 76965.2 | — | — | — | 12.4 | 0.30 | 8 | — | — | — |
| CONT. | — | — | — | — | 11.4 | — | — | — | — | — |
| LGP48 | 77202.4 | 0.749 | 0.11 | 15 | — | — | — | 0.511 | 0.14 | 6 |
| LGP48 | 77203.2 | 0.779 | L | 20 | — | — | — | — | — | — |
| LGP47 | 76956.1 | 0.760 | 0.02 | 17 | — | — | — | — | — | — |
| LGP47 | 76960.2 | 0.734 | 0.15 | 13 | — | — | — | — | — | — |
| CONT. | — | 0.651 | — | — | — | — | — | 0.484 | — | — |
| LYD877 | 83630.1 | — | — | — | — | — | — | 0.571 | 0.23 | 14 |
| LYD877 | 83630.3 | — | — | — | 15.3 | 0.12 | 25 | 0.615 | 0.05 | 23 |
| LYD877 | 83630.4 | 0.707 | 0.09 | 20 | 14.4 | 0.26 | 17 | 0.569 | 0.25 | 14 |
| LYD863 | 83808.1 | 0.689 | 0.18 | 16 | — | — | — | — | — | — |
| LYD863 | 83810.6 | 0.683 | 0.20 | 16 | — | — | — | — | — | — |
| LYD863 | 83810.7 | — | — | — | — | — | — | 0.577 | 0.20 | 15 |
| LYD846 | 83531.3 | 0.673 | 0.22 | 14 | — | — | — | — | — | — |
| LYD846 | 83533.4 | 0.735 | 0.06 | 24 | — | — | — | — | — | — |
| LYD831 | 83803.3 | 0.709 | 0.10 | 20 | — | — | — | — | — | — |
| LYD831 | 83803.6 | — | — | — | — | — | — | 0.565 | 0.29 | 13 |
| LYD788 | 83798.4 | — | — | — | 15.0 | 0.16 | 22 | 0.583 | 0.16 | 17 |
| LYD788 | 83800.5 | — | — | — | — | — | — | 0.570 | 0.23 | 14 |
| LYD779 | 83708.2 | — | — | — | — | — | — | 0.577 | 0.19 | 15 |
| LYD776 | 83944.1 | 0.775 | 0.01 | 31 | — | — | — | — | — | — |
| LYD776 | 83947.1 | — | — | — | — | — | — | 0.564 | 0.27 | 13 |
| LYD776 | 83947.2 | 0.668 | 0.26 | 13 | — | — | — | — | — | — |
| LYD764 | 83479.2 | 0.669 | 0.27 | 13 | — | — | — | — | — | — |
| LYD764 | 83479.4 | 0.676 | 0.25 | 14 | 15.3 | 0.13 | 24 | 0.590 | 0.12 | 18 |
| LYD731 | 83454.2 | 0.668 | 0.29 | 13 | — | — | — | — | — | — |
| LYD731 | 83456.1 | — | — | — | — | — | — | 0.570 | 0.25 | 14 |
| LYD731 | 83458.1 | — | — | — | — | — | — | 0.562 | 0.28 | 12 |
| LYD713 | 83786.4 | 0.683 | 0.22 | 16 | 14.5 | 0.25 | 18 | — | — | — |
| LYD713 | 83788.1 | 0.699 | 0.20 | 18 | — | — | — | — | — | — |
| LYD713 | 83788.3 | — | — | — | 15.5 | 0.09 | 26 | 0.576 | 0.19 | 15 |
| LYD713 | 83789.3 | 0.724 | 0.06 | 22 | — | — | — | — | — | — |
| LYD710 | 83893.2 | 0.683 | 0.17 | 16 | — | — | — | — | — | — |
| LYD710 | 83895.6 | — | — | — | 14.5 | 0.25 | 18 | — | — | — |
| LYD710 | 83896.1 | — | — | — | 14.4 | 0.28 | 17 | — | — | — |
| LYD708 | 83451.7 | — | — | — | 14.4 | 0.27 | 17 | 0.581 | 0.18 | 16 |
| LYD700 | 84151.1 | 0.691 | 0.20 | 17 | — | — | — | — | — | — |
| LYD700 | 84151.4 | 0.694 | 0.14 | 17 | — | — | — | — | — | — |
| LYD698 | 83780.3 | 0.679 | 0.26 | 15 | — | — | — | — | — | — |
| LYD698 | 83780.4 | — | — | — | 14.4 | 0.27 | 17 | 0.563 | 0.27 | 13 |
| CONT. | — | 0.591 | — | — | 12.3 | — | — | 0.501 | — | — |
| LGP77 | 81452.2 | — | — | — | — | — | — | 0.435 | 0.14 | 10 |
| CONT. | — | — | — | — | — | — | — | 0.395 | — | — |
| LGP73 | 81449.3 | — | — | — | — | — | — | 0.399 | 0.07 | 8 |
| LGP73 | 81449.7 | — | — | — | — | — | — | 0.402 | L | 9 |
| LGP73 | 81449.8 | 0.624 | 0.11 | 24 | 8.37 | L | 24 | 0.400 | 0.02 | 9 |

TABLE 175-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.505 | — | — | 6.77 | — | — | 0.368 | — | — |
| LYD930 | 83832.3 | — | — | — | 10.7 | 0.12 | 27 | 0.480 | 0.14 | 16 |
| LYD930 | 83834.3 | — | — | — | 10.0 | 0.25 | 19 | — | — | — |
| LYD877 | 83631.2 | 0.820 | 0.19 | 24 | — | — | — | — | — | — |
| LYD863 | 83810.7 | — | — | — | 9.88 | 0.30 | 17 | — | — | — |
| LYD788 | 83800.4 | — | — | — | 10.7 | 0.10 | 27 | 0.486 | 0.09 | 17 |
| LYD764 | 83483.1 | — | — | — | 10.3 | 0.19 | 22 | — | — | — |
| LYD715 | 84155.5 | 0.791 | 0.28 | 20 | 11.2 | 0.06 | 32 | 0.487 | 0.10 | 18 |
| LYD715 | 84158.1 | — | — | — | 10.9 | 0.10 | 29 | 0.463 | 0.29 | 12 |
| LYD713 | 83786.4 | 0.778 | 0.30 | 18 | — | — | — | — | — | — |
| LYD713 | 83789.2 | — | — | — | 10.5 | 0.16 | 24 | 0.477 | 0.17 | 15 |
| CONT. | — | 0.659 | — | — | 8.44 | — | — | 0.414 | — | — |
| LGP49 | 77652.6 | — | — | — | 13.9 | 0.18 | 13 | — | — | — |
| CONT. | — | — | — | — | 12.3 | — | — | — | — | — |
| LYD919 | 83642.2 | 0.810 | 0.13 | 25 | 12.1 | 0.04 | 35 | 0.539 | 0.03 | 24 |
| LYD913 | 84198.7 | — | — | — | 11.1 | 0.16 | 23 | — | — | — |
| LYD909 | 84174.2 | — | — | — | 11.8 | 0.06 | 31 | 0.492 | 0.20 | 14 |
| LYD909 | 84174.4 | — | — | — | 12.2 | 0.03 | 36 | 0.490 | 0.20 | 13 |
| LYD909 | 84177.1 | — | — | — | 10.7 | 0.24 | 19 | 0.480 | 0.30 | 11 |
| LYD909 | 84178.3 | — | — | — | 10.5 | 0.30 | 17 | — | — | — |
| LYD900 | 83738.10 | 0.786 | 0.20 | 21 | 11.6 | 0.08 | 29 | 0.489 | 0.23 | 13 |
| LYD900 | 83738.14 | — | — | — | 11.2 | 0.13 | 25 | 0.503 | 0.13 | 16 |
| LYD900 | 83738.8 | — | — | — | 12.9 | 0.02 | 44 | 0.536 | 0.04 | 24 |
| LYD898 | 83639.1 | — | — | — | 10.5 | 0.28 | 17 | — | — | — |
| LYD898 | 83640.1 | — | — | — | 11.9 | 0.06 | 32 | 0.498 | 0.18 | 15 |
| LYD898 | 83641.6 | — | — | — | 10.7 | 0.23 | 19 | — | — | — |
| LYD896 | 83659.2 | 0.775 | 0.25 | 19 | — | — | — | — | — | — |
| LYD896 | 83659.5 | — | — | — | — | — | — | 0.484 | 0.26 | 12 |
| LYD896 | 83661.2 | — | — | — | 10.5 | 0.29 | 17 | — | — | — |
| LYD896 | 83661.4 | 0.777 | 0.23 | 20 | 10.7 | 0.24 | 19 | 0.494 | 0.19 | 14 |
| LYD895 | 83535.4 | — | — | — | 11.0 | 0.17 | 22 | — | — | — |
| LYD893 | 83951.1 | — | — | — | 11.7 | 0.07 | 30 | — | — | — |
| LYD893 | 83952.5 | — | — | — | 11.4 | 0.10 | 27 | 0.520 | 0.06 | 20 |
| LYD893 | 83952.6 | — | — | — | 11.3 | 0.14 | 25 | — | — | — |
| LYD893 | 83952.7 | — | — | — | 11.0 | 0.17 | 22 | 0.496 | 0.17 | 14 |
| LYD886 | 83634.2 | — | — | — | 10.6 | 0.28 | 18 | 0.490 | 0.24 | 13 |
| LYD886 | 83635.4 | — | — | — | 11.1 | 0.16 | 23 | 0.504 | 0.13 | 16 |
| LYD886 | 83636.1 | — | — | — | 10.8 | 0.22 | 20 | — | — | — |
| LYD882 | 84061.1 | — | — | — | 11.9 | 0.05 | 32 | 0.507 | 0.11 | 17 |
| LYD882 | 84064.4 | — | — | — | 10.7 | 0.24 | 19 | — | — | — |
| LYD882 | 84065.7 | 0.785 | 0.19 | 21 | 10.9 | 0.20 | 21 | — | — | — |
| LYD871 | 83716.2 | — | — | — | — | — | — | 0.490 | 0.22 | 13 |
| LYD848 | 84290.3 | — | — | — | 12.2 | 0.03 | 35 | 0.488 | 0.23 | 13 |
| LYD848 | 84290.4 | 0.946 | 0.01 | 45 | 11.6 | 0.09 | 29 | — | — | — |
| LYD848 | 84292.5 | — | — | — | 11.2 | 0.13 | 25 | 0.491 | 0.21 | 13 |
| LYD786 | 84582.1 | — | — | — | 11.0 | 0.18 | 23 | 0.484 | 0.28 | 12 |
| LYD786 | 84585.4 | — | — | — | 10.5 | 0.29 | 17 | — | — | — |
| LYD746 | 83898.2 | 0.760 | 0.27 | 17 | 11.1 | 0.14 | 24 | — | — | — |
| LYD746 | 83902.2 | 0.759 | 0.28 | 17 | 12.0 | 0.06 | 33 | 0.493 | 0.21 | 14 |
| LYD746 | 83902.4 | — | — | — | 10.9 | 0.18 | 21 | 0.487 | 0.23 | 12 |
| LYD745 | 84261.1 | 0.780 | 0.23 | 20 | 10.6 | 0.27 | 17 | — | — | — |
| LYD745 | 84261.4 | — | — | — | 11.6 | 0.08 | 29 | 0.509 | 0.09 | 17 |
| LYD745 | 84262.1 | 0.771 | 0.25 | 19 | 13.8 | L | 54 | 0.541 | 0.02 | 25 |
| LYD745 | 84264.2 | — | — | — | 10.8 | 0.20 | 21 | 0.491 | 0.21 | 13 |
| LYD733 | 83768.3 | — | — | — | 11.8 | 0.06 | 31 | 0.496 | 0.17 | 15 |
| LYD717 | 84353.1 | 0.769 | 0.28 | 18 | — | — | — | — | — | — |
| LYD717 | 84356.2 | — | — | — | 12.2 | 0.03 | 36 | 0.497 | 0.15 | 15 |
| CONT. | — | 0.650 | — | — | 9.00 | — | — | 0.433 | — | — |
| LGP46 | 77256.1 | 0.906 | 0.04 | 30 | — | — | — | — | — | — |
| LGP46 | 77258.3 | 0.781 | 0.08 | 12 | — | — | — | — | — | — |
| LGP46 | 77259.6 | 0.805 | 0.17 | 15 | — | — | — | — | — | — |
| LGP46 | 77260.2 | 0.750 | 0.29 | 7 | — | — | — | — | — | — |
| LGP45 | 77196.1 | — | — | — | — | — | — | 0.544 | 0.26 | 4 |
| LGP45 | 77196.5 | 0.789 | 0.20 | 13 | — | — | — | — | — | — |
| LGP19 | 76938.3 | 0.805 | 0.21 | 15 | — | — | — | — | — | — |
| LGP19 | 76939.2 | 0.773 | 0.10 | 11 | — | — | — | — | — | — |
| LGP19 | 76940.1 | 0.820 | 0.17 | 18 | — | — | — | — | — | — |
| CONT. | — | 0.698 | — | — | — | — | — | 0.520 | — | — |
| LGP6 | 75670.2 | — | — | — | — | — | — | 0.466 | 0.21 | 5 |
| LGP32 | 75397.4 | — | — | — | 10.5 | 0.08 | 22 | 0.517 | 0.03 | 17 |
| LGP12 | 78567.3 | — | — | — | — | — | — | 0.488 | 0.08 | 10 |

TABLE 175-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | — | — | — | 8.60 | — | — | 0.443 | — | — |
| LGP74 | 81325.1 | 0.745 | 0.28 | 10 | — | — | — | — | — | — |
| LGP74 | 81328.3 | — | — | — | 11.3 | 0.05 | 19 | 0.451 | 0.09 | 9 |
| CONT. | — | 0.680 | — | — | 9.43 | — | — | 0.413 | — | — |
| LGP43 | 76953.2 | 0.680 | 0.17 | 22 | — | — | — | — | — | — |
| LGP43 | 76953.5 | 0.666 | 0.14 | 20 | — | — | — | — | — | — |
| CONT. | — | 0.557 | — | — | — | — | — | — | — | — |
| LGP74 | 81325.1 | — | — | — | 9.83 | 0.18 | 9 | 0.481 | 0.20 | 5 |
| LGP74 | 81328.3 | — | — | — | 10.8 | 0.16 | 20 | 0.505 | 0.12 | 10 |
| CONT. | — | — | — | — | 9.04 | — | — | 0.460 | — | — |
| LGP71 | 82503.1 | 0.613 | 0.13 | 8 | 8.80 | 0.08 | 38 | 0.477 | 0.22 | 19 |
| CONT. | — | 0.568 | — | — | 6.37 | — | — | 0.400 | — | — |
| LYD911 | 86503.1 | — | — | — | 13.0 | 0.22 | 21 | — | — | — |
| LYD904 | 84498.5 | — | — | — | 13.2 | 0.22 | 24 | — | — | — |
| LYD904 | 84499.2 | — | — | — | 14.5 | 0.05 | 35 | 0.576 | 0.06 | 20 |
| LYD902 | 84948.5 | — | — | — | 13.3 | 0.16 | 25 | 0.551 | 0.18 | 14 |
| LYD899 | 83723.8 | 0.786 | 0.26 | 16 | — | — | — | — | — | — |
| LYD867 | 85535.2 | — | — | — | 13.6 | 0.17 | 27 | 0.547 | 0.23 | 13 |
| LYD867 | 85536.5 | — | — | — | — | — | — | 0.538 | 0.24 | 12 |
| LYD844 | 85192.3 | — | — | — | 13.2 | 0.20 | 23 | 0.550 | 0.18 | 14 |
| LYD844 | 85192.7 | — | — | — | 12.7 | 0.28 | 19 | — | — | — |
| LYD844 | 85192.8 | — | — | — | 13.5 | 0.17 | 26 | — | — | — |
| LYD825 | 85882.4 | — | — | — | — | — | — | 0.554 | 0.19 | 15 |
| LYD825 | 85883.1 | — | — | — | 13.0 | 0.22 | 21 | 0.544 | 0.21 | 13 |
| LYD825 | 85884.2 | — | — | — | 12.7 | 0.29 | 18 | — | — | — |
| LYD812 | 85560.2 | — | — | — | 13.8 | 0.10 | 29 | 0.575 | 0.07 | 19 |
| LYD812 | 85564.1 | — | — | — | — | — | — | 0.539 | 0.27 | 12 |
| LYD778 | 85053.1 | — | — | — | — | — | — | 0.546 | 0.26 | 13 |
| LYD778 | 85053.2 | — | — | — | 13.7 | 0.13 | 28 | 0.608 | 0.02 | 26 |
| LYD778 | 85053.4 | — | — | — | 13.2 | 0.17 | 24 | 0.533 | 0.28 | 11 |
| LYD772 | 84526.1 | — | — | — | 13.1 | 0.20 | 22 | 0.555 | 0.17 | 15 |
| LYD772 | 84529.2 | — | — | — | — | — | — | 0.536 | 0.26 | 11 |
| LYD730 | 84258.1 | — | — | — | — | — | — | 0.577 | 0.07 | 20 |
| LYD711 | 85315.3 | — | — | — | 14.1 | 0.10 | 32 | 0.575 | 0.08 | 19 |
| LYD711 | 85316.3 | — | — | — | 13.8 | 0.11 | 29 | 0.573 | 0.09 | 19 |
| LYD711 | 85316.5 | — | — | — | 13.8 | 0.11 | 29 | 0.588 | 0.04 | 22 |
| CONT. | — | 0.677 | — | — | 10.7 | — | — | 0.482 | — | — |
| LGP1 | 76250.4 | 0.735 | 0.19 | 10 | — | — | — | — | — | — |
| CONT. | — | 0.669 | — | — | — | — | — | — | — | — |
| LGP71 | 82500.4 | 0.688 | 0.13 | 27 | — | — | — | — | — | — |
| LGP71 | 82502.4 | 0.690 | 0.11 | 27 | — | — | — | — | — | — |
| LGP71 | 82503.1 | 0.658 | 0.01 | 21 | 7.79 | 0.27 | 7 | — | — | — |
| LGP71 | 82503.2 | 0.682 | 0.13 | 26 | — | — | — | — | — | — |
| CONT. | — | 0.542 | — | — | 7.27 | — | — | — | — | — |
| LGP1 | 76249.3 | 0.689 | 0.30 | 6 | — | — | — | — | — | — |
| LGP1 | 76250.3 | 0.725 | 0.18 | 12 | — | — | — | — | — | — |
| CONT. | — | 0.649 | — | — | — | — | — | — | — | — |
| LGP34 | 75739.3 | — | — | — | 11.3 | 0.05 | 12 | — | — | — |
| CONT. | — | — | — | — | 10.1 | — | — | — | — | — |
| LYD922 | 83823.5 | 0.804 | 0.25 | 13 | — | — | — | — | — | — |
| LYD915 | 84657.1 | — | — | — | 14.9 | 0.21 | 21 | 0.656 | 0.14 | 18 |
| LYD913 | 84195.1 | — | — | — | 14.8 | 0.23 | 20 | 0.630 | 0.25 | 13 |
| LYD899 | 83721.2 | 0.816 | 0.21 | 14 | — | — | — | — | — | — |
| LYD893 | 83951.1 | 0.825 | 0.18 | 15 | — | — | — | — | — | — |
| LYD893 | 83952.6 | 0.803 | 0.29 | 12 | — | — | — | — | — | — |
| LYD848 | 84289.1 | 0.820 | 0.20 | 15 | 15.8 | 0.10 | 29 | — | — | — |
| LYD840 | 84085.2 | 0.812 | 0.24 | 14 | 14.8 | 0.23 | 20 | — | — | — |
| LYD833 | 83511.4 | 0.803 | 0.26 | 12 | — | — | — | — | — | — |
| LYD833 | 83512.2 | 0.805 | 0.28 | 13 | — | — | — | — | — | — |
| LYD833 | 83513.5 | — | — | — | 16.1 | 0.09 | 31 | — | — | — |
| LYD789 | 84132.2 | 0.810 | 0.24 | 13 | — | — | — | — | — | — |
| LYD746 | 83901.5 | 0.821 | 0.18 | 15 | — | — | — | — | — | — |
| LYD717 | 84356.2 | 0.807 | 0.24 | 13 | — | — | — | — | — | — |
| CONT. | — | 0.715 | — | — | 12.3 | — | — | 0.558 | — | — |
| LYD919 | 83642.2 | 0.824 | 0.07 | 20 | 12.5 | 0.23 | 18 | 0.598 | 0.04 | 18 |
| LYD919 | 83644.3 | — | — | — | — | — | — | 0.573 | 0.14 | 13 |
| LYD919 | 83646.1 | — | — | — | — | — | — | 0.567 | 0.19 | 12 |
| LYD900 | 83738.10 | 0.773 | 0.25 | 12 | — | — | — | — | — | — |
| LYD900 | 83738.11 | 0.806 | 0.12 | 17 | — | — | — | — | — | — |
| LYD898 | 83641.6 | 0.773 | 0.23 | 12 | — | — | — | — | — | — |
| LYD894 | 84361.1 | 0.771 | 0.27 | 12 | — | — | — | — | — | — |

TABLE 175-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD886 | 83634.2 | 0.772 | 0.24 | 12 | — | — | — | — | — | — |
| LYD886 | 83636.1 | 0.870 | 0.02 | 26 | — | — | — | 0.556 | 0.25 | 10 |
| LYD883 | 83912.3 | — | — | — | 13.3 | 0.10 | 25 | 0.590 | 0.07 | 17 |
| LYD882 | 84065.1 | 0.815 | 0.10 | 18 | — | — | — | — | — | — |
| LYD871 | 83716.2 | — | — | — | 12.5 | 0.23 | 17 | — | — | — |
| LYD871 | 83716.4 | 0.766 | 0.27 | 11 | — | — | — | — | — | — |
| LYD871 | 83718.6 | — | — | — | 12.9 | 0.14 | 22 | 0.555 | 0.25 | 9 |
| LYD865 | 83731.1 | — | — | — | 13.4 | 0.09 | 26 | 0.572 | 0.14 | 13 |
| LYD839 | 83521.1 | 0.769 | 0.29 | 12 | — | — | — | — | — | — |
| LYD811 | 83713.3 | 0.772 | 0.24 | 12 | 12.6 | 0.21 | 18 | 0.587 | 0.07 | 16 |
| LYD793 | 83499.7 | — | — | — | — | — | — | 0.571 | 0.14 | 13 |
| LYD777 | 83489.3 | 0.835 | 0.05 | 21 | 12.6 | 0.21 | 18 | — | — | — |
| LYD777 | 83492.3 | 0.778 | 0.20 | 13 | — | — | — | — | — | — |
| LYD772 | 84529.2 | 0.774 | 0.22 | 12 | — | — | — | 0.557 | 0.24 | 10 |
| LYD772 | 84529.3 | — | — | — | 12.3 | 0.29 | 16 | — | — | — |
| LYD748 | 84919.1 | 0.792 | 0.15 | 15 | — | — | — | — | — | — |
| LYD747 | 85011.3 | 0.773 | 0.25 | 12 | — | — | — | — | — | — |
| LYD745 | 84262.1 | — | — | — | — | — | — | 0.555 | 0.29 | 10 |
| LYD745 | 84263.1 | — | — | — | — | — | — | 0.565 | 0.19 | 12 |
| LYD745 | 84264.2 | 0.771 | 0.24 | 12 | — | — | — | — | — | — |
| CONT. | — | 0.688 | — | — | 10.6 | — | — | 0.507 | — | — |
| LGP9 | 75515.1 | 0.684 | 0.02 | 17 | — | — | — | — | — | — |
| LGP44 | 75763.3 | 0.640 | 0.26 | 9 | — | — | — | — | — | — |
| LGP44 | 75765.3 | 0.700 | 0.02 | 20 | — | — | — | — | — | — |
| LGP10 | 75385.3 | 0.734 | 0.03 | 25 | — | — | — | — | — | — |
| CONT. | — | 0.585 | — | — | — | — | — | — | — | — |
| LGP46 | 77258.3 | 0.644 | 0.07 | 12 | — | — | — | — | — | — |
| LGP46 | 77259.3 | 0.645 | 0.14 | 12 | — | — | — | — | — | — |
| LGP46 | 77259.6 | 0.606 | 0.27 | 5 | — | — | — | — | — | — |
| LGP45 | 77196.6 | 0.660 | 0.15 | 15 | — | — | — | — | — | — |
| LGP45 | 77197.4 | 0.637 | 0.25 | 11 | — | — | — | — | — | — |
| LGP19 | 76940.2 | 0.603 | 0.07 | 5 | — | — | — | — | — | — |
| CONT. | — | 0.576 | — | — | — | — | — | — | — | — |
| LGP48 | 77204.6 | 0.786 | 0.29 | 6 | — | — | — | — | — | — |
| CONT. | — | 0.739 | — | — | — | — | — | — | — | — |

Table 175. "CONT."—Control; "Ave."—Average; "% Incr." = % increment; "p-val."—p-value, L- p < 0.01. RGR = relative growth rate.

TABLE 176

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGP77 | 81452.2 | — | — | — | 7.03 | 0.06 | 18 | 4.78 | 0.02 | 8 |
| LGP77 | 81453.3 | 0.254 | 0.28 | 9 | — | — | — | — | — | — |
| LGP77 | 81456.3 | — | — | — | — | — | — | 4.59 | 0.17 | 3 |
| CONT. | — | 0.234 | — | — | 5.97 | — | — | 4.44 | — | — |
| LGP52 | 76963.1 | — | — | — | 11.6 | 0.23 | 9 | 5.72 | 0.13 | 6 |
| LGP52 | 76965.2 | — | — | — | 11.5 | 0.24 | 8 | 5.65 | 0.27 | 5 |
| CONT. | — | — | — | — | 10.6 | — | — | 5.38 | — | — |
| LGP58 | 76972.1 | 0.340 | 0.14 | 14 | — | — | — | — | — | — |
| LGP47 | 76957.1 | 0.334 | 0.17 | 12 | — | — | — | — | — | — |
| LGP47 | 76960.3 | 0.342 | 0.08 | 15 | — | — | — | — | — | — |
| CONT. | — | 0.298 | — | — | — | — | — | — | — | — |
| LYD930 | 83833.4 | 0.396 | L | 30 | — | — | — | — | — | — |
| LYD930 | 83834.3 | — | — | — | — | — | — | 5.97 | 0.24 | 4 |
| LYD881 | 84058.5 | — | — | — | 13.3 | 0.23 | 10 | 6.15 | 0.13 | 8 |
| LYD877 | 83630.3 | — | — | — | 15.0 | L | 24 | 6.54 | L | 14 |
| LYD877 | 83630.4 | — | — | — | 14.1 | 0.13 | 16 | 6.32 | 0.07 | 11 |
| LYD863 | 83810.7 | — | — | — | — | — | — | 6.22 | 0.28 | 9 |
| LYD846 | 83531.4 | — | — | — | 13.0 | 0.29 | 8 | 6.06 | 0.13 | 6 |
| LYD846 | 83533.1 | 0.348 | 0.19 | 14 | — | — | — | — | — | — |
| LYD831 | 83803.1 | — | — | — | 13.1 | 0.25 | 8 | 6.14 | 0.06 | 7 |

TABLE 176-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD831 | 83803.3 | — | — | — | 13.4 | 0.15 | 11 | 6.14 | 0.06 | 7 |
| LYD831 | 83803.5 | — | — | — | 13.1 | 0.26 | 8 | 6.07 | 0.10 | 6 |
| LYD788 | 83798.4 | — | — | — | 14.9 | 0.12 | 23 | 6.49 | 0.03 | 13 |
| LYD788 | 83800.4 | 0.337 | 0.21 | 10 | — | — | — | — | — | — |
| LYD788 | 83800.5 | — | — | — | 13.6 | 0.10 | 13 | 6.19 | 0.08 | 8 |
| LYD783 | 84170.1 | 0.368 | 0.02 | 21 | — | — | — | — | — | — |
| LYD783 | 84170.3 | 0.371 | 0.13 | 22 | 13.8 | 0.08 | 14 | 6.12 | 0.10 | 7 |
| LYD779 | 83704.2 | — | — | — | 13.6 | 0.10 | 12 | 6.11 | 0.08 | 7 |
| LYD779 | 83708.2 | — | — | — | 13.9 | 0.06 | 15 | 6.29 | 0.02 | 10 |
| LYD779 | 83708.4 | — | — | — | — | — | — | 6.24 | 0.19 | 9 |
| LYD776 | 83944.1 | 0.361 | 0.16 | 18 | — | — | — | — | — | — |
| LYD776 | 83947.1 | — | — | — | 13.2 | 0.25 | 9 | 6.09 | 0.18 | 7 |
| LYD776 | 83947.6 | 0.329 | 0.29 | 8 | — | — | — | — | — | — |
| LYD764 | 83479.4 | — | — | — | 15.1 | 0.06 | 25 | 6.67 | L | 17 |
| LYD764 | 83480.1 | — | — | — | — | — | — | 6.29 | 0.22 | 10 |
| LYD731 | 83456.1 | — | — | — | 14.0 | 0.24 | 15 | 6.25 | 0.17 | 9 |
| LYD731 | 83458.1 | — | — | — | — | — | — | 6.06 | 0.19 | 6 |
| LYD715 | 84155.5 | — | — | — | — | — | — | 6.00 | 0.21 | 5 |
| LYD715 | 84158.1 | — | — | — | — | — | — | 6.17 | 0.20 | 8 |
| LYD715 | 84158.3 | — | — | — | 14.0 | 0.05 | 15 | 6.21 | 0.03 | 9 |
| LYD713 | 83786.4 | 0.351 | 0.19 | 15 | 14.3 | 0.17 | 18 | — | — | — |
| LYD713 | 83788.3 | — | — | — | 15.0 | L | 24 | 6.41 | L | 12 |
| LYD710 | 83895.3 | — | — | — | — | — | — | 6.15 | 0.29 | 8 |
| LYD710 | 83895.6 | — | — | — | 14.4 | 0.03 | 19 | 6.35 | 0.04 | 11 |
| LYD710 | 83896.1 | — | — | — | 14.0 | 0.21 | 16 | 6.16 | 0.20 | 8 |
| LYD708 | 83451.6 | — | — | — | — | — | — | 6.09 | 0.12 | 7 |
| LYD708 | 83451.7 | — | — | — | 14.1 | 0.21 | 17 | 6.36 | 0.14 | 11 |
| LYD700 | 84151.1 | — | — | — | — | — | — | 6.11 | 0.12 | 7 |
| LYD700 | 84151.4 | 0.378 | 0.01 | 24 | — | — | — | — | — | — |
| LYD698 | 83780.4 | — | — | — | 14.0 | 0.04 | 16 | 6.20 | 0.04 | 8 |
| CONT. | — | 0.305 | — | — | 12.1 | — | — | 5.72 | — | — |
| LGP77 | 81452.2 | — | — | — | 5.22 | 0.20 | 12 | 4.32 | 0.24 | 8 |
| LGP77 | 81453.3 | — | — | — | 4.94 | 0.16 | 6 | 4.13 | 0.30 | 3 |
| CONT. | — | — | — | — | 4.64 | — | — | 4.00 | — | — |
| LGP73 | 81449.7 | — | — | — | — | — | — | 4.66 | 0.15 | 3 |
| LGP73 | 81449.8 | — | — | — | 8.66 | L | 24 | 5.01 | L | 11 |
| CONT. | — | — | — | — | 7.00 | — | — | 4.51 | — | — |
| LYD930 | 83832.3 | — | — | — | 10.2 | 0.24 | 26 | 5.25 | 0.20 | 12 |
| LYD930 | 83834.3 | — | — | — | 9.54 | 0.13 | 18 | 5.01 | 0.19 | 7 |
| LYD881 | 84058.2 | — | — | — | — | — | — | 4.95 | 0.13 | 6 |
| LYD877 | 83631.2 | 0.326 | 0.13 | 18 | — | — | — | — | — | — |
| LYD863 | 83810.7 | — | — | — | 9.53 | 0.05 | 17 | 4.99 | 0.26 | 7 |
| LYD846 | 83531.3 | — | — | — | 8.81 | 0.29 | 9 | — | — | — |
| LYD831 | 83803.3 | — | — | — | 9.37 | 0.07 | 15 | 5.09 | 0.04 | 9 |
| LYD831 | 83803.5 | 0.333 | 0.02 | 21 | — | — | — | — | — | — |
| LYD831 | 83803.6 | 0.319 | 0.10 | 16 | — | — | — | — | — | — |
| LYD788 | 83800.4 | 0.316 | 0.11 | 15 | 10.2 | 0.01 | 25 | 5.28 | L | 13 |
| LYD788 | 83800.5 | 0.342 | L | 24 | — | — | — | — | — | — |
| LYD783 | 84170.1 | — | — | — | 9.32 | 0.22 | 15 | 5.04 | 0.11 | 8 |
| LYD783 | 84170.3 | — | — | — | 8.95 | 0.24 | 10 | — | — | — |
| LYD783 | 84172.2 | 0.317 | 0.07 | 15 | — | — | — | — | — | — |
| LYD779 | 83704.2 | — | — | — | 9.36 | 0.07 | 15 | 4.96 | 0.13 | 6 |
| LYD779 | 83708.2 | — | — | — | 9.07 | 0.18 | 12 | — | — | — |
| LYD776 | 83947.4 | 0.304 | 0.14 | 10 | — | — | — | — | — | — |
| LYD764 | 83479.4 | — | — | — | 9.03 | 0.15 | 11 | 4.97 | 0.20 | 6 |
| LYD764 | 83483.1 | — | — | — | 9.82 | 0.03 | 21 | 5.10 | 0.03 | 9 |
| LYD740 | 83462.1 | — | — | — | 8.82 | 0.26 | 9 | 4.93 | 0.16 | 5 |
| LYD731 | 83456.1 | 0.363 | 0.04 | 31 | — | — | — | — | — | — |
| LYD715 | 84155.5 | — | — | — | 10.7 | 0.10 | 32 | 5.43 | 0.12 | 16 |
| LYD715 | 84158.1 | — | — | — | 10.4 | 0.29 | 29 | — | — | — |
| LYD715 | 84158.3 | — | — | — | 9.02 | 0.16 | 11 | 4.93 | 0.16 | 5 |
| LYD713 | 83788.3 | — | — | — | 9.04 | 0.15 | 11 | — | — | — |
| LYD713 | 83789.3 | 0.359 | 0.25 | 30 | 8.94 | 0.25 | 10 | — | — | — |
| LYD708 | 83451.5 | 0.329 | 0.24 | 19 | — | — | — | — | — | — |
| LYD698 | 83776.2 | 0.313 | 0.24 | 13 | — | — | — | — | — | — |
| LYD698 | 83780.3 | 0.373 | 0.13 | 35 | — | — | — | — | — | — |
| CONT. | — | 0.276 | — | — | 8.12 | — | — | 4.68 | — | — |
| LGP49 | 77652.6 | — | — | — | 14.2 | 0.22 | 11 | — | — | — |
| CONT. | — | — | — | — | 12.8 | — | — | — | — | — |
| LYD919 | 83642.2 | — | — | — | 11.4 | 0.09 | 33 | 5.69 | 0.02 | 18 |
| LYD919 | 83644.3 | — | — | — | 9.36 | 0.22 | 9 | — | — | — |

TABLE 176-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD919 | 83645.1 | 0.334 | 0.28 | 9 | 9.79 | 0.07 | 14 | 5.08 | 0.17 | 5 |
| LYD913 | 84195.2 | — | — | — | 9.48 | 0.27 | 11 | — | — | — |
| LYD913 | 84198.4 | — | — | — | 9.64 | 0.08 | 12 | — | — | — |
| LYD913 | 84198.7 | 0.359 | 0.04 | 17 | 10.6 | 0.24 | 24 | — | — | — |
| LYD909 | 84174.2 | — | — | — | 11.3 | 0.15 | 31 | 5.43 | 0.05 | 12 |
| LYD909 | 84174.4 | — | — | — | 11.6 | L | 35 | 5.45 | L | 13 |
| LYD909 | 84177.1 | — | — | — | 10.2 | 0.02 | 19 | 5.32 | 0.02 | 10 |
| LYD909 | 84178.3 | — | — | — | 9.95 | 0.03 | 16 | 5.14 | 0.22 | 6 |
| LYD900 | 83738.10 | — | — | — | 11.0 | 0.06 | 29 | 5.46 | 0.02 | 13 |
| LYD900 | 83738.14 | — | — | — | 10.7 | 0.09 | 24 | 5.41 | 0.07 | 12 |
| LYD900 | 83738.8 | — | — | — | 12.4 | 0.18 | 44 | 5.95 | 0.14 | 23 |
| LYD898 | 83640.1 | — | — | — | 11.3 | 0.22 | 32 | 5.48 | 0.20 | 13 |
| LYD898 | 83641.5 | — | — | — | — | — | — | 5.06 | 0.27 | 4 |
| LYD898 | 83641.6 | — | — | — | 10.2 | 0.02 | 19 | 5.17 | 0.08 | 7 |
| LYD898 | 83641.8 | — | — | — | — | — | — | 5.10 | 0.24 | 5 |
| LYD896 | 83659.5 | — | — | — | 9.59 | 0.16 | 12 | 5.20 | 0.06 | 8 |
| LYD896 | 83661.2 | — | — | — | 10.00 | 0.10 | 17 | 5.13 | 0.29 | 6 |
| LYD896 | 83661.4 | — | — | — | 10.1 | 0.02 | 18 | 5.32 | 0.03 | 10 |
| LYD895 | 83535.4 | — | — | — | 10.5 | 0.10 | 23 | 5.19 | 0.16 | 7 |
| LYD893 | 83951.1 | 0.332 | 0.26 | 8 | 11.1 | L | 29 | 5.39 | 0.01 | 11 |
| LYD893 | 83952.5 | — | — | — | 10.8 | 0.02 | 26 | 5.52 | L | 14 |
| LYD893 | 83952.6 | — | — | — | 10.7 | 0.25 | 25 | 5.24 | 0.23 | 8 |
| LYD893 | 83952.7 | — | — | — | 10.5 | 0.14 | 23 | 5.42 | 0.05 | 12 |
| LYD886 | 83634.2 | — | — | — | — | — | — | 5.26 | 0.19 | 9 |
| LYD886 | 83635.4 | 0.343 | 0.21 | 12 | 10.5 | 0.03 | 23 | 5.43 | 0.12 | 12 |
| LYD886 | 83636.1 | — | — | — | 10.2 | 0.19 | 19 | — | — | — |
| LYD882 | 84061.1 | — | — | — | 11.3 | 0.04 | 32 | 5.60 | L | 16 |
| LYD882 | 84064.4 | — | — | — | 10.3 | 0.10 | 20 | 5.20 | 0.06 | 7 |
| LYD882 | 84065.7 | — | — | — | 10.4 | 0.08 | 21 | — | — | — |
| LYD871 | 83715.4 | — | — | — | 9.66 | 0.07 | 13 | 5.22 | 0.06 | 8 |
| LYD871 | 83716.2 | — | — | — | 9.71 | 0.07 | 13 | 5.30 | 0.10 | 9 |
| LYD871 | 83716.4 | — | — | — | — | — | — | 5.17 | 0.24 | 7 |
| LYD871 | 83718.6 | — | — | — | 9.79 | 0.07 | 14 | 5.19 | 0.06 | 7 |
| LYD848 | 84290.3 | — | — | — | 11.6 | L | 35 | 5.54 | L | 14 |
| LYD848 | 84290.4 | — | — | — | 11.1 | 0.29 | 29 | 5.33 | 0.26 | 10 |
| LYD848 | 84292.5 | — | — | — | 10.7 | L | 25 | 5.40 | 0.01 | 12 |
| LYD840 | 84085.2 | — | — | — | 9.57 | 0.19 | 12 | 5.15 | 0.12 | 7 |
| LYD840 | 84085.4 | — | — | — | 9.46 | 0.13 | 10 | 5.10 | 0.18 | 5 |
| LYD786 | 84582.2 | — | — | — | 9.42 | 0.17 | 10 | — | — | — |
| LYD786 | 84584.4 | — | — | — | 9.57 | 0.15 | 12 | 5.11 | 0.29 | 6 |
| LYD786 | 84585.3 | — | — | — | — | — | — | 5.13 | 0.11 | 6 |
| LYD786 | 84585.4 | — | — | — | 10.0 | 0.04 | 17 | 5.28 | 0.04 | 9 |
| LYD746 | 83898.2 | — | — | — | 10.6 | L | 24 | 5.30 | 0.03 | 10 |
| LYD746 | 83902.2 | — | — | — | 11.4 | 0.14 | 33 | 5.53 | 0.28 | 14 |
| LYD746 | 83902.4 | — | — | — | 10.4 | 0.01 | 21 | 5.28 | 0.04 | 9 |
| LYD745 | 84261.1 | — | — | — | 10.1 | 0.16 | 18 | — | — | — |
| LYD745 | 84261.4 | — | — | — | 11.0 | L | 29 | 5.51 | L | 14 |
| LYD745 | 84262.1 | — | — | — | 13.1 | L | 53 | 5.88 | L | 21 |
| LYD745 | 84264.2 | 0.349 | 0.08 | 14 | 10.4 | 0.01 | 21 | 5.39 | 0.22 | 11 |
| LYD733 | 83766.2 | — | — | — | 9.46 | 0.14 | 10 | 5.06 | 0.20 | 5 |
| LYD733 | 83766.5 | — | — | — | — | — | — | 5.10 | 0.14 | 5 |
| LYD733 | 83768.3 | 0.351 | 0.07 | 14 | 11.2 | L | 30 | 5.46 | L | 13 |
| LYD717 | 84353.1 | — | — | — | 9.75 | 0.09 | 14 | 5.14 | 0.11 | 6 |
| LYD717 | 84354.2 | — | — | — | 9.55 | 0.10 | 11 | 5.09 | 0.15 | 5 |
| LYD717 | 84356.2 | — | — | — | 11.6 | L | 35 | 5.52 | L | 14 |
| CONT. | — | 0.307 | — | — | 8.57 | — | — | 4.84 | — | — |
| LGP46 | 77260.2 | 0.414 | 0.03 | 18 | — | — | — | — | — | — |
| LGP19 | 76939.2 | 0.376 | 0.22 | 7 | — | — | — | — | — | — |
| LGP19 | 76940.1 | 0.377 | 0.20 | 7 | — | — | — | — | — | — |
| CONT. | — | 0.351 | — | — | — | — | — | — | — | — |
| LGP32 | 75397.4 | 0.225 | 0.03 | 25 | 10.2 | 0.08 | 20 | 5.62 | 0.05 | 11 |
| LGP12 | 78567.3 | — | — | — | — | — | — | 5.37 | 0.23 | 6 |
| CONT. | — | 0.180 | — | — | 8.44 | — | — | 5.06 | — | — |
| LGP74 | 81328.3 | — | — | — | 11.8 | 0.06 | 18 | 5.60 | 0.15 | 7 |
| CONT. | — | — | — | — | 9.97 | — | — | 5.24 | — | — |
| LGP43 | 76951.2 | 0.275 | 0.28 | 9 | — | — | — | — | — | — |
| LGP43 | 76953.2 | 0.283 | 0.12 | 12 | — | — | — | — | — | — |
| CONT. | — | 0.253 | — | — | — | — | — | — | — | — |
| LGP74 | 81325.1 | — | — | — | 9.66 | 0.20 | 8 | 5.53 | 0.12 | 4 |
| LGP74 | 81326.4 | 0.352 | 0.07 | 26 | — | — | — | — | — | — |
| LGP74 | 81328.3 | — | — | — | 10.6 | 0.15 | 19 | 5.81 | 0.12 | 9 |

TABLE 176-continued

Genes showing improved plant performance at Normal growth conditions under regulation of At6669 promoter

| Gene Name | Event # | Harvest Index Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| CONT. | — | 0.281 | — | — | 8.92 | — | — | 5.34 | — | — |
| LGP71 | 82503.1 | — | — | — | 8.52 | 0.06 | 38 | 5.29 | 0.12 | 18 |
| CONT. | — | — | — | — | 6.19 | — | — | 4.50 | — | — |
| LYD911 | 86503.1 | — | — | — | 12.7 | 0.04 | 21 | 5.94 | 0.16 | 7 |
| LYD907 | 84976.1 | — | — | — | 12.0 | 0.10 | 14 | 6.02 | 0.08 | 8 |
| LYD904 | 84497.2 | — | — | — | 11.8 | 0.11 | 12 | 5.94 | 0.18 | 7 |
| LYD904 | 84499.2 | — | — | — | 14.0 | L | 33 | 6.37 | L | 15 |
| LYD902 | 84948.5 | — | — | — | 13.2 | 0.28 | 25 | 6.36 | 0.21 | 14 |
| LYD899 | 83723.8 | — | — | — | — | — | — | 6.03 | 0.18 | 8 |
| LYD867 | 85536.5 | — | — | — | 11.4 | 0.24 | 8 | 5.96 | 0.05 | 7 |
| LYD844 | 85192.1 | — | — | — | 11.7 | 0.16 | 12 | 6.00 | 0.04 | 8 |
| LYD844 | 85192.3 | — | — | — | — | — | — | 6.08 | 0.26 | 9 |
| LYD844 | 85192.7 | — | — | — | 12.4 | 0.03 | 18 | 5.99 | 0.04 | 8 |
| LYD825 | 85883.1 | — | — | — | 12.5 | 0.02 | 19 | 6.00 | 0.04 | 8 |
| LYD825 | 85884.2 | — | — | — | 12.4 | 0.03 | 18 | 5.95 | 0.08 | 7 |
| LYD812 | 85560.1 | — | — | — | 11.4 | 0.25 | 9 | — | — | — |
| LYD812 | 85560.2 | — | — | — | 13.4 | L | 28 | 6.27 | 0.01 | 13 |
| LYD812 | 85564.1 | — | — | — | 11.8 | 0.30 | 12 | — | — | — |
| LYD778 | 85053.2 | — | — | — | — | — | — | 6.58 | 0.18 | 18 |
| LYD778 | 85053.3 | — | — | — | 11.5 | 0.21 | 9 | 5.93 | 0.07 | 7 |
| LYD778 | 85053.4 | — | — | — | 12.9 | 0.14 | 23 | 5.95 | 0.06 | 7 |
| LYD772 | 84526.1 | — | — | — | 12.7 | 0.29 | 21 | — | — | — |
| LYD772 | 84529.2 | — | — | — | — | — | — | 6.04 | 0.03 | 9 |
| LYD718 | 85457.1 | — | — | — | — | — | — | 6.07 | 0.08 | 9 |
| LYD711 | 85315.3 | — | — | — | — | — | — | 6.31 | 0.30 | 14 |
| LYD711 | 85316.3 | — | — | — | 13.4 | 0.25 | 27 | 6.29 | 0.25 | 13 |
| LYD711 | 85316.5 | — | — | — | 13.6 | 0.21 | 29 | 6.49 | 0.16 | 17 |
| CONT. | — | — | — | — | 10.5 | — | — | 5.56 | — | — |
| LGP71 | 82503.1 | — | — | — | 6.15 | 0.13 | 10 | 4.52 | 0.17 | 6 |
| CONT. | — | — | — | — | 5.57 | — | — | 4.26 | — | — |
| LGP1 | 76248.1 | 0.371 | 0.27 | 9 | — | — | — | — | — | — |
| LGP1 | 76249.3 | 0.367 | 0.22 | 7 | — | — | — | — | — | — |
| CONT. | — | 0.341 | — | — | — | — | — | — | — | — |
| LYD929 | 83647.2 | 0.353 | 0.15 | 10 | — | — | — | — | — | — |
| LYD929 | 83651.2 | — | — | — | 13.3 | 0.12 | 10 | — | — | — |
| LYD922 | 83823.6 | — | — | — | 13.3 | 0.11 | 11 | — | — | — |
| LYD915 | 84657.1 | — | — | — | 14.3 | 0.30 | 19 | 6.92 | 0.11 | 14 |
| LYD915 | 84658.1 | 0.381 | 0.02 | 19 | — | — | — | — | — | — |
| LYD915 | 84659.1 | 0.367 | 0.30 | 14 | — | — | — | — | — | — |
| LYD913 | 84195.1 | — | — | — | 14.3 | 0.03 | 19 | 6.76 | 0.10 | 12 |
| LYD913 | 84198.1 | 0.344 | 0.30 | 7 | — | — | — | — | — | — |
| LYD913 | 84198.4 | 0.347 | 0.26 | 8 | — | — | — | — | — | — |
| LYD909 | 84174.1 | — | — | — | 13.7 | 0.22 | 14 | — | — | — |
| LYD909 | 84177.1 | 0.359 | 0.10 | 12 | — | — | — | — | — | — |
| LYD899 | 83722.1 | 0.366 | 0.06 | 14 | — | — | — | — | — | — |
| LYD895 | 83535.3 | 0.367 | 0.06 | 14 | — | — | — | — | — | — |
| LYD895 | 83537.3 | 0.378 | 0.04 | 18 | — | — | — | — | — | — |
| LYD895 | 83537.4 | 0.363 | 0.28 | 13 | — | — | — | — | — | — |
| LYD893 | 83950.1 | — | — | — | 13.5 | 0.24 | 12 | — | — | — |
| LYD893 | 83952.5 | — | — | — | 13.4 | 0.09 | 12 | — | — | — |
| LYD848 | 84289.1 | — | — | — | 15.2 | 0.07 | 26 | 6.66 | 0.10 | 10 |
| LYD840 | 84085.2 | — | — | — | 14.3 | 0.02 | 19 | 6.53 | 0.22 | 8 |
| LYD833 | 83511.1 | 0.365 | 0.10 | 14 | — | — | — | — | — | — |
| LYD833 | 83513.5 | — | — | — | 15.6 | L | 30 | 6.60 | 0.03 | 9 |
| LYD821 | 84054.2 | — | — | — | 12.9 | 0.25 | 7 | — | — | — |
| LYD821 | 84054.5 | 0.355 | 0.14 | 11 | — | — | — | — | — | — |
| LYD789 | 84132.3 | — | — | — | 12.8 | 0.28 | 7 | — | — | — |
| LYD733 | 83768.1 | 0.376 | 0.03 | 17 | — | — | — | — | — | — |
| LYD717 | 84356.2 | 0.400 | 0.02 | 25 | — | — | — | — | — | — |
| LYD704 | 83785.2 | — | — | — | — | — | — | 6.29 | 0.27 | 4 |
| LYD704 | 83785.5 | 0.425 | 0.05 | 32 | — | — | — | — | — | — |
| CONT. | — | 0.321 | — | — | 12.0 | — | — | 6.05 | — | — |
| LGP52 | 76963.1 | — | — | — | 13.0 | 0.28 | 12 | 6.00 | 0.17 | 7 |
| CONT. | — | — | — | — | 11.6 | — | — | 5.59 | — | — |
| LYD919 | 83642.2 | — | — | — | 12.0 | L | 17 | 6.18 | 0.02 | 12 |
| LYD919 | 83644.3 | — | — | — | 11.2 | 0.28 | 9 | 5.98 | 0.18 | 9 |
| LYD919 | 83646.1 | — | — | — | 11.4 | 0.20 | 11 | — | — | — |
| LYD898 | 83641.5 | — | — | — | 11.3 | 0.24 | 10 | 5.96 | 0.07 | 8 |
| LYD898 | 83641.8 | 0.379 | 0.22 | 18 | 11.7 | 0.14 | 14 | — | — | — |
| LYD894 | 84361.1 | — | — | — | — | — | — | 5.69 | 0.15 | 3 |
| LYD894 | 84362.1 | 0.359 | 0.17 | 12 | — | — | — | — | — | — |

TABLE 176-continued

Genes showing improved plant performance at Normal growth conditions under regulation of At6669 promoter

| Gene Name | Event # | Harvest Index | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD894 | 84362.2 | 0.364 | 0.28 | 14 | 10.9 | 0.11 | 7 | 5.67 | 0.09 | 3 |
| LYD894 | 84362.3 | — | — | — | — | — | — | 5.61 | 0.25 | 2 |
| LYD886 | 83634.2 | — | — | — | 10.9 | 0.17 | 6 | 5.64 | 0.14 | 3 |
| LYD886 | 83634.3 | 0.380 | 0.08 | 19 | 11.0 | 0.26 | 7 | — | — | — |
| LYD886 | 83636.1 | — | — | — | 11.6 | L | 14 | 5.88 | 0.07 | 7 |
| LYD886 | 83636.3 | 0.353 | 0.24 | 10 | — | — | — | — | — | — |
| LYD883 | 83911.4 | — | — | — | — | — | — | 5.63 | 0.28 | 2 |
| LYD883 | 83912.3 | — | — | — | 12.7 | L | 24 | 6.28 | L | 14 |
| LYD882 | 84064.4 | 0.371 | 0.25 | 16 | — | — | — | — | — | — |
| LYD882 | 84065.1 | — | — | — | 11.3 | 0.06 | 10 | 5.83 | 0.17 | 6 |
| LYD871 | 83716.2 | 0.379 | 0.06 | 18 | 12.0 | 0.03 | 17 | 5.86 | 0.18 | 7 |
| LYD871 | 83718.6 | — | — | — | 12.5 | 0.09 | 22 | 6.12 | L | 11 |
| LYD865 | 83731.1 | — | — | — | 12.9 | 0.10 | 26 | 6.17 | 0.19 | 12 |
| LYD865 | 83733.5 | — | — | — | 11.0 | 0.09 | 8 | 5.65 | 0.15 | 3 |
| LYD839 | 83522.1 | — | — | — | 10.7 | 0.30 | 4 | — | — | — |
| LYD811 | 83711.4 | — | — | — | 11.0 | 0.29 | 8 | 5.73 | 0.05 | 4 |
| LYD811 | 83713.3 | — | — | — | 12.0 | 0.11 | 17 | 6.04 | 0.12 | 10 |
| LYD793 | 83499.2 | — | — | — | 11.5 | 0.02 | 12 | 5.88 | 0.06 | 7 |
| LYD793 | 83499.7 | — | — | — | 11.1 | 0.07 | 8 | — | — | — |
| LYD793 | 83500.4 | 0.367 | 0.10 | 15 | — | — | — | — | — | — |
| LYD786 | 84582.1 | 0.360 | 0.16 | 12 | — | — | — | — | — | — |
| LYD786 | 84582.2 | 0.356 | 0.26 | 11 | — | — | — | — | — | — |
| LYD777 | 83489.3 | — | — | — | 12.1 | L | 18 | 5.92 | L | 8 |
| LYD777 | 83492.3 | — | — | — | 11.1 | 0.06 | 8 | — | — | — |
| LYD777 | 83493.3 | — | — | — | 10.7 | 0.25 | 5 | — | — | — |
| LYD772 | 84526.1 | — | — | — | 10.8 | 0.14 | 6 | 5.61 | 0.25 | 2 |
| LYD772 | 84529.1 | 0.368 | 0.16 | 15 | — | — | — | — | — | — |
| LYD772 | 84529.2 | — | — | — | 11.5 | 0.21 | 12 | 5.85 | L | 6 |
| LYD772 | 84529.3 | 0.361 | 0.20 | 12 | — | — | — | — | — | — |
| LYD748 | 84918.3 | — | — | — | — | — | — | 5.64 | 0.15 | 2 |
| LYD748 | 84919.4 | — | — | — | — | — | — | 5.69 | 0.15 | 3 |
| LYD747 | 85011.1 | — | — | — | — | — | — | 5.84 | 0.18 | 6 |
| LYD747 | 85011.3 | — | — | — | 10.7 | 0.25 | 5 | 5.67 | 0.09 | 3 |
| LYD747 | 85014.1 | — | — | — | — | — | — | 5.61 | 0.25 | 2 |
| LYD745 | 84261.1 | — | — | — | 11.2 | 0.12 | 9 | 5.73 | 0.04 | 4 |
| LYD745 | 84262.1 | — | — | — | 11.8 | 0.10 | 16 | 5.97 | L | 9 |
| LYD745 | 84263.1 | — | — | — | 11.7 | 0.05 | 14 | 6.15 | L | 12 |
| CONT. | — | 0.321 | — | — | 10.2 | — | — | 5.50 | — | — |
| LGP46 | 77258.3 | 0.354 | 0.20 | 8 | — | — | — | — | — | — |
| CONT. | — | 0.327 | — | — | — | — | — | — | — | — |
| LGP47 | 76956.1 | 0.350 | 0.13 | 17 | — | — | — | — | — | — |
| CONT. | — | 0.300 | — | — | — | — | — | — | — | — |

Table 176. "CONT."—Control; "Ave."—Average; "% Incr." = % increment; "p-val."—p-value, L- $p < 0.01$.

TABLE 177

Genes showing improved plant performance at Normal growth conditions under regulation of At6669 promoter

| Gene Name | Event # | Seed Yield [mg] | | | 1000 Seed Weight [mg] | | |
|---|---|---|---|---|---|---|---|
| | | Ave. | P-Val. | % Incr. | Ave. | P-Val. | % Incr. |
| LGP54 | 77039.1 | — | — | — | 22.4 | 0.09 | 5 |
| LGP53 | 76966.2 | — | — | — | 25.7 | L | 20 |
| LGP53 | 76968.1 | — | — | — | 26.1 | L | 22 |
| LGP52 | 76962.1 | — | — | — | 26.6 | L | 25 |
| LGP52 | 76963.1 | — | — | — | 23.9 | 0.06 | 12 |
| LGP52 | 76965.2 | — | — | — | 26.0 | L | 22 |
| CONT. | — | — | — | — | 21.3 | — | — |
| LGP58 | 76972.1 | 344.0 | 0.20 | 19 | — | — | — |
| LGP58 | 76975.5 | — | — | — | 21.0 | 0.12 | 5 |
| LGP48 | 77202.1 | 354.5 | 0.05 | 23 | 21.1 | 0.08 | 6 |
| LGP48 | 77202.4 | 320.2 | 0.28 | 11 | — | — | — |
| LGP48 | 77203.2 | 345.9 | 0.23 | 20 | — | — | — |
| LGP48 | 77204.3 | — | — | — | 22.4 | L | 12 |
| LGP48 | 77204.6 | 337.4 | 0.29 | 17 | — | — | — |
| LGP47 | 76960.3 | 347.1 | 0.07 | 20 | — | — | — |
| CONT. | — | 289.0 | — | — | 20.0 | — | — |
| LYD930 | 83831.3 | — | — | — | 27.9 | 0.22 | 22 |
| LYD930 | 83832.3 | — | — | — | 27.2 | L | 20 |
| LYD930 | 83833.4 | 518.1 | 0.27 | 18 | — | — | — |
| LYD881 | 84058.5 | 537.8 | 0.14 | 22 | — | — | — |
| LYD877 | 83630.2 | — | — | — | 26.0 | L | 14 |
| LYD877 | 83630.3 | — | — | — | 25.7 | 0.01 | 13 |
| LYD863 | 83808.4 | — | — | — | 27.6 | 0.11 | 21 |
| LYD863 | 83810.7 | — | — | — | 26.6 | 0.12 | 17 |
| LYD846 | 83533.4 | — | — | — | 27.1 | 0.15 | 19 |
| LYD788 | 83798.3 | 479.1 | 0.26 | 9 | — | — | — |

TABLE 177-continued

Genes showing improved plant performance at Normal growth conditions under regulation of At6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LYD788 | 83798.4 | — | — | — | 25.2 | 0.27 | 11 |
| LYD783 | 84170.1 | 506.9 | 0.06 | 15 | 24.5 | 0.07 | 8 |
| LYD783 | 84170.3 | 505.3 | 0.07 | 15 | — | — | — |
| LYD783 | 84172.2 | — | — | — | 24.2 | 0.11 | 6 |
| LYD779 | 83704.2 | — | — | — | 26.9 | L | 18 |
| LYD776 | 83944.1 | 592.4 | 0.23 | 35 | — | — | — |
| LYD776 | 83947.6 | 514.5 | 0.04 | 17 | 24.0 | 0.20 | 5 |
| LYD764 | 83479.4 | — | — | — | 26.0 | 0.28 | 14 |
| LYD764 | 83483.6 | — | — | — | 25.7 | 0.27 | 13 |
| LYD731 | 83456.1 | — | — | — | 24.3 | 0.12 | 7 |
| LYD713 | 83788.3 | — | — | — | 25.4 | 0.29 | 12 |
| LYD710 | 83895.3 | — | — | — | 26.7 | 0.09 | 17 |
| LYD710 | 83895.6 | — | — | — | 28.3 | 0.12 | 24 |
| LYD708 | 83451.7 | — | — | — | 24.4 | 0.09 | 7 |
| LYD700 | 84149.4 | — | — | — | 24.2 | 0.22 | 6 |
| LYD700 | 84150.3 | — | — | — | 28.6 | 0.14 | 26 |
| LYD700 | 84151.4 | 498.8 | 0.09 | 13 | — | — | — |
| LYD698 | 83778.1 | — | — | — | 26.7 | 0.17 | 17 |
| LYD698 | 83780.3 | — | — | — | 24.9 | 0.08 | 9 |
| LYD698 | 83780.4 | 487.8 | 0.26 | 11 | — | — | — |
| CONT. | — | 440.0 | — | — | 22.8 | — | — |
| LGP77 | 81453.3 | — | — | — | 21.9 | 0.05 | 12 |
| CONT. | — | — | — | — | 19.5 | — | — |
| LGP73 | 81449.3 | 390.3 | 0.28 | 18 | — | — | — |
| LGP73 | 81449.8 | 373.7 | 0.12 | 13 | 24.8 | L | 32 |
| CONT. | — | 330.5 | — | — | 18.7 | — | — |
| LYD930 | 83831.3 | — | — | — | 23.4 | 0.17 | 17 |
| LYD930 | 83832.3 | — | — | — | 24.1 | 0.12 | 21 |
| LYD881 | 84058.5 | — | — | — | 21.5 | 0.29 | 8 |
| LYD877 | 83630.3 | — | — | — | 24.1 | 0.05 | 21 |
| LYD863 | 83808.4 | 357.6 | 0.21 | 11 | 22.2 | L | 12 |
| LYD863 | 83810.6 | — | — | — | 24.4 | 0.16 | 23 |
| LYD846 | 83529.5 | — | — | — | 20.6 | 0.28 | 4 |
| LYD846 | 83531.4 | — | — | — | 20.9 | 0.27 | 5 |
| LYD831 | 83803.5 | 404.6 | 0.11 | 26 | — | — | — |
| LYD831 | 83803.6 | 394.3 | 0.02 | 23 | — | — | — |
| LYD788 | 83798.4 | — | — | — | 23.4 | 0.14 | 17 |
| LYD788 | 83800.1 | 348.2 | 0.26 | 9 | — | — | — |
| LYD788 | 83800.4 | 361.8 | 0.14 | 13 | 21.6 | 0.09 | 9 |
| LYD788 | 83800.5 | 413.1 | L | 29 | — | — | — |
| LYD783 | 84172.2 | 408.8 | L | 27 | — | — | — |
| LYD779 | 83704.2 | 373.6 | 0.05 | 16 | — | — | — |
| LYD779 | 83708.4 | 415.9 | 0.12 | 30 | 21.0 | 0.28 | 6 |
| LYD776 | 83944.1 | 351.5 | 0.22 | 10 | — | — | — |
| LYD764 | 83479.4 | — | — | — | 23.8 | L | 20 |
| LYD740 | 83461.4 | 358.3 | 0.15 | 12 | — | — | — |
| LYD731 | 83456.1 | 413.9 | 0.08 | 29 | — | — | — |
| LYD731 | 83456.3 | — | — | — | 21.1 | 0.27 | 6 |
| LYD715 | 84158.1 | — | — | — | 23.7 | 0.17 | 19 |
| LYD713 | 83788.3 | — | — | — | 23.7 | L | 19 |
| LYD713 | 83789.3 | 434.4 | 0.20 | 35 | — | — | — |
| LYD708 | 83451.5 | 366.5 | 0.20 | 14 | — | — | — |
| LYD698 | 83778.1 | — | — | — | 21.4 | 0.06 | 8 |
| LYD698 | 83780.3 | 429.0 | 0.01 | 34 | — | — | — |
| CONT. | — | 320.8 | — | — | 19.9 | — | — |
| LGP49 | 77651.8 | — | — | — | 20.8 | 0.15 | 4 |
| LGP49 | 77652.6 | — | — | — | 24.6 | 0.06 | 23 |
| CONT. | — | — | — | — | 20.0 | — | — |
| LYD919 | 83644.2 | 390.9 | 0.08 | 13 | — | — | — |
| LYD913 | 84198.7 | 424.2 | 0.01 | 23 | — | — | — |
| LYD909 | 84174.1 | — | — | — | 20.2 | 0.29 | 7 |
| LYD898 | 83641.5 | — | — | — | 22.3 | 0.01 | 18 |
| LYD896 | 83659.2 | — | — | — | 23.9 | 0.06 | 27 |
| LYD895 | 83535.5 | 403.5 | 0.04 | 17 | — | — | — |
| LYD886 | 83635.4 | 400.2 | 0.30 | 16 | — | — | — |
| LYD882 | 84065.1 | — | — | — | 19.6 | 0.30 | 4 |
| LYD840 | 84085.2 | — | — | — | 21.5 | L | 14 |
| LYD786 | 84582.1 | 396.1 | 0.27 | 15 | — | — | — |
| LYD745 | 84262.1 | 375.5 | 0.22 | 9 | — | — | — |
| LYD733 | 83766.5 | 375.8 | 0.24 | 9 | — | — | — |
| LYD733 | 83768.3 | 376.2 | 0.24 | 9 | — | — | — |
| LYD717 | 84353.1 | 392.3 | 0.21 | 14 | — | — | — |
| CONT. | — | 345.3 | — | — | 18.8 | — | — |
| LGP45 | 77196.1 | — | — | — | 24.5 | L | 18 |
| CONT. | — | — | — | — | 20.8 | — | — |
| LGP32 | 75397.4 | 178.8 | 0.05 | 26 | — | — | — |
| CONT. | — | 141.9 | — | — | — | — | — |
| LGP74 | 81326.1 | — | — | — | 25.6 | 0.08 | 10 |
| LGP74 | 81328.3 | — | — | — | 24.9 | 0.28 | 8 |
| CONT. | — | — | — | — | 23.2 | — | — |
| LGP43 | 76951.2 | 304.6 | 0.27 | 11 | — | LNU824- | — |
| LGP43 | 76955.2 | — | — | — | 22.9 | 0.04 | 15 |
| CONT. | — | 274.9 | — | — | 20.0 | — | — |
| LGP74 | 81328.3 | — | — | — | 22.6 | 0.02 | 13 |
| CONT. | — | — | — | — | 19.9 | — | — |
| LGP71 | 82500.4 | — | — | — | 24.8 | 0.10 | 15 |
| LGP71 | 82503.1 | — | — | — | 25.8 | 0.02 | 19 |
| LGP71 | 82503.2 | — | — | — | 23.7 | 0.10 | 10 |
| CONT. | — | — | — | — | 21.7 | — | — |
| LGP73 | 81449.8 | — | — | — | 28.2 | 0.04 | 18 |
| CONT. | — | — | — | — | 23.8 | — | — |
| LGP71 | 82500.4 | — | — | — | 23.7 | L | 25 |
| LGP71 | 82503.1 | — | — | — | 23.4 | 0.02 | 24 |
| CONT. | — | — | — | — | 19.0 | — | — |
| LGP34 | 75739.3 | — | — | — | 24.8 | 0.08 | 10 |
| CONT. | — | — | — | — | 22.5 | — | — |
| LYD915 | 84658.1 | 473.2 | 0.15 | 23 | — | — | — |
| LYD913 | 84195.4 | — | — | — | 23.7 | L | 12 |
| LYD909 | 84177.1 | 444.8 | 0.21 | 16 | — | — | — |
| LYD899 | 83722.1 | 420.1 | 0.23 | 9 | — | — | — |
| LYD895 | 83535.5 | 427.3 | 0.20 | 11 | — | — | — |
| LYD895 | 83537.3 | 445.9 | 0.23 | 16 | — | — | — |
| LYD848 | 84292.5 | — | — | — | 23.1 | 0.22 | 9 |
| LYD840 | 84085.2 | — | — | — | 25.4 | 0.02 | 20 |
| LYD833 | 83511.1 | 430.5 | 0.11 | 12 | 22.7 | 0.07 | 8 |
| LYD789 | 84131.3 | 448.0 | 0.12 | 16 | — | — | — |
| LYD733 | 83768.1 | 428.4 | 0.12 | 11 | — | — | — |
| LYD717 | 84356.2 | 463.2 | 0.02 | 20 | — | — | — |
| LYD704 | 83785.5 | 469.4 | 0.01 | 22 | — | — | — |
| CONT. | — | 384.7 | — | — | 21.2 | — | — |
| LGP54 | 77039.1 | — | — | — | 22.6 | L | 8 |
| LGP53 | 76966.2 | — | — | — | 25.9 | L | 23 |
| LGP53 | 76968.1 | — | — | — | 25.3 | 0.03 | 21 |
| LGP53 | 76968.4 | — | — | — | 21.9 | 0.18 | 4 |
| LGP52 | 76962.1 | — | — | — | 25.1 | L | 19 |
| LGP52 | 76963.1 | 423.6 | 0.27 | 14 | 24.5 | L | 16 |
| LGP52 | 76963.3 | — | — | — | 21.8 | 0.12 | 4 |
| LGP52 | 76965.2 | — | — | — | 24.9 | L | 19 |
| CONT. | — | 370.5 | — | — | 21.0 | — | — |
| LGP34 | 75737.4 | — | — | — | 21.6 | 0.13 | 5 |
| LGP34 | 75739.3 | — | — | — | 24.6 | L | 20 |
| CONT. | — | — | — | — | 20.6 | — | — |
| LYD919 | 83646.1 | — | — | — | 22.2 | 0.18 | 12 |
| LYD900 | 83738.8 | — | — | — | 23.1 | 0.01 | 17 |
| LYD898 | 83641.5 | — | — | — | 25.6 | 0.21 | 29 |
| LYD898 | 83641.8 | 451.3 | 0.13 | 10 | — | — | — |
| LYD894 | 84362.2 | 458.6 | 0.13 | 12 | — | — | — |
| LYD894 | 84362.3 | — | — | — | 20.6 | 0.09 | 4 |
| LYD886 | 83634.3 | 509.9 | 0.07 | 25 | — | — | — |
| LYD886 | 83636.3 | 500.2 | 0.25 | 22 | 20.9 | 0.05 | 5 |
| LYD883 | 83911.2 | 454.4 | 0.12 | 11 | — | — | — |
| LYD883 | 83912.3 | 444.7 | 0.20 | 9 | — | — | — |
| LYD882 | 84064.4 | 442.3 | 0.22 | 8 | — | — | — |
| LYD871 | 83716.2 | 453.1 | 0.17 | 11 | — | — | — |
| LYD871 | 83718.6 | — | — | — | 20.6 | 0.08 | 4 |
| LYD865 | 83730.1 | — | — | — | 22.8 | 0.26 | 15 |
| LYD865 | 83733.5 | 444.7 | 0.22 | 9 | — | — | — |
| LYD839 | 83521.1 | — | — | — | 24.6 | L | 24 |
| LYD839 | 83522.1 | — | — | — | 23.1 | L | 17 |
| LYD793 | 83499.7 | — | — | — | 23.0 | L | 16 |
| LYD786 | 84582.1 | 463.9 | 0.07 | 14 | — | — | — |
| LYD777 | 83489.3 | — | — | — | 20.3 | 0.29 | 3 |

TABLE 177-continued

Genes showing improved plant performance at Normal growth conditions under regulation of At6669 promoter

| Gene | | Seed Yield [mg] | | | 1000 Seed Weight [mg] | | |
|---|---|---|---|---|---|---|---|
| Name | Event # | Ave. | P-Val. | % Incr. | Ave. | P-Val. | Incr. |
| LYD772 | 84529.1 | 481.7 | 0.16 | 18 | — | — | — |
| LYD772 | 84529.2 | — | — | — | 24.6 | L | 24 |
| LYD747 | 85011.3 | — | — | — | 21.8 | 0.12 | 10 |
| LYD745 | 84262.1 | — | — | — | 21.9 | 0.11 | 10 |
| CONT. | — | 408.6 | — | — | 19.8 | — | — |
| LGP44 | 75764.8 | — | — | — | 23.4 | 0.04 | 14 |
| LGP44 | 75765.3 | — | — | — | 21.0 | 0.13 | 2 |
| CONT. | — | — | — | — | 20.5 | — | — |
| LGP46 | 77256.1 | — | — | — | 20.9 | 0.25 | 6 |
| LGP45 | 77196.1 | — | — | — | 24.7 | L | 25 |
| LGP19 | 76938.3 | 303.6 | 0.15 | 17 | — | — | — |
| LGP19 | 76939.1 | — | — | — | 20.4 | 0.27 | 4 |
| CONT. | — | 259.9 | — | — | 19.7 | — | — |
| LGP48 | 77204.3 | — | — | — | 23.5 | 0.01 | 13 |
| LGP47 | 76956.1 | 316.7 | 0.21 | 14 | — | — | — |
| CONT. | — | 277.7 | — | — | 20.8 | — | — |

Table 177. "CONT."—Control; "Ave."—Average; "% Incr." = % increment; "p-val."—p-value, L- p < 0.01.

Example 27

Evaluation of Transgenic *Arabidopsis* for Seed Yield and Plant Growth Rate Under Normal Conditions in Greenhouse Assays Until Bolting (GH-SB Assays)

Assay 2: plant performance improvement measured until bolting stage: plant biomass and plant growth rate under normal greenhouse conditions (GH-SB Assays)—This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. Plants were grown under normal conditions which included irrigation of the trays with a solution containing of 6 mM inorganic nitrogen in the form of $KNO_3$ with 1 mM $KH_2PO_4$, 1 mM $MgSO_4$, 2 mM $CaCl_2$ and microelements. Under normal conditions the plants grow in a controlled environment in a closed transgenic greenhouse; temperature was 18-22° C., humidity around 70%; Irrigation was done by flooding with a water solution containing 6 mM N (nitrogen) (as described hereinabove), and flooding was repeated whenever water loss reached 50%. All plants were grown in the greenhouse until bolting stage. Plant biomass (the above ground tissue) was weighted directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the At6669 promoter (SEQ ID NO: 15751) and the selectable marker, were used as control. Additionally or alternatively, Mock-transgenic plants expressing the uidA reporter gene (GUS-Intron) or with no gene at all, under the same promoter were used as control.

The plants were analyzed for their overall size, growth rate, fresh weight and dry matter. Transgenic plants performance was compared to control plants grown in parallel under the same conditions. The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula VIII, described above), rosette area (Formula IX described above) and plot coverage (Formula XI, described above) were calculated using the indicated formulas.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Experimental Results:

Tables 178-180 summarize the observed phenotypes of transgenic plants expressing the genes constructs using the GH-SB Assays.

The genes listed in Tables 178-180 improved plant performance when grown at normal conditions. These genes produced larger plants with a larger photosynthetic area, biomass (fresh weight, dry weight, rosette diameter, rosette area and plot coverage), relative growth rate, blade relative area and petiole relative area. The genes were cloned under the regulation of a constitutive At6669 promoter (SEQ ID NO: 15751). The evaluation of each gene was performed by testing the performance of different number of events. Event with p-value<0.1 was considered statistically significant

TABLE 178

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD897 | 84444.13 | 117.5 | 0.18 | 10 | — | — | — | — | — | — |
| LYD888 | 84613.2 | 117.5 | 0.18 | 10 | 1481.2 | 0.09 | 13 | — | — | — |
| LYD869_H1 | 85982.3 | 116.2 | 0.27 | 9 | — | — | — | — | — | — |
| LYD869_H1 | 85983.1 | 126.9 | 0.03 | 19 | 1512.5 | 0.18 | 16 | — | — | — |
| LYD859 | 83953.6 | — | — | — | 1431.2 | 0.29 | 9 | — | — | — |
| LYD859 | 83957.5 | 121.9 | 0.12 | 14 | 1525.0 | 0.25 | 17 | 10.4 | 0.04 | 9 |
| LYD853 | 86496.1 | 118.8 | 0.18 | 11 | — | — | — | 10.1 | 0.08 | 5 |
| LYD853 | 86497.6 | 120.0 | 0.12 | 13 | 1475.0 | 0.09 | 13 | — | — | — |
| LYD853 | 86497.7 | 125.0 | 0.22 | 17 | — | — | — | — | — | — |
| LYD828 | 85324.2 | 118.8 | 0.15 | 11 | — | — | — | — | — | — |
| LYD828 | 85324.4 | — | — | — | 1400.0 | 0.27 | 7 | — | — | — |
| LYD826 | 85587.2 | 118.8 | 0.18 | 11 | 1425.0 | 0.17 | 9 | — | — | — |
| LYD795 | 85978.4 | — | — | — | — | — | — | 10.2 | 0.02 | 7 |
| LYD790 | 84574.2 | 118.8 | 0.15 | 11 | 1406.2 | 0.24 | 8 | — | — | — |
| LYD790 | 84574.5 | 115.6 | 0.26 | 9 | — | — | — | — | — | — |
| LYD756 | 85069.8 | — | — | — | — | — | — | 10.1 | 0.22 | 5 |
| LYD750 | 84966.3 | 128.1 | 0.07 | 20 | 1593.8 | 0.18 | 22 | — | — | — |
| LYD744 | 86509.2 | 120.6 | 0.12 | 13 | 1406.2 | 0.26 | 8 | — | — | — |
| LYD699 | 85972.6 | 126.2 | 0.07 | 18 | 1481.2 | 0.17 | 13 | — | — | — |
| CONT. | — | 106.6 | — | — | 1307.7 | — | — | 9.61 | — | — |
| LYD908 | 84445.1 | 50.0 | 0.11 | 21 | 687.5 | 0.02 | 31 | 10.6 | L | 11 |
| LYD908 | 84446.1 | — | — | — | — | — | — | 10.4 | 0.01 | 8 |
| LYD908 | 84447.1 | 60.0 | L | 45 | 781.2 | 0.02 | 49 | 10.9 | L | 14 |
| LYD908 | 84447.4 | 61.9 | L | 50 | 781.2 | 0.12 | 49 | 10.7 | 0.11 | 11 |
| LYD876 | 83416.3 | 51.9 | 0.25 | 26 | 706.2 | 0.05 | 35 | 10.6 | L | 11 |
| LYD876 | 83417.3 | 57.5 | 0.01 | 39 | 631.2 | 0.26 | 20 | — | — | — |
| LYD876 | 83417.6 | — | — | — | — | — | — | 10.5 | L | 9 |
| LYD876 | 83418.2 | — | — | — | — | — | — | 10.5 | L | 9 |
| LYD865 | 83730.1 | — | — | — | — | — | — | 11.1 | 0.07 | 15 |
| LYD865 | 83731.1 | — | — | — | — | — | — | 10.2 | 0.15 | 7 |
| LYD865 | 83733.5 | — | — | — | — | — | — | 10.2 | 0.29 | 7 |
| LYD864 | 83406.2 | — | — | — | — | — | — | 10.3 | 0.20 | 8 |
| LYD864 | 83406.4 | 55.6 | 0.04 | 35 | 675.0 | 0.02 | 29 | — | — | — |
| LYD864 | 83409.2 | — | — | — | — | — | — | 10.8 | 0.09 | 13 |
| LYD864 | 83409.3 | 56.2 | 0.02 | 36 | 806.2 | 0.04 | 54 | 10.6 | 0.23 | 10 |
| LYD864 | 83409.4 | — | — | — | — | — | — | 10.3 | 0.06 | 8 |
| LYD843 | 83772.1 | 53.1 | 0.04 | 29 | 700.0 | 0.02 | 33 | 10.4 | 0.12 | 8 |
| LYD843 | 83774.1 | — | — | — | — | — | — | 10.1 | 0.16 | 5 |
| LYD843 | 83775.2 | 56.2 | 0.24 | 36 | 787.5 | 0.14 | 50 | — | — | — |
| LYD843 | 83775.4 | 58.8 | 0.14 | 42 | 706.2 | 0.05 | 35 | 10.0 | 0.11 | 4 |
| LYD842 | 83524.4 | 48.8 | 0.17 | 18 | 618.8 | 0.11 | 18 | 9.94 | 0.11 | 4 |
| LYD842 | 83526.5 | — | — | — | — | — | — | 10.3 | L | 8 |
| LYD842 | 83528.2 | 51.9 | 0.06 | 26 | 668.8 | 0.03 | 27 | 10.7 | 0.02 | 11 |
| LYD835 | 84139.1 | — | — | — | 612.5 | 0.13 | 17 | 10.7 | 0.02 | 11 |
| LYD835 | 84141.2 | — | — | — | — | — | — | 10.1 | 0.16 | 5 |
| LYD835 | 84141.3 | 59.4 | L | 44 | 681.2 | 0.02 | 30 | 10.2 | 0.10 | 6 |
| LYD835 | 84143.1 | — | — | — | — | — | — | 10.6 | 0.13 | 10 |
| LYD835 | 84143.2 | 55.6 | 0.02 | 35 | 693.8 | 0.03 | 32 | 9.81 | 0.27 | 2 |
| LYD821 | 84053.3 | 62.5 | L | 52 | 825.0 | L | 57 | 11.9 | 0.08 | 24 |
| LYD821 | 84054.1 | 65.0 | 0.17 | 58 | 775.0 | 0.03 | 48 | 10.9 | L | 14 |
| LYD821 | 84054.4 | — | — | — | 606.2 | 0.16 | 15 | 10.7 | 0.02 | 11 |
| LYD821 | 84054.6 | — | — | — | — | — | — | 10.1 | 0.16 | 5 |
| LYD793 | 83499.5 | — | — | — | — | — | — | 9.88 | 0.24 | 3 |
| LYD793 | 83499.7 | 50.0 | 0.29 | 21 | — | — | — | — | — | — |
| LYD793 | 83500.4 | 57.5 | 0.09 | 39 | 737.5 | L | 40 | 10.7 | 0.11 | 11 |
| LYD777 | 83489.3 | — | — | — | 662.5 | 0.20 | 26 | 10.2 | 0.03 | 7 |
| LYD777 | 83491.3 | — | — | — | — | — | — | 9.81 | 0.27 | 2 |
| LYD777 | 83492.3 | — | — | — | 637.5 | 0.09 | 21 | 10.2 | 0.15 | 7 |
| LYD777 | 83492.4 | — | — | — | 637.5 | 0.07 | 21 | — | — | — |
| LYD777 | 83493.3 | 60.0 | L | 45 | 762.5 | L | 45 | — | — | — |
| LYD767 | 83485.1 | 52.5 | 0.05 | 27 | 787.5 | L | 50 | 10.8 | L | 12 |
| LYD767 | 83486.2 | 49.4 | 0.15 | 20 | 737.5 | L | 40 | 10.7 | 0.11 | 11 |
| LYD767 | 83488.1 | — | — | — | 656.2 | 0.25 | 25 | 10.0 | 0.11 | 4 |
| LYD767 | 83488.5 | — | — | — | 662.5 | 0.08 | 26 | 10.8 | L | 12 |
| LYD753 | 83916.1 | — | — | — | 656.2 | 0.04 | 25 | 10.4 | L | 8 |
| LYD753 | 83917.2 | — | — | — | — | — | — | 10.2 | 0.02 | 6 |
| LYD753 | 83917.6 | 66.9 | L | 62 | 806.2 | L | 54 | 11.5 | L | 20 |
| LYD735 | 84165.1 | — | — | — | — | — | — | 10.1 | 0.21 | 6 |
| LYD735 | 84168.2 | 68.8 | 0.17 | 67 | — | — | — | 10.5 | L | 9 |
| LYD730 | 84258.1 | 52.5 | 0.07 | 27 | 712.5 | 0.03 | 36 | 11.4 | 0.02 | 19 |
| LYD730 | 84259.1 | — | — | — | 637.5 | 0.20 | 21 | — | — | — |
| LYD729 | 84159.1 | — | — | — | — | — | — | 10.7 | 0.11 | 11 |

TABLE 178-continued

Genes showing improved plant performance at Normal growth conditions under regulation of At6669 promoter

| | | Dry Weight [mg] | | | Fresh Weight [mg] | | | Leaf Number | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LYD729 | 84159.4 | — | — | — | — | — | — | 10.6 | L | 10 |
| LYD729 | 84159.6 | — | — | — | 675.0 | 0.02 | 29 | 10.4 | 0.01 | 8 |
| LYD729 | 84160.3 | 65.6 | 0.05 | 59 | 831.2 | 0.13 | 58 | 10.6 | 0.13 | 10 |
| LYD729 | 84163.2 | — | — | — | 612.5 | 0.22 | 17 | — | — | — |
| LYD726 | 84591.1 | 65.6 | 0.05 | 59 | 837.5 | 0.04 | 60 | 11.1 | 0.07 | 15 |
| LYD726 | 84593.1 | 65.0 | 0.04 | 58 | 843.8 | L | 61 | 11.2 | L | 17 |
| LYD726 | 84595.1 | — | — | — | 718.8 | 0.04 | 37 | — | — | — |
| LYD726 | 84595.3 | — | — | — | — | — | — | 10.7 | L | 11 |
| LYD720 | 83761.3 | — | — | — | — | — | — | 10.1 | 0.05 | 6 |
| LYD720 | 83763.1 | 75.3 | L | 82 | 1035.7 | 0.30 | 97 | 10.8 | L | 13 |
| LYD720 | 83764.2 | — | — | — | 737.5 | 0.23 | 40 | 10.4 | 0.04 | 9 |
| LYD720 | 83764.3 | — | — | — | 718.8 | L | 37 | 10.8 | 0.02 | 13 |
| LYD705 | 83382.6 | — | — | — | — | — | — | 10.2 | 0.03 | 7 |
| LYD705 | 83384.4 | — | — | — | 687.5 | 0.02 | 31 | — | — | — |
| CONT. | — | 41.2 | — | — | 525.0 | — | — | 9.59 | — | — |
| LGP8 | 75405.1 | — | — | — | — | — | — | 12.5 | 0.10 | 6 |
| LGP20 | 76945.5 | — | — | — | 4365.6 | 0.14 | 10 | — | — | — |
| CONT. | — | — | — | — | 3975.9 | — | — | 11.8 | — | — |
| LGP43 | 76955.2 | — | — | — | 5075.0 | 0.07 | 6 | — | — | — |
| CONT. | — | — | — | — | 4801.8 | — | — | — | — | — |
| LYD914 | 84179.2 | 55.6 | 0.22 | 13 | 631.2 | 0.22 | 23 | — | — | — |
| LYD914 | 84183.6 | 53.1 | 0.10 | 8 | — | — | — | 11.9 | 0.10 | 4 |
| LYD901 | 83883.3 | — | — | — | — | — | — | 12.1 | 0.16 | 6 |
| LYD892 | 84250.5 | 55.6 | 0.02 | 13 | — | — | — | — | — | — |
| LYD892 | 84250.7 | 61.9 | 0.01 | 26 | 718.8 | L | 40 | — | — | — |
| LYD876 | 83418.2 | — | — | — | — | — | — | 11.8 | 0.07 | 3 |
| LYD876 | 83418.3 | — | — | — | 642.0 | 0.05 | 25 | — | — | — |
| LYD870 | 83815.7 | — | — | — | 591.1 | 0.23 | 15 | — | — | — |
| LYD864 | 83409.3 | — | — | — | — | — | — | 11.8 | 0.21 | 2 |
| LYD864 | 83409.4 | — | — | — | — | — | — | 12.5 | L | 9 |
| LYD847 | 83403.1 | — | — | — | 601.8 | 0.14 | 17 | — | — | — |
| LYD843 | 83772.1 | 55.0 | 0.05 | 12 | — | — | — | — | — | — |
| LYD843 | 83775.2 | 57.5 | 0.09 | 17 | — | — | — | — | — | — |
| LYD842 | 83526.5 | — | — | — | 668.8 | 0.26 | 30 | — | — | — |
| LYD781 | 83496.3 | 53.2 | 0.20 | 8 | — | — | — | — | — | — |
| LYD755 | 84033.1 | — | — | — | 593.8 | 0.20 | 16 | 11.8 | 0.26 | 3 |
| LYD753 | 83917.6 | — | — | — | — | — | — | 11.9 | 0.16 | 4 |
| LYD735 | 84165.1 | — | — | — | 612.5 | 0.07 | 19 | — | — | — |
| LYD727 | 83791.1 | — | — | — | 613.4 | 0.07 | 20 | — | — | — |
| LYD727 | 83793.2 | — | — | — | — | — | — | 11.8 | 0.26 | 3 |
| LYD727 | 83795.2 | — | — | — | 656.2 | 0.02 | 28 | — | — | — |
| LYD722 | 84944.3 | 59.4 | 0.21 | 21 | — | — | — | 12.0 | 0.05 | 5 |
| LYD722 | 84944.4 | 57.5 | 0.21 | 17 | 656.2 | 0.02 | 28 | 12.4 | 0.15 | 8 |
| CONT. | — | 49.1 | — | — | 513.3 | — | — | 11.5 | — | — |
| LGP1 | 76249.3 | — | — | — | — | — | — | 11.7 | 0.25 | 3 |
| LGP1 | 76250.4 | — | — | — | — | — | — | 11.7 | 0.24 | 4 |
| CONT. | — | — | — | — | — | — | — | 11.3 | — | — |
| LYD922 | 83821.3 | 60.0 | 0.06 | 25 | 868.8 | 0.02 | 38 | — | — | — |
| LYD922 | 83823.5 | 65.0 | 0.04 | 35 | — | — | — | 10.9 | 0.15 | 5 |
| LYD922 | 83823.6 | — | — | — | — | — | — | 11.0 | 0.08 | 6 |
| LYD905 | 84147.2 | — | — | — | — | — | — | 11.1 | 0.05 | 7 |
| LYD901 | 83883.2 | 64.6 | 0.25 | 34 | 736.6 | 0.26 | 17 | 11.2 | 0.06 | 8 |
| LYD901 | 83883.3 | — | — | — | — | — | — | 11.0 | 0.17 | 6 |
| LYD901 | 83886.6 | 61.9 | 0.03 | 29 | 812.5 | 0.04 | 29 | 11.4 | 0.01 | 10 |
| LYD883 | 83911.3 | 56.9 | 0.17 | 18 | 737.5 | 0.21 | 17 | — | — | — |
| LYD883 | 83912.2 | 57.5 | 0.09 | 20 | 775.0 | 0.14 | 23 | 11.3 | 0.11 | 9 |
| LYD883 | 83912.3 | 58.1 | 0.08 | 21 | 837.5 | 0.02 | 33 | 11.6 | 0.23 | 11 |
| LYD860 | 83622.1 | 54.4 | 0.23 | 13 | — | — | — | — | — | — |
| LYD860 | 83625.4 | — | — | — | 812.5 | 0.12 | 29 | 12.2 | 0.24 | 17 |
| LYD839 | 83521.3 | — | — | — | — | — | — | 10.8 | 0.27 | 4 |
| LYD839 | 83522.1 | 58.1 | 0.13 | 21 | — | — | — | — | — | — |
| LYD839 | 83523.1 | — | — | — | — | — | — | 10.9 | 0.15 | 5 |
| LYD839 | 83523.6 | — | — | — | 762.5 | 0.10 | 21 | — | — | — |
| LYD836 | 83514.4 | — | — | — | — | — | — | 11.6 | 0.18 | 12 |
| LYD836 | 83515.5 | — | — | — | 756.2 | 0.12 | 20 | — | — | — |
| LYD833 | 83512.2 | — | — | — | 731.2 | 0.19 | 16 | — | — | — |
| LYD833 | 83513.5 | 55.6 | 0.18 | 16 | 775.0 | 0.08 | 23 | 11.4 | L | 10 |
| LYD811 | 83713.4 | — | — | — | 737.5 | 0.21 | 17 | — | — | — |
| LYD789 | 84130.3 | 57.5 | 0.26 | 20 | 775.0 | 0.30 | 23 | — | — | — |
| LYD789 | 84131.3 | — | — | — | 718.8 | 0.27 | 14 | — | — | — |
| LYD781 | 83494.1 | 58.1 | 0.09 | 21 | — | — | — | — | — | — |
| LYD781 | 83494.4 | 54.4 | 0.23 | 13 | — | — | — | 10.8 | 0.23 | 4 |

TABLE 178-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD755 | 84032.1 | 56.9 | 0.12 | 18 | 756.2 | 0.27 | 20 | 10.8 | 0.25 | 4 |
| LYD755 | 84035.1 | — | — | — | 800.0 | 0.05 | 27 | — | — | — |
| LYD755 | 84035.2 | 59.4 | 0.06 | 24 | — | — | — | 12.1 | L | 16 |
| LYD742 | 83467.4 | — | — | — | 756.2 | 0.22 | 20 | 10.8 | 0.18 | 4 |
| LYD739 | 83386.2 | 58.1 | 0.19 | 21 | — | — | — | 11.7 | L | 13 |
| LYD739 | 83389.4 | — | — | — | 725.0 | 0.22 | 15 | — | — | — |
| LYD725 | 84190.3 | — | — | — | 856.2 | 0.02 | 36 | 11.3 | 0.02 | 9 |
| LYD725 | 84191.1 | 61.2 | 0.08 | 28 | 856.2 | 0.02 | 36 | — | — | — |
| LYD704 | 83781.1 | 60.6 | 0.04 | 26 | — | — | — | — | — | — |
| LYD704 | 83785.7 | — | — | — | — | — | — | 10.8 | 0.25 | 4 |
| CONT. | — | 48.0 | — | — | 628.8 | — | — | 10.4 | — | — |
| LYD925 | 85844.1 | 71.0 | 0.13 | 27 | 919.6 | L | 34 | 11.4 | L | 11 |
| LYD925 | 85844.3 | 70.6 | 0.06 | 26 | 750.0 | 0.28 | 10 | — | — | — |
| LYD920 | 83760.3 | 63.1 | 0.28 | 13 | 768.8 | 0.15 | 12 | 10.9 | 0.20 | 5 |
| LYD897 | 84444.6 | — | — | — | — | — | — | 11.7 | 0.13 | 13 |
| LYD869_H1 | 85983.1 | 75.6 | 0.27 | 35 | — | — | — | 10.9 | 0.20 | 5 |
| LYD854 | 84992.3 | 70.6 | 0.10 | 26 | — | — | — | 11.0 | 0.27 | 7 |
| LYD854 | 84993.2 | 68.1 | 0.08 | 21 | — | — | — | — | — | — |
| LYD826 | 85585.1 | — | — | — | — | — | — | 10.7 | 0.19 | 4 |
| LYD826 | 85587.1 | 68.8 | 0.07 | 23 | 850.0 | 0.15 | 24 | 11.7 | L | 13 |
| LYD826 | 85587.5 | 67.5 | 0.27 | 20 | — | — | — | — | — | — |
| LYD824 | 83903.3 | 76.9 | 0.01 | 37 | 993.8 | L | 45 | — | — | — |
| LYD824 | 83905.3 | 76.2 | 0.24 | 36 | 1000.0 | 0.02 | 46 | 10.7 | 0.19 | 4 |
| LYD824 | 83907.2 | — | — | — | — | — | — | 10.9 | 0.06 | 5 |
| LYD824 | 83907.6 | — | — | — | — | — | — | 11.6 | 0.07 | 12 |
| LYD816 | 85591.1 | 75.6 | 0.01 | 35 | 1025.0 | L | 50 | — | — | — |
| LYD816 | 85594.2 | — | — | — | — | — | — | 11.5 | 0.28 | 11 |
| LYD814 | 84971.2 | — | — | — | — | — | — | 10.7 | 0.19 | 4 |
| LYD814 | 84973.3 | — | — | — | — | — | — | 10.8 | 0.11 | 5 |
| LYD814 | 84973.6 | 75.0 | 0.02 | 34 | — | — | — | 11.4 | 0.05 | 10 |
| LYD791 | 85129.4 | 81.2 | 0.01 | 45 | 925.0 | L | 35 | 11.8 | L | 14 |
| LYD791 | 85129.5 | 74.2 | 0.03 | 32 | 933.9 | L | 37 | 11.1 | 0.02 | 7 |
| LYD790 | 84574.2 | 88.8 | L | 58 | 1100.0 | L | 61 | 11.9 | 0.10 | 16 |
| LYD778 | 85053.2 | — | — | — | — | — | — | 11.0 | 0.04 | 7 |
| LYD778 | 85053.3 | 62.6 | 0.30 | 12 | 817.9 | 0.24 | 20 | 11.2 | 0.01 | 9 |
| LYD774 | 83938.1 | — | — | — | — | — | — | 10.8 | 0.16 | 4 |
| LYD774 | 83938.4 | 65.0 | 0.19 | 16 | — | — | — | — | — | — |
| LYD774 | 83940.2 | 70.6 | 0.05 | 26 | 868.8 | 0.05 | 27 | 11.2 | L | 9 |
| LYD769 | 84121.5 | 77.5 | 0.09 | 38 | — | — | — | 11.0 | 0.14 | 7 |
| LYD769 | 84123.1 | 73.3 | 0.27 | 31 | 851.8 | 0.21 | 25 | 11.2 | 0.01 | 9 |
| LYD769 | 84123.3 | — | — | — | — | — | — | 11.2 | 0.01 | 9 |
| LYD756 | 85067.2 | — | — | — | 881.2 | 0.28 | 29 | 11.1 | 0.02 | 8 |
| LYD756 | 85069.8 | 69.4 | 0.24 | 24 | — | — | — | 10.9 | 0.10 | 6 |
| LYD752 | 85046.5 | — | — | — | 743.8 | 0.29 | 9 | — | — | — |
| LYD752 | 85047.2 | — | — | — | — | — | — | 10.7 | 0.19 | 4 |
| LYD752 | 85049.1 | 77.5 | L | 38 | 887.5 | 0.10 | 30 | 11.1 | 0.02 | 8 |
| LYD741 | 84426.6 | 67.1 | 0.25 | 20 | — | — | — | — | — | — |
| LYD741 | 84426.7 | — | — | — | — | — | — | 10.8 | 0.17 | 5 |
| LYD702 | 84412.3 | — | — | — | — | — | — | 10.7 | 0.29 | 4 |
| CONT. | — | 56.1 | — | — | 683.9 | — | — | 10.3 | — | — |
| LYD917 | 84186.4 | — | — | — | — | — | — | 11.8 | L | 8 |
| LYD917 | 84187.1 | 57.0 | 0.19 | 22 | — | — | — | — | — | — |
| LYD917 | 84188.2 | 53.1 | 0.21 | 14 | — | — | — | — | — | — |
| LYD917 | 84188.3 | 53.2 | 0.09 | 14 | — | — | — | — | — | — |
| LYD912 | 83820.5 | — | — | — | — | — | — | 11.4 | 0.14 | 5 |
| LYD908 | 84447.4 | 58.3 | 0.23 | 25 | — | — | — | 11.4 | 0.14 | 5 |
| LYD905 | 84145.4 | 52.5 | 0.19 | 13 | — | — | — | — | — | — |
| LYD905 | 84146.3 | 56.9 | 0.09 | 22 | 662.5 | 0.01 | 33 | 11.9 | 0.02 | 9 |
| LYD905 | 84147.2 | 54.4 | 0.03 | 17 | — | — | — | 11.4 | 0.12 | 4 |
| LYD905 | 84147.5 | — | — | — | — | — | — | 11.4 | — | — |
| LYD860 | 83625.4 | 50.5 | 0.29 | 9 | — | — | — | 11.2 | 0.29 | 3 |
| LYD838 | 83997.2 | — | — | — | — | — | — | 11.4 | 0.26 | 4 |
| LYD838 | 83998.1 | — | — | — | — | — | — | 11.4 | 0.26 | 4 |
| LYD838 | 83999.2 | — | — | — | — | — | — | 11.2 | 0.29 | 3 |
| LYD838 | 84000.2 | 52.1 | 0.17 | 12 | 566.1 | 0.19 | 14 | 11.6 | 0.03 | 6 |
| LYD836 | 83516.2 | — | — | — | — | — | — | 11.2 | 0.24 | 3 |
| LYD836 | 83518.2 | — | — | — | 568.8 | 0.25 | 14 | — | — | — |
| LYD835 | 84141.2 | — | — | — | — | — | — | 11.2 | 0.24 | 3 |
| LYD835 | 84141.3 | — | — | — | — | — | — | 11.3 | 0.14 | 4 |
| LYD809 | 83504.4 | — | — | — | — | — | — | 11.4 | 0.07 | 5 |
| LYD767 | 83485.1 | — | — | — | 681.2 | L | 37 | — | — | — |
| LYD767 | 83488.1 | — | — | — | 562.5 | 0.26 | 13 | — | — | — |

TABLE 178-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD767 | 83488.5 | 58.1 | 0.16 | 25 | — | — | — | 11.4 | 0.29 | 5 |
| LYD742 | 83467.4 | 63.9 | 0.28 | 37 | — | — | — | — | — | — |
| LYD738 | 84027.1 | — | — | — | 600.0 | 0.15 | 20 | 11.5 | 0.18 | 5 |
| LYD729 | 84159.4 | — | — | — | 573.2 | 0.15 | 15 | — | — | — |
| LYD729 | 84161.2 | 54.8 | 0.08 | 18 | — | — | — | 11.4 | 0.12 | 4 |
| LYD726 | 84593.1 | 51.9 | 0.11 | 12 | — | — | — | — | — | — |
| LYD726 | 84595.3 | — | — | — | — | — | — | 11.8 | L | 8 |
| LYD725 | 84189.3 | 55.0 | 0.03 | 18 | — | — | — | — | — | — |
| LYD705 | 83382.6 | 56.9 | 0.19 | 22 | — | — | — | — | — | — |
| CONT. | — | 46.5 | — | — | 498.7 | — | — | 10.9 | — | — |
| LYD874 | 84407.1 | — | — | — | 721.4 | 0.11 | 10 | — | — | — |
| LYD874 | 85656.1 | 55.0 | 0.04 | 13 | 700.0 | 0.24 | 7 | 10.6 | 0.11 | 8 |
| LYD874 | 85658.1 | 56.9 | 0.05 | 17 | 750.0 | 0.25 | 15 | — | — | — |
| LYD834 | 84452.4 | 54.4 | 0.13 | 12 | — | — | — | 10.8 | 0.18 | 9 |
| LYD829 | 85058.4 | 59.4 | L | 22 | 787.5 | L | 20 | 10.9 | 0.01 | 10 |
| LYD829 | 85058.8 | — | — | — | 752.7 | 0.03 | 15 | 10.7 | 0.02 | 8 |
| LYD829 | 85059.3 | 51.9 | 0.25 | 6 | — | — | — | — | — | — |
| LYD806 | 85557.1 | 68.8 | L | 41 | 906.2 | L | 39 | 11.6 | L | 18 |
| LYD798 | 84533.1 | — | — | — | 731.2 | 0.17 | 12 | 10.2 | 0.27 | 3 |
| LYD798 | 84533.4 | 61.9 | 0.06 | 27 | 731.2 | 0.17 | 12 | — | — | — |
| LYD798 | 84533.5 | 53.1 | 0.21 | 9 | — | — | — | — | — | — |
| LYD794 | 86031.4 | — | — | — | 706.2 | 0.23 | 8 | — | — | — |
| LYD765 | 85811.2 | 58.8 | 0.25 | 21 | 768.8 | 0.15 | 18 | 10.8 | 0.21 | 10 |
| LYD765 | 85811.3 | — | — | — | 751.8 | 0.06 | 15 | — | — | — |
| LYD765 | 85814.2 | 66.2 | L | 36 | 825.0 | 0.16 | 26 | — | — | — |
| LYD762 | 85112.5 | 66.9 | 0.25 | 37 | 837.5 | 0.29 | 28 | 11.3 | 0.04 | 15 |
| LYD762 | 85112.7 | — | — | — | — | — | — | 10.6 | 0.11 | 8 |
| LYD762 | 85114.3 | 60.6 | 0.01 | 24 | 781.2 | 0.12 | 20 | 10.8 | 0.18 | 9 |
| LYD761 | 83477.2 | 54.4 | 0.06 | 12 | — | — | — | 10.2 | 0.27 | 3 |
| LYD760 | 83699.1 | 58.0 | L | 19 | — | — | — | 10.6 | 0.11 | 8 |
| LYD760 | 83703.2 | 57.5 | 0.08 | 18 | — | — | — | — | — | — |
| LYD754 | 85597.1 | 56.2 | 0.11 | 15 | 737.5 | 0.30 | 13 | — | — | — |
| LYD754 | 85597.2 | 57.5 | 0.02 | 18 | 737.5 | 0.06 | 13 | 10.4 | 0.08 | 6 |
| LYD754 | 85598.1 | — | — | — | — | — | — | 10.6 | 0.19 | 7 |
| LYD751 | 85720.2 | 59.4 | 0.02 | 22 | 768.8 | 0.23 | 18 | — | — | — |
| LYD751 | 85720.3 | — | — | — | — | — | — | 10.6 | 0.23 | 8 |
| LYD749 | 84423.6 | — | — | — | — | — | — | 10.3 | 0.22 | 4 |
| LYD749 | 84423.8 | — | — | — | — | — | — | 10.5 | 0.29 | 7 |
| LYD711 | 85315.1 | — | — | — | — | — | — | 10.9 | 0.01 | 10 |
| LYD711 | 85316.3 | 55.6 | 0.20 | 14 | 725.0 | 0.09 | 11 | — | — | — |
| LYD711 | 85316.5 | 70.6 | L | 45 | 868.8 | L | 33 | 11.2 | L | 14 |
| LYD703 | 85102.2 | — | — | — | — | — | — | 10.2 | 0.27 | 3 |
| CONT. | — | 48.8 | — | — | 653.6 | — | — | 9.86 | — | — |
| LYD925 | 85840.1 | — | — | — | — | — | — | 9.69 | 0.10 | 8 |
| LYD925 | 85844.1 | 112.5 | 0.11 | 12 | 1387.5 | 0.16 | 11 | 9.50 | L | 6 |
| LYD924 | 86506.3 | 112.5 | 0.11 | 12 | — | — | — | — | — | — |
| LYD924 | 86506.5 | 111.9 | 0.29 | 12 | 1362.5 | 0.24 | 9 | 9.69 | L | 8 |
| LYD884 | 84576.1 | 128.1 | 0.17 | 28 | — | — | — | 9.31 | 0.05 | 3 |
| LYD884 | 84579.2 | — | — | — | — | — | — | 9.56 | L | 6 |
| LYD884 | 84580.3 | — | — | — | — | — | — | 9.62 | 0.03 | 7 |
| LYD879 | 85963.1 | 127.5 | 0.02 | 27 | 1556.2 | 0.20 | 24 | 9.44 | 0.19 | 5 |
| LYD879 | 85964.1 | — | — | — | — | — | — | 9.25 | 0.24 | 3 |
| LYD878 | 84487.1 | 110.6 | 0.16 | 11 | 1393.8 | 0.11 | 11 | 9.50 | 0.06 | 6 |
| LYD878 | 84488.11 | — | — | — | — | — | — | 9.19 | 0.21 | 2 |
| LYD878 | 84488.5 | 113.1 | 0.15 | 13 | 1362.5 | 0.20 | 9 | — | — | — |
| LYD878 | 84488.8 | 111.9 | 0.29 | 12 | 1475.0 | 0.24 | 18 | — | — | — |
| LYD834 | 84452.3 | — | — | — | — | — | — | 9.62 | 0.19 | 7 |
| LYD834 | 84452.4 | — | — | — | 1343.8 | 0.28 | 7 | — | — | — |
| LYD829 | 85058.3 | 120.6 | 0.02 | 21 | 1531.2 | 0.22 | 22 | — | — | — |
| LYD829 | 85058.4 | 108.8 | 0.22 | 9 | — | — | — | 9.50 | 0.06 | 6 |
| LYD829 | 85058.8 | 122.5 | 0.16 | 22 | 1450.0 | 0.11 | 16 | 9.50 | L | 6 |
| LYD829 | 85059.2 | — | — | — | 1481.2 | 0.29 | 18 | — | — | — |
| LYD829 | 85059.3 | 108.8 | 0.22 | 9 | 1375.0 | 0.17 | 10 | 9.56 | L | 6 |
| LYD813 | 83725.1 | 115.6 | 0.25 | 16 | 1493.8 | 0.15 | 19 | — | — | — |
| LYD813 | 83725.2 | 112.5 | 0.19 | 12 | 1443.8 | 0.10 | 15 | 9.75 | 0.15 | 8 |
| LYD813 | 83726.5 | — | — | — | — | — | — | 9.31 | 0.30 | 3 |
| LYD813 | 83728.1 | — | — | — | 1356.2 | 0.22 | 8 | — | — | — |
| LYD804 | 84134.1 | 121.9 | 0.02 | 22 | 1568.8 | L | 25 | — | — | — |
| LYD804 | 84134.2 | 110.6 | 0.28 | 11 | — | — | — | 9.56 | 0.13 | 6 |
| LYD804 | 84137.5 | — | — | — | — | — | — | 9.25 | 0.08 | 3 |
| LYD804 | 84138.2 | 113.8 | 0.08 | 14 | — | — | — | — | — | — |
| LYD804 | 84138.5 | — | — | — | — | — | — | 9.38 | 0.02 | 4 |

TABLE 178-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYD798 | 84533.1 | — | — | — | — | — | — | 9.62 | L | 7 |
| LYD798 | 84533.3 | — | — | — | — | — | — | 9.94 | 0.26 | 10 |
| LYD798 | 84533.6 | — | — | — | 1437.5 | 0.06 | 15 | 10.0 | L | 11 |
| LYD784 | 84605.1 | 113.8 | 0.15 | 14 | 1393.8 | 0.12 | 11 | — | — | — |
| LYD784 | 86519.3 | — | — | — | — | — | — | 10.1 | 0.18 | 12 |
| LYD780 | 86514.1 | — | — | — | — | — | — | 9.44 | 0.01 | 5 |
| LYD780 | 86514.2 | 121.2 | 0.26 | 21 | 1531.2 | 0.15 | 22 | 9.69 | 0.10 | 8 |
| LYD757 | 83470.2 | — | — | — | — | — | — | 9.56 | 0.30 | 6 |
| LYD757 | 83470.5 | — | — | — | 1450.0 | 0.24 | 16 | 9.69 | 0.24 | 8 |
| LYD757 | 83472.1 | 110.0 | 0.28 | 10 | 1400.0 | 0.10 | 12 | — | — | — |
| LYD757 | 83473.4 | — | — | — | — | — | — | 9.62 | 0.03 | 7 |
| LYD754 | 85597.1 | 124.4 | 0.08 | 24 | 1587.5 | 0.19 | 27 | 10.0 | L | 11 |
| LYD754 | 85597.2 | 125.0 | 0.06 | 25 | 1568.8 | 0.02 | 25 | — | — | — |
| LYD754 | 85599.4 | — | — | — | — | — | — | 9.50 | 0.06 | 6 |
| LYD751 | 85720.3 | 118.1 | 0.06 | 18 | 1587.5 | L | 27 | 9.75 | 0.15 | 8 |
| LYD751 | 85722.1 | 127.5 | 0.04 | 27 | 1606.2 | L | 28 | 9.69 | 0.10 | 8 |
| LYD751 | 85722.2 | 114.4 | 0.07 | 14 | 1443.8 | 0.07 | 15 | 9.75 | 0.15 | 8 |
| LYD751 | 85724.1 | — | — | — | — | — | — | 9.88 | 0.01 | 10 |
| LYD722 | 84941.2 | 113.8 | 0.11 | 14 | 1387.5 | 0.19 | 11 | 9.25 | 0.24 | 3 |
| LYD722 | 84944.3 | — | — | — | — | — | — | 9.31 | 0.30 | 3 |
| LYD722 | 84945.1 | — | — | — | — | — | — | 10.2 | L | 13 |
| LYD714 | 84071.1 | 109.1 | 0.25 | 9 | 1397.3 | 0.14 | 12 | — | — | — |
| LYD714 | 84074.2 | 123.8 | 0.01 | 24 | 1412.5 | 0.13 | 13 | — | — | — |
| LYD714 | 84075.1 | — | — | — | — | — | — | 9.44 | 0.01 | 5 |
| LYD714 | 84075.4 | — | — | — | — | — | — | 9.50 | 0.06 | 6 |
| LYD702 | 84411.6 | — | — | — | — | — | — | 9.19 | 0.21 | 2 |
| LYD702 | 84411.8 | — | — | — | 1343.8 | 0.28 | 7 | — | — | — |
| LYD702 | 84412.3 | 121.9 | 0.01 | 22 | 1493.8 | 0.05 | 19 | 10.1 | 0.15 | 12 |
| LYD702 | 84412.6 | 115.0 | 0.06 | 15 | 1362.5 | 0.24 | 9 | — | — | — |
| CONT. | — | 100.1 | — | — | 1252.4 | — | — | 9.00 | — | — |
| LGP49 | 77651.3 | — | — | — | — | — | — | 12.0 | 0.16 | 6 |
| LGP49 | 77651.8 | — | — | — | — | — | — | 12.0 | 0.07 | 6 |
| LGP49 | 77652.6 | — | — | — | — | — | — | 11.8 | 0.26 | 3 |
| CONT. | — | — | — | — | — | — | — | 11.4 | — | — |
| LGP44 | 75764.8 | — | — | — | — | — | — | 11.8 | 0.12 | 4 |
| LGP44 | 75765.3 | — | — | — | 5093.8 | 0.11 | 5 | — | — | — |
| CONT. | — | — | — | — | 4866.7 | — | — | 11.3 | — | — |
| LGP8 | 75409.5 | 278.7 | 0.08 | 6 | 4003.6 | 0.07 | 11 | 11.9 | 0.02 | 8 |
| LGP21 | 76332.1 | 286.3 | 0.18 | 9 | 3945.0 | 0.27 | 9 | — | — | — |
| LGP20 | 76941.5 | — | — | — | — | — | — | 12.0 | 0.01 | 9 |
| CONT. | — | 262.8 | — | — | 3606.2 | — | — | 11.0 | — | — |
| LYD849 | 86622.2 | — | — | — | — | — | — | 10.1 | 0.35 | 5 |
| LYD841 | 85885.2 | — | — | — | 1381.2 | 0.43 | 6 | — | — | — |
| LYD830 | 86932.6 | 113.1 | 0.41 | 6 | — | — | — | — | — | — |
| CONT. | — | 106.6 | — | — | 1307.7 | — | — | 9.61 | — | — |
| LYD926 | 83826.2 | — | — | — | — | — | — | 10.2 | 0.48 | 4 |
| LYD926 | 83830.2 | — | — | — | — | — | — | 10.4 | 0.48 | 6 |
| LYD926 | 83830.3 | 58.6 | 0.45 | 20 | — | — | — | — | — | — |
| CONT. | — | 48.8 | — | — | — | — | — | 9.86 | — | — |
| LYD803 | 87331.3 | — | — | — | — | — | — | 9.88 | 0.06 | 5 |
| CONT. | — | — | — | — | — | — | — | 9.38 | — | — |

Table 178. "CONT."—Control; "Ave."—Average; "% Incr." = % increment; "p-val."—p-value, L- p < 0.01.

TABLE 179

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD888 | 84614.1 | 60.4 | 0.21 | 7 | 7.56 | 0.21 | 7 | — | — | — |
| LYD869_H1 | 85983.1 | 73.8 | 0.01 | 31 | 9.23 | 0.01 | 31 | 5.13 | L | 14 |
| LYD859 | 83953.3 | 61.5 | 0.10 | 9 | 7.69 | 0.10 | 9 | 4.78 | 0.03 | 6 |
| LYD859 | 83957.5 | 68.7 | 0.20 | 22 | 8.58 | 0.20 | 22 | 5.00 | 0.23 | 11 |
| LYD853 | 86496.1 | 66.0 | 0.01 | 17 | 8.25 | 0.01 | 17 | 4.87 | 0.04 | 8 |

TABLE 179-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD853 | 86497.7 | 69.3 | 0.15 | 23 | 8.66 | 0.15 | 23 | 4.95 | L | 10 |
| LYD828 | 85324.4 | 61.9 | 0.08 | 10 | 7.74 | 0.08 | 10 | 4.70 | 0.09 | 4 |
| LYD826 | 85587.1 | 62.2 | 0.24 | 11 | 7.78 | 0.24 | 11 | 4.70 | 0.13 | 4 |
| LYD826 | 85587.2 | 67.2 | 0.03 | 20 | 8.40 | 0.03 | 20 | 4.85 | 0.01 | 8 |
| LYD795 | 85978.4 | 62.7 | 0.18 | 11 | 7.84 | 0.18 | 11 | 4.81 | 0.27 | 7 |
| LYD790 | 84574.2 | 61.6 | 0.27 | 10 | 7.71 | 0.27 | 10 | — | — | — |
| LYD750 | 84966.3 | — | — | — | — | — | — | 4.92 | 0.27 | 9 |
| LYD744 | 86509.2 | — | — | — | — | — | — | 4.64 | 0.21 | 3 |
| LYD744 | 86509.4 | — | — | — | — | — | — | 4.86 | 0.18 | 8 |
| LYD699 | 85972.6 | 64.4 | 0.02 | 15 | 8.05 | 0.02 | 15 | 4.73 | 0.06 | 5 |
| CONT. | — | 56.2 | — | — | 7.03 | — | — | 4.50 | — | — |
| LYD908 | 84445.1 | 79.1 | L | 31 | 9.89 | L | 31 | 5.34 | 0.15 | 13 |
| LYD908 | 84446.1 | 73.5 | 0.02 | 22 | 9.18 | 0.02 | 22 | 5.08 | 0.10 | 7 |
| LYD908 | 84447.1 | 89.9 | L | 49 | 11.2 | L | 49 | 5.56 | L | 17 |
| LYD908 | 84447.4 | 88.3 | L | 47 | 11.0 | L | 47 | 5.70 | 0.01 | 20 |
| LYD876 | 83416.3 | 82.0 | 0.06 | 36 | 10.2 | 0.06 | 36 | 5.28 | 0.03 | 11 |
| LYD876 | 83417.3 | 75.8 | L | 26 | 9.48 | L | 26 | 5.11 | 0.06 | 8 |
| LYD876 | 83418.2 | 72.0 | 0.24 | 20 | 9.00 | 0.24 | 20 | — | — | — |
| LYD865 | 83730.1 | 79.4 | 0.21 | 32 | 9.92 | 0.21 | 32 | 5.29 | 0.23 | 12 |
| LYD865 | 83733.5 | 82.1 | 0.25 | 36 | 10.3 | 0.25 | 36 | — | — | — |
| LYD864 | 83406.4 | 72.1 | 0.03 | 20 | 9.02 | 0.03 | 20 | 5.09 | 0.17 | 7 |
| LYD864 | 83409.3 | 90.2 | 0.05 | 50 | 11.3 | 0.05 | 50 | 5.62 | 0.01 | 19 |
| LYD843 | 83772.1 | 79.4 | L | 32 | 9.93 | L | 32 | 5.37 | 0.06 | 13 |
| LYD843 | 83774.1 | 74.4 | 0.27 | 24 | 9.30 | 0.27 | 24 | — | — | — |
| LYD843 | 83775.2 | 88.9 | 0.15 | 48 | 11.1 | 0.15 | 48 | 5.64 | 0.09 | 19 |
| LYD843 | 83775.4 | 77.7 | 0.07 | 29 | 9.71 | 0.07 | 29 | 5.22 | 0.18 | 10 |
| LYD842 | 83524.4 | 70.0 | 0.17 | 16 | 8.75 | 0.17 | 16 | 5.03 | 0.17 | 6 |
| LYD842 | 83528.2 | 74.0 | 0.03 | 23 | 9.26 | 0.03 | 23 | 5.13 | 0.07 | 8 |
| LYD835 | 84139.1 | 75.2 | 0.01 | 25 | 9.40 | 0.01 | 25 | 5.23 | 0.02 | 10 |
| LYD835 | 84141.3 | 73.7 | 0.03 | 23 | 9.22 | 0.03 | 23 | 5.16 | 0.04 | 9 |
| LYD835 | 84143.1 | 69.7 | 0.19 | 16 | 8.71 | 0.19 | 16 | — | — | — |
| LYD835 | 84143.2 | 80.2 | L | 33 | 10.0 | L | 33 | 5.29 | 0.01 | 11 |
| LYD821 | 84053.3 | 92.5 | L | 54 | 11.6 | L | 54 | 5.67 | L | 20 |
| LYD821 | 84054.1 | 83.7 | L | 39 | 10.5 | L | 39 | 5.40 | L | 14 |
| LYD821 | 84054.4 | 71.8 | 0.03 | 19 | 8.97 | 0.03 | 19 | 5.16 | 0.04 | 9 |
| LYD793 | 83499.7 | 81.1 | 0.29 | 35 | 10.1 | 0.29 | 35 | 5.32 | 0.26 | 12 |
| LYD793 | 83500.4 | 79.2 | 0.02 | 32 | 9.90 | 0.02 | 32 | 5.29 | 0.01 | 11 |
| LYD777 | 83489.3 | 74.8 | 0.12 | 24 | 9.35 | 0.12 | 24 | 5.08 | 0.28 | 7 |
| LYD777 | 83492.3 | 74.1 | 0.01 | 23 | 9.26 | 0.01 | 23 | 5.17 | 0.03 | 9 |
| LYD777 | 83492.4 | 71.3 | 0.04 | 18 | 8.91 | 0.04 | 18 | 5.18 | 0.03 | 9 |
| LYD777 | 83493.3 | 81.4 | L | 35 | 10.2 | L | 35 | 5.34 | L | 13 |
| LYD767 | 83485.1 | 85.4 | L | 42 | 10.7 | L | 42 | 5.50 | 0.04 | 16 |
| LYD767 | 83486.2 | 79.6 | L | 32 | 9.95 | L | 32 | 5.26 | 0.02 | 11 |
| LYD767 | 83488.1 | 73.6 | 0.06 | 22 | 9.20 | 0.06 | 22 | 5.12 | 0.18 | 8 |
| LYD767 | 83488.5 | 73.8 | 0.02 | 23 | 9.23 | 0.02 | 23 | 5.15 | 0.04 | 9 |
| LYD753 | 83916.1 | 77.1 | L | 28 | 9.64 | L | 28 | 5.31 | 0.01 | 12 |
| LYD753 | 83917.6 | 92.4 | L | 54 | 11.5 | L | 54 | 5.66 | L | 19 |
| LYD735 | 84167.1 | 68.7 | 0.25 | 14 | 8.59 | 0.25 | 14 | — | — | — |
| LYD735 | 84168.2 | 78.6 | L | 31 | 9.82 | L | 31 | 5.31 | 0.01 | 12 |
| LYD730 | 84258.3 | 80.7 | L | 34 | 10.1 | L | 34 | 5.32 | 0.07 | 12 |
| LYD729 | 84159.1 | — | — | — | — | — | — | 5.40 | 0.25 | 14 |
| LYD729 | 84159.4 | 76.2 | 0.01 | 27 | 9.52 | 0.01 | 27 | 5.08 | 0.15 | 7 |
| LYD729 | 84159.6 | 77.9 | L | 29 | 9.73 | L | 29 | 5.22 | 0.02 | 10 |
| LYD729 | 84160.3 | 80.6 | L | 34 | 10.1 | L | 34 | 5.25 | 0.04 | 11 |
| LYD729 | 84163.2 | 71.6 | 0.12 | 19 | 8.94 | 0.12 | 19 | 5.15 | 0.17 | 8 |
| LYD726 | 84591.1 | 92.8 | L | 54 | 11.6 | L | 54 | 5.63 | 0.03 | 19 |
| LYD726 | 84593.1 | 90.6 | L | 51 | 11.3 | L | 51 | 5.71 | L | 20 |
| LYD726 | 84595.1 | 80.0 | 0.18 | 33 | 10.00 | 0.18 | 33 | 5.38 | 0.05 | 13 |
| LYD720 | 83761.2 | 71.8 | 0.19 | 19 | 8.98 | 0.19 | 19 | 5.06 | 0.25 | 7 |
| LYD720 | 83761.3 | 66.4 | 0.19 | 10 | 8.30 | 0.19 | 10 | 4.95 | 0.24 | 4 |
| LYD720 | 83763.1 | 88.4 | 0.04 | 47 | 11.0 | 0.04 | 47 | 5.57 | L | 17 |
| LYD720 | 83764.2 | 81.5 | 0.11 | 35 | 10.2 | 0.11 | 35 | 5.34 | 0.12 | 13 |
| LYD720 | 83764.3 | 78.9 | 0.01 | 31 | 9.86 | 0.01 | 31 | 5.30 | 0.05 | 12 |
| LYD705 | 83380.2 | 65.0 | 0.28 | 8 | 8.13 | 0.28 | 8 | — | — | — |
| LYD705 | 83384.4 | 71.3 | 0.04 | 19 | 8.91 | 0.04 | 19 | 5.11 | 0.06 | 8 |
| CONT. | — | 60.2 | — | — | 7.52 | — | — | 4.74 | — | — |
| LGP8 | 75405.1 | 83.7 | 0.27 | 8 | 10.5 | 0.27 | 8 | 5.33 | 0.26 | 5 |
| CONT. | — | 77.7 | — | — | 9.71 | — | — | 5.09 | — | — |
| LGP43 | 76955.2 | 77.8 | 0.24 | 6 | 9.73 | 0.24 | 6 | 5.26 | 0.17 | 4 |
| CONT. | — | 73.2 | — | — | 9.15 | — | — | 5.06 | — | — |
| LYD914 | 84179.2 | 120.1 | 0.03 | 28 | 15.0 | 0.03 | 28 | 6.58 | 0.14 | 14 |

TABLE 179-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD914 | 84179.4 | 101.4 | 0.22 | 8 | 12.7 | 0.22 | 8 | — | — | — |
| LYD914 | 84183.6 | 121.1 | L | 29 | 15.1 | L | 29 | 6.73 | L | 16 |
| LYD892 | 84250.7 | 130.4 | 0.15 | 39 | 16.3 | 0.15 | 39 | 6.63 | 0.07 | 15 |
| LYD876 | 83418.3 | 113.1 | 0.15 | 20 | 15.1 | L | 28 | 6.66 | L | 15 |
| LYD864 | 83409.3 | 102.8 | 0.25 | 9 | 12.8 | 0.25 | 9 | 6.07 | 0.08 | 5 |
| LYD864 | 83409.4 | 120.0 | L | 28 | 15.0 | L | 28 | 6.52 | L | 13 |
| LYD843 | 83774.1 | 106.9 | 0.08 | 14 | 13.4 | 0.08 | 14 | 6.17 | 0.02 | 7 |
| LYD842 | 83526.5 | 113.0 | 0.01 | 20 | 14.1 | 0.01 | 20 | 6.44 | L | 11 |
| LYD781 | 83498.3 | 104.4 | 0.21 | 11 | 13.1 | 0.21 | 11 | 6.18 | 0.06 | 7 |
| LYD755 | 84035.2 | — | — | — | — | — | — | 5.98 | 0.22 | 3 |
| LYD753 | 83917.2 | 120.5 | 0.20 | 28 | 15.1 | 0.20 | 28 | 6.63 | 0.26 | 15 |
| LYD735 | 84165.1 | 113.5 | 0.03 | 21 | 14.2 | 0.03 | 21 | 6.28 | 0.14 | 9 |
| LYD727 | 83791.1 | 109.7 | 0.03 | 17 | 13.7 | 0.03 | 17 | 6.36 | 0.06 | 10 |
| LYD727 | 83795.2 | 119.1 | 0.07 | 27 | 14.9 | 0.07 | 27 | 6.51 | 0.02 | 13 |
| LYD722 | 84944.3 | 116.2 | 0.27 | 24 | 14.5 | 0.27 | 24 | — | — | — |
| LYD722 | 84944.4 | 123.9 | L | 32 | 15.5 | L | 32 | 6.57 | L | 13 |
| LYD720 | 83763.1 | 109.8 | 0.07 | 17 | 13.7 | 0.07 | 17 | 6.35 | L | 10 |
| CONT. | — | 94.0 | — | — | 11.7 | — | — | 5.79 | — | — |
| LYD922 | 83821.3 | 97.5 | 0.21 | 23 | 12.2 | 0.21 | 23 | 5.91 | 0.03 | 11 |
| LYD922 | 83823.6 | 94.3 | 0.03 | 19 | 11.8 | 0.03 | 19 | 5.81 | 0.01 | 9 |
| LYD901 | 83883.2 | 91.1 | 0.13 | 15 | 11.5 | 0.07 | 16 | 5.74 | 0.02 | 8 |
| LYD901 | 83886.6 | 93.9 | 0.04 | 19 | 11.7 | 0.04 | 19 | 5.72 | 0.09 | 8 |
| LYD883 | 83911.3 | — | — | — | — | — | — | 5.47 | 0.29 | 3 |
| LYD883 | 83912.2 | 91.2 | 0.05 | 15 | 11.4 | 0.05 | 15 | 5.70 | 0.05 | 7 |
| LYD883 | 83912.3 | 103.9 | L | 31 | 13.0 | L | 31 | 6.03 | 0.01 | 14 |
| LYD860 | 83625.4 | 93.8 | 0.05 | 19 | 11.7 | 0.05 | 19 | 5.81 | 0.09 | 9 |
| LYD836 | 83514.4 | 99.3 | 0.30 | 26 | 12.4 | 0.30 | 26 | 5.88 | 0.24 | 11 |
| LYD836 | 83515.5 | 88.7 | 0.23 | 12 | 11.1 | 0.23 | 12 | 5.55 | 0.28 | 5 |
| LYD833 | 83512.2 | 86.9 | 0.16 | 10 | 10.9 | 0.16 | 10 | 5.56 | 0.12 | 5 |
| LYD833 | 83513.5 | 94.1 | 0.03 | 19 | 11.8 | 0.03 | 19 | 5.79 | 0.01 | 9 |
| LYD811 | 83713.4 | — | — | — | — | — | — | 5.53 | 0.18 | 4 |
| LYD755 | 84032.1 | 87.0 | 0.18 | 10 | 10.9 | 0.18 | 10 | 5.49 | 0.28 | 3 |
| LYD755 | 84035.1 | 97.0 | 0.01 | 23 | 12.1 | 0.01 | 23 | 5.80 | 0.01 | 9 |
| LYD755 | 84035.2 | 93.6 | 0.14 | 18 | 11.7 | 0.14 | 18 | 5.67 | 0.09 | 7 |
| LYD742 | 83467.3 | — | — | — | — | — | — | 5.56 | 0.27 | 5 |
| LYD725 | 84190.3 | 96.3 | 0.03 | 22 | 12.0 | 0.03 | 22 | 5.83 | 0.02 | 10 |
| LYD725 | 84191.1 | 94.6 | 0.02 | 20 | 11.8 | 0.02 | 20 | 5.70 | 0.23 | 7 |
| LYD725 | 84191.2 | 85.9 | 0.29 | 9 | 10.7 | 0.29 | 9 | 5.68 | 0.25 | 7 |
| CONT. | — | 79.1 | — | — | 9.89 | — | — | 5.31 | — | — |
| LYD925 | 85844.1 | 104.1 | 0.09 | 30 | 13.0 | 0.09 | 30 | 6.17 | 0.18 | 14 |
| LYD925 | 85844.3 | 89.2 | 0.21 | 11 | 11.2 | 0.21 | 11 | 5.74 | 0.16 | 6 |
| LYD920 | 83760.3 | 88.3 | 0.19 | 10 | 11.0 | 0.19 | 10 | 5.65 | 0.28 | 4 |
| LYD869_H1 | 85982.5 | 88.2 | 0.18 | 10 | 11.0 | 0.18 | 10 | 5.95 | 0.04 | 10 |
| LYD869_H1 | 85983.1 | 101.4 | 0.19 | 27 | 12.7 | 0.19 | 27 | 6.17 | 0.10 | 14 |
| LYD854 | 84993.2 | 91.0 | 0.09 | 14 | 11.4 | 0.09 | 14 | 5.90 | 0.08 | 9 |
| LYD826 | 85587.1 | 99.6 | 0.08 | 24 | 12.5 | 0.08 | 24 | 6.08 | 0.02 | 12 |
| LYD826 | 85587.5 | 91.4 | 0.15 | 14 | 11.4 | 0.15 | 14 | — | — | — |
| LYD824 | 83903.3 | 107.2 | 0.10 | 34 | 13.4 | 0.10 | 34 | 6.50 | 0.15 | 20 |
| LYD824 | 83905.3 | 106.6 | L | 33 | 13.3 | L | 33 | 6.33 | 0.04 | 17 |
| LYD824 | 83907.2 | 94.5 | 0.06 | 18 | 11.8 | 0.06 | 18 | 5.83 | 0.08 | 8 |
| LYD824 | 83907.6 | 89.3 | 0.16 | 12 | 11.2 | 0.16 | 12 | — | — | — |
| LYD816 | 85591.1 | 118.1 | L | 47 | 14.8 | L | 47 | 6.89 | 0.04 | 27 |
| LYD816 | 85594.2 | 93.1 | 0.16 | 16 | 11.6 | 0.16 | 16 | 5.90 | 0.13 | 9 |
| LYD791 | 85129.4 | 103.3 | 0.07 | 29 | 12.9 | 0.07 | 29 | 6.10 | 0.19 | 13 |
| LYD791 | 85129.5 | 100.0 | L | 25 | 13.4 | 0.06 | 34 | 6.45 | 0.02 | 19 |
| LYD790 | 84574.2 | 124.0 | L | 55 | 15.5 | L | 55 | 6.83 | L | 26 |
| LYD778 | 85053.3 | 93.6 | 0.05 | 17 | 11.7 | 0.05 | 17 | 5.87 | 0.07 | 8 |
| LYD774 | 83938.4 | 96.8 | 0.04 | 21 | 12.1 | 0.04 | 21 | 5.96 | 0.07 | 10 |
| LYD774 | 83940.2 | 102.3 | L | 28 | 12.8 | L | 28 | 6.04 | 0.02 | 12 |
| LYD769 | 84121.5 | — | — | — | — | — | — | 6.28 | 0.23 | 16 |
| LYD769 | 84123.1 | 106.0 | L | 32 | 13.2 | L | 32 | 6.12 | 0.08 | 13 |
| LYD769 | 84123.3 | 106.1 | 0.06 | 32 | 13.3 | 0.06 | 32 | 6.19 | 0.17 | 14 |
| LYD756 | 85067.2 | 95.5 | 0.10 | 19 | 11.9 | 0.10 | 19 | — | — | — |
| LYD756 | 85069.8 | 94.8 | 0.27 | 18 | 11.9 | 0.27 | 18 | — | — | — |
| LYD752 | 85046.5 | — | — | — | — | — | — | 5.71 | 0.23 | 5 |
| LYD752 | 85049.1 | 102.7 | 0.16 | 28 | 12.8 | 0.16 | 28 | 6.19 | 0.24 | 14 |
| CONT. | — | 80.0 | — | — | 10.0 | — | — | 5.41 | — | — |
| LYD905 | 84146.3 | 112.0 | 0.18 | 14 | 14.0 | 0.18 | 14 | 6.15 | 0.25 | 3 |
| LYD838 | 83997.1 | — | — | — | — | — | — | 6.12 | 0.28 | 3 |
| LYD835 | 84141.3 | — | — | — | — | — | — | 6.34 | 0.23 | 6 |
| LYD767 | 83485.1 | 110.1 | 0.08 | 12 | 13.8 | 0.08 | 12 | 6.20 | 0.14 | 4 |

TABLE 179-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYD767 | 83488.1 | 111.0 | 0.06 | 13 | 13.9 | 0.06 | 13 | 6.43 | 0.05 | 8 |
| LYD726 | 84593.1 | — | — | — | — | — | — | 6.22 | 0.24 | 4 |
| LYD725 | 84189.3 | 107.3 | 0.16 | 9 | 13.4 | 0.16 | 9 | — | — | — |
| CONT. | — | 98.5 | — | — | 12.3 | — | — | 5.95 | — | — |
| LYD874 | 85658.1 | 83.5 | 0.29 | 8 | 10.4 | 0.29 | 8 | — | — | — |
| LYD834 | 84452.4 | — | — | — | — | — | — | 5.65 | 0.29 | 6 |
| LYD829 | 85058.4 | 87.6 | 0.13 | 13 | 11.0 | 0.13 | 13 | 5.62 | 0.22 | 5 |
| LYD829 | 85058.8 | 86.8 | 0.21 | 12 | 10.8 | 0.21 | 12 | — | — | — |
| LYD806 | 85557.1 | 111.4 | 0.05 | 44 | 13.9 | 0.05 | 44 | 6.35 | L | 19 |
| LYD806 | 85557.17 | 84.7 | 0.26 | 10 | 10.6 | 0.26 | 10 | 5.69 | 0.25 | 7 |
| LYD798 | 84533.1 | 89.8 | 0.07 | 16 | 11.2 | 0.07 | 16 | 5.66 | 0.15 | 6 |
| LYD798 | 84533.4 | 98.6 | 0.01 | 28 | 12.3 | 0.01 | 28 | 6.08 | 0.18 | 14 |
| LYD765 | 85811.2 | 89.0 | 0.24 | 15 | 11.1 | 0.24 | 15 | 5.71 | 0.12 | 7 |
| LYD762 | 85112.5 | 96.9 | 0.01 | 25 | 12.1 | 0.01 | 25 | 6.02 | 0.01 | 13 |
| LYD762 | 85114.3 | 102.8 | 0.05 | 33 | 12.8 | 0.05 | 33 | 6.29 | L | 18 |
| LYD754 | 85597.1 | 87.0 | 0.12 | 13 | 10.9 | 0.12 | 13 | — | — | — |
| LYD754 | 85597.2 | 98.0 | L | 27 | 12.2 | L | 27 | 5.99 | 0.02 | 12 |
| LYD749 | 84423.6 | — | — | — | — | — | — | 5.86 | 0.15 | 10 |
| LYD711 | 85315.1 | 89.3 | 0.23 | 16 | 11.2 | 0.23 | 16 | 5.71 | 0.11 | 7 |
| LYD711 | 85316.5 | 106.0 | 0.22 | 37 | 13.3 | 0.22 | 37 | 6.21 | 0.20 | 16 |
| CONT. | — | 77.3 | — | — | 9.66 | — | — | 5.34 | — | — |
| LYD925 | 85840.1 | 54.6 | 0.04 | 13 | 6.83 | 0.04 | 13 | 4.43 | L | 7 |
| LYD925 | 85844.1 | 57.6 | 0.01 | 19 | 7.20 | 0.01 | 19 | 4.67 | L | 13 |
| LYD924 | 86506.1 | — | — | — | — | — | — | 4.27 | 0.26 | 3 |
| LYD924 | 86506.5 | 54.3 | 0.07 | 12 | 6.79 | 0.07 | 12 | 4.44 | 0.11 | 8 |
| LYD924 | 86507.1 | 60.7 | 0.08 | 26 | 7.59 | 0.08 | 26 | 4.82 | L | 17 |
| LYD884 | 84576.1 | 54.2 | 0.04 | 12 | 6.77 | 0.04 | 12 | 4.45 | L | 8 |
| LYD884 | 84579.2 | — | — | — | — | — | — | 4.46 | 0.05 | 8 |
| LYD879 | 85963.1 | 63.3 | 0.21 | 31 | 7.91 | 0.21 | 31 | 4.60 | 0.23 | 11 |
| LYD879 | 85964.1 | — | — | — | — | — | — | 4.32 | 0.18 | 5 |
| LYD878 | 84487.1 | 53.6 | 0.11 | 11 | 6.70 | 0.11 | 11 | — | — | — |
| LYD878 | 84488.5 | 57.4 | L | 19 | 7.17 | L | 19 | 4.57 | 0.10 | 11 |
| LYD878 | 84488.8 | 57.5 | 0.28 | 19 | 7.19 | 0.28 | 19 | — | — | — |
| LYD834 | 84452.3 | 60.6 | L | 26 | 7.58 | L | 26 | 4.75 | L | 15 |
| LYD834 | 84452.4 | 57.4 | 0.18 | 19 | 7.17 | 0.18 | 19 | 4.57 | 0.28 | 11 |
| LYD829 | 85058.3 | 62.2 | 0.23 | 29 | 7.77 | 0.23 | 29 | — | — | — |
| LYD829 | 85058.4 | 54.0 | 0.05 | 12 | 6.75 | 0.05 | 12 | 4.28 | 0.12 | 4 |
| LYD829 | 85059.2 | 63.1 | L | 31 | 7.89 | L | 31 | 4.77 | L | 15 |
| LYD829 | 85059.3 | 55.5 | 0.01 | 15 | 6.94 | 0.01 | 15 | 4.41 | 0.01 | 7 |
| LYD813 | 83725.1 | 57.3 | 0.09 | 19 | 7.17 | 0.09 | 19 | 4.54 | 0.12 | 10 |
| LYD813 | 83725.2 | 56.8 | 0.06 | 18 | 7.10 | 0.06 | 18 | 4.41 | 0.08 | 7 |
| LYD813 | 83726.4 | 52.6 | 0.22 | 9 | 6.58 | 0.22 | 9 | — | — | — |
| LYD804 | 84134.1 | 62.3 | 0.04 | 29 | 7.79 | 0.04 | 29 | 4.59 | 0.12 | 11 |
| LYD798 | 84533.1 | 53.4 | 0.05 | 10 | 6.67 | 0.05 | 10 | 4.36 | 0.05 | 6 |
| LYD798 | 84533.3 | 57.2 | L | 18 | 7.15 | L | 18 | 4.49 | 0.02 | 9 |
| LYD798 | 84533.5 | — | — | — | — | — | — | 4.31 | 0.23 | 4 |
| LYD798 | 84533.6 | 58.7 | L | 21 | 7.33 | L | 21 | 4.48 | L | 8 |
| LYD784 | 84605.1 | 52.1 | 0.13 | 8 | 6.52 | 0.13 | 8 | 4.34 | 0.05 | 5 |
| LYD780 | 86514.2 | 59.8 | 0.24 | 24 | 7.48 | 0.24 | 24 | — | — | — |
| LYD757 | 83470.5 | 59.5 | 0.27 | 23 | 7.43 | 0.27 | 23 | 4.67 | 0.11 | 13 |
| LYD757 | 83472.1 | 52.2 | 0.12 | 8 | 6.53 | 0.12 | 8 | 4.45 | L | 8 |
| LYD757 | 83473.4 | 59.2 | L | 23 | 7.40 | L | 23 | 4.40 | 0.02 | 7 |
| LYD754 | 85597.1 | 67.7 | 0.16 | 40 | 8.46 | 0.16 | 40 | 4.93 | 0.11 | 19 |
| LYD754 | 85597.2 | 60.3 | L | 25 | 7.54 | L | 25 | 4.59 | L | 11 |
| LYD754 | 85598.1 | 51.5 | 0.17 | 7 | 6.44 | 0.17 | 7 | 4.40 | 0.09 | 7 |
| LYD751 | 85720.2 | — | — | — | 6.53 | 0.11 | 8 | 4.45 | 0.21 | 8 |
| LYD751 | 85720.3 | 63.7 | 0.07 | 32 | 7.96 | 0.07 | 32 | 4.69 | 0.01 | 13 |
| LYD751 | 85722.1 | 58.1 | L | 20 | 7.27 | L | 20 | 4.46 | L | 8 |
| LYD751 | 85722.2 | 56.6 | 0.07 | 17 | 7.08 | 0.07 | 17 | 4.39 | 0.19 | 6 |
| LYD751 | 85724.1 | 53.2 | 0.05 | 10 | 6.66 | 0.05 | 10 | — | — | — |
| LYD722 | 84941.1 | 53.8 | 0.16 | 11 | 6.73 | 0.16 | 11 | 4.36 | 0.18 | 6 |
| LYD722 | 84941.2 | 57.8 | 0.19 | 20 | 7.23 | 0.19 | 20 | 4.43 | 0.09 | 7 |
| LYD722 | 84945.1 | 53.9 | 0.04 | 12 | 6.73 | 0.04 | 12 | 4.35 | 0.04 | 5 |
| LYD714 | 84071.1 | 54.0 | 0.03 | 12 | 6.75 | 0.03 | 12 | 4.45 | 0.08 | 8 |
| LYD714 | 84074.2 | 53.9 | 0.23 | 12 | 6.74 | 0.23 | 12 | — | — | — |
| LYD702 | 84412.2 | 52.2 | 0.15 | 8 | 6.53 | 0.15 | 8 | 4.34 | 0.04 | 5 |
| LYD702 | 84412.3 | 60.6 | 0.10 | 25 | 7.57 | 0.10 | 25 | 4.49 | 0.11 | 9 |
| LYD702 | 84412.6 | 55.2 | 0.02 | 14 | 6.90 | 0.02 | 14 | 4.38 | 0.02 | 6 |
| CONT. | — | 48.3 | — | — | 6.04 | — | — | 4.13 | — | — |
| LGP49 | 77652.6 | 80.4 | 0.09 | 16 | 10.0 | 0.09 | 16 | 5.17 | 0.27 | 5 |
| CONT. | — | 69.2 | — | — | 8.65 | — | — | 4.94 | — | — |

TABLE 179-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LGP25 | 75389.4 | — | — | — | — | — | — | 5.72 | 0.12 | 5 |
| LGP25 | 75390.4 | 92.5 | 0.28 | 5 | 11.6 | 0.28 | 5 | 5.67 | 0.10 | 4 |
| CONT. | — | 88.4 | — | — | 11.1 | — | — | 5.43 | — | — |
| LGP44 | 75764.8 | 68.2 | 0.06 | 9 | 8.53 | 0.06 | 9 | 4.75 | 0.06 | 3 |
| LGP10 | 75385.3 | 68.6 | 0.29 | 9 | 8.57 | 0.29 | 9 | 4.81 | 0.21 | 5 |
| CONT. | — | 62.8 | — | — | 7.85 | — | — | 4.60 | — | — |
| LGP20 | 76941.5 | 110.1 | 0.08 | 20 | 13.8 | 0.08 | 20 | 6.24 | 0.11 | 12 |
| CONT. | — | 91.9 | — | — | 11.5 | — | — | 5.59 | — | — |
| LYD845 | 83399.3 | — | — | — | — | — | — | 6.06 | 0.36 | 5 |
| CONT. | — | — | — | — | — | — | — | 5.79 | — | — |
| LYD851 | 85197.1 | 60.4 | 0.41 | 4 | 7.55 | 0.41 | 4 | — | — | — |
| CONT. | — | 57.9 | — | — | 7.23 | — | — | — | — | — |
| LYD803 | 85074.1 | — | — | — | — | — | — | 5.18 | 0.39 | 9 |
| LYD803 | 87327.1 | — | — | — | — | — | — | 5.10 | 0.45 | 7 |
| LYD803 | 87331.3 | 59.6 | 0.10 | 13 | 7.45 | 0.10 | 13 | 5.04 | 0.23 | 6 |
| CONT. | — | 52.6 | — | — | 6.57 | — | — | 4.76 | — | — |

Table 179. "CONT."—Control; "Ave."—Average; "% Incr." = % increment; "p-val."—p-value, L- p < 0.01.

TABLE 180

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD869_H1 | 85983.1 | — | — | — | 9.38 | 0.03 | 32 | 0.438 | 0.06 | 17 |
| LYD859 | 83953.3 | — | — | — | — | — | — | 0.416 | 0.20 | 11 |
| LYD859 | 83957.5 | 0.686 | 0.26 | 21 | 8.67 | 0.14 | 22 | — | — | — |
| LYD853 | 86496.1 | — | — | — | 8.33 | 0.23 | 17 | — | — | — |
| LYD853 | 86497.7 | — | — | — | 8.68 | 0.13 | 22 | — | — | — |
| LYD826 | 85587.2 | 0.685 | 0.27 | 21 | 8.56 | 0.16 | 20 | 0.411 | 0.27 | 10 |
| LYD750 | 84966.3 | — | — | — | 8.69 | 0.14 | 22 | 0.426 | 0.15 | 14 |
| LYD744 | 86509.4 | — | — | — | — | — | — | 0.411 | 0.27 | 10 |
| LYD699 | 85972.6 | — | — | — | 8.22 | 0.27 | 16 | — | — | — |
| CONT. | — | 0.566 | — | — | 7.12 | — | — | 0.374 | — | — |
| LYD908 | 84445.1 | — | — | — | 10.5 | 0.08 | 32 | 0.522 | 0.18 | 14 |
| LYD908 | 84446.1 | — | — | — | 9.62 | 0.23 | 21 | — | — | — |
| LYD908 | 84447.1 | 0.822 | 0.16 | 28 | 11.9 | 0.01 | 50 | 0.531 | 0.12 | 16 |
| LYD908 | 84447.4 | — | — | — | 11.7 | 0.01 | 48 | 0.550 | 0.06 | 20 |
| LYD876 | 83416.3 | 0.786 | 0.27 | 23 | 10.9 | 0.05 | 37 | — | — | — |
| LYD876 | 83417.3 | — | — | — | 10.0 | 0.15 | 27 | — | — | — |
| LYD876 | 83417.6 | 0.798 | 0.24 | 25 | — | — | — | — | — | — |
| LYD876 | 83418.2 | — | — | — | 9.49 | 0.28 | 20 | — | — | — |
| LYD865 | 83730.1 | 0.800 | 0.22 | 25 | 10.5 | 0.09 | 32 | — | — | — |
| LYD865 | 83733.5 | — | — | — | 10.9 | 0.06 | 37 | — | — | — |
| LYD864 | 83406.2 | — | — | — | 9.78 | 0.23 | 23 | — | — | — |
| LYD864 | 83406.4 | — | — | — | 9.54 | 0.26 | 20 | — | — | — |
| LYD864 | 83409.2 | 0.797 | 0.23 | 24 | 10.1 | 0.16 | 27 | — | — | — |
| LYD864 | 83409.3 | — | — | — | 11.9 | 0.01 | 51 | 0.537 | 0.10 | 17 |
| LYD843 | 83772.1 | — | — | — | 10.6 | 0.08 | 33 | 0.530 | 0.13 | 16 |
| LYD843 | 83774.1 | — | — | — | 9.79 | 0.21 | 23 | — | — | — |
| LYD843 | 83775.2 | 0.810 | 0.20 | 27 | 11.8 | 0.02 | 48 | 0.528 | 0.16 | 15 |
| LYD843 | 83775.4 | — | — | — | 10.3 | 0.11 | 29 | — | — | — |
| LYD842 | 83528.2 | 0.813 | 0.20 | 27 | 9.85 | 0.19 | 24 | — | — | — |
| LYD835 | 84139.1 | 0.796 | 0.24 | 24 | 9.93 | 0.17 | 25 | — | — | — |
| LYD835 | 84141.3 | — | — | — | 9.75 | 0.20 | 23 | — | — | — |
| LYD835 | 84143.1 | 0.790 | 0.26 | 23 | — | — | — | — | — | — |
| LYD835 | 84143.2 | — | — | — | 10.6 | 0.07 | 34 | 0.516 | 0.22 | 13 |
| LYD821 | 84053.3 | 0.932 | 0.02 | 46 | 12.3 | L | 55 | 0.542 | 0.08 | 18 |
| LYD821 | 84054.1 | 0.800 | 0.20 | 25 | 11.1 | 0.04 | 39 | — | — | — |
| LYD821 | 84054.4 | 0.787 | 0.27 | 23 | 9.48 | 0.28 | 19 | — | — | — |
| LYD793 | 83499.7 | 0.813 | 0.19 | 27 | 10.7 | 0.08 | 35 | — | — | — |
| LYD793 | 83500.4 | 0.801 | 0.20 | 25 | 10.5 | 0.08 | 33 | — | — | — |
| LYD777 | 83489.3 | — | — | — | 9.86 | 0.18 | 24 | — | — | — |

TABLE 180-continued

Genes showing improved plant performance at Normal growth conditions under regulation of At6669 promoter

| | | RGR Of Leaf Number | | | RGR Of Plot Coverage | | | RGR Of Rosette Diameter | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LYD777 | 83492.3 | — | — | — | 9.75 | 0.21 | 23 | — | — | — |
| LYD777 | 83492.4 | — | — | — | 9.44 | 0.29 | 19 | — | — | — |
| LYD777 | 83493.3 | — | — | — | 10.8 | 0.06 | 36 | — | — | — |
| LYD767 | 83485.1 | — | — | — | 11.3 | 0.03 | 43 | 0.520 | 0.20 | 13 |
| LYD767 | 83486.2 | 0.775 | 0.28 | 21 | 10.5 | 0.08 | 32 | 0.509 | 0.28 | 11 |
| LYD767 | 83488.1 | — | — | — | 9.70 | 0.22 | 22 | — | — | — |
| LYD767 | 83488.5 | 0.780 | 0.27 | 22 | 9.76 | 0.20 | 23 | — | — | — |
| LYD753 | 83916.1 | — | — | — | 10.2 | 0.12 | 29 | 0.509 | 0.28 | 11 |
| LYD753 | 83917.6 | 0.885 | 0.06 | 38 | 12.3 | L | 54 | 0.531 | 0.12 | 16 |
| LYD735 | 84168.2 | — | — | — | 10.4 | 0.09 | 31 | 0.510 | 0.26 | 11 |
| LYD730 | 84258.1 | 0.895 | 0.05 | 40 | 10.7 | 0.06 | 35 | 0.529 | 0.14 | 15 |
| LYD729 | 84159.1 | — | — | — | 10.6 | 0.09 | 34 | 0.513 | 0.27 | 12 |
| LYD729 | 84159.4 | — | — | — | 10.1 | 0.14 | 27 | — | — | — |
| LYD729 | 84159.6 | — | — | — | 10.3 | 0.10 | 30 | — | — | — |
| LYD729 | 84160.3 | — | — | — | 10.7 | 0.07 | 34 | — | — | — |
| LYD726 | 84591.1 | 0.776 | 0.28 | 21 | 12.3 | L | 55 | 0.532 | 0.12 | 16 |
| LYD726 | 84593.1 | 0.815 | 0.17 | 27 | 12.1 | L | 52 | 0.549 | 0.05 | 20 |
| LYD726 | 84595.1 | — | — | — | 10.6 | 0.07 | 34 | 0.520 | 0.20 | 14 |
| LYD726 | 84595.2 | 0.801 | 0.25 | 25 | — | — | — | — | — | — |
| LYD726 | 84595.3 | — | — | — | 9.52 | 0.29 | 20 | — | — | — |
| LYD720 | 83763.1 | 0.770 | 0.30 | 20 | 11.7 | 0.01 | 48 | 0.525 | 0.16 | 15 |
| LYD720 | 83764.2 | — | — | — | 10.7 | 0.06 | 35 | — | — | — |
| LYD720 | 83764.3 | 0.814 | 0.18 | 27 | 10.5 | 0.08 | 32 | 0.518 | 0.21 | 13 |
| LYD705 | 83384.4 | — | — | — | 9.45 | 0.28 | 19 | — | — | — |
| CONT. | — | 0.640 | — | — | 7.94 | — | — | 0.458 | — | — |
| LGP43 | 76951.2 | 0.758 | 0.17 | 10 | — | — | — | — | — | — |
| LGP43 | 76953.5 | 0.735 | 0.08 | 7 | — | — | — | — | — | — |
| LGP43 | 76955.1 | 0.733 | 0.20 | 7 | — | — | — | — | — | — |
| LGP43 | 76955.2 | 0.756 | 0.28 | 10 | 8.69 | 0.17 | 8 | 0.375 | 0.14 | 5 |
| CONT. | — | 0.687 | — | — | 8.07 | — | — | 0.357 | — | — |
| LYD914 | 84179.2 | — | — | — | 14.8 | 0.05 | 29 | 0.578 | 0.15 | 15 |
| LYD914 | 84183.6 | — | — | — | 14.9 | 0.05 | 30 | 0.611 | 0.04 | 21 |
| LYD901 | 83883.3 | — | — | — | 13.5 | 0.26 | 17 | 0.568 | 0.24 | 13 |
| LYD892 | 84250.7 | — | — | — | 16.2 | 0.01 | 41 | 0.583 | 0.13 | 16 |
| LYD876 | 83418.3 | — | — | — | 14.0 | 0.14 | 21 | 0.588 | 0.11 | 17 |
| LYD864 | 83409.4 | — | — | — | 14.9 | 0.05 | 30 | 0.583 | 0.13 | 16 |
| LYD843 | 83772.1 | — | — | — | 13.5 | 0.26 | 17 | — | — | — |
| LYD843 | 83775.2 | — | — | — | 14.6 | 0.12 | 27 | 0.567 | 0.30 | 12 |
| LYD842 | 83526.5 | — | — | — | 14.0 | 0.13 | 22 | 0.566 | 0.23 | 12 |
| LYD755 | 84033.1 | — | — | — | 13.9 | 0.18 | 21 | — | — | — |
| LYD753 | 83917.2 | — | — | — | 14.9 | 0.05 | 30 | 0.590 | 0.12 | 17 |
| LYD739 | 83386.2 | — | — | — | — | — | — | 0.569 | 0.26 | 13 |
| LYD735 | 84165.1 | — | — | — | 13.9 | 0.16 | 21 | 0.563 | 0.25 | 12 |
| LYD727 | 83791.1 | — | — | — | 13.6 | 0.21 | 18 | — | — | — |
| LYD727 | 83793.2 | 0.787 | 0.25 | 15 | — | — | — | — | — | — |
| LYD727 | 83795.2 | — | — | — | 14.7 | 0.06 | 28 | 0.568 | 0.22 | 13 |
| LYD722 | 84944.3 | — | — | — | 14.6 | 0.08 | 27 | 0.574 | 0.22 | 14 |
| LYD722 | 84944.4 | — | — | — | 15.4 | 0.02 | 34 | 0.574 | 0.17 | 14 |
| LYD720 | 83761.3 | — | — | — | 13.8 | 0.19 | 20 | 0.563 | 0.28 | 12 |
| LYD720 | 83763.1 | — | — | — | 13.5 | 0.25 | 17 | 0.561 | 0.27 | 11 |
| CONT. | — | 0.682 | — | — | 11.5 | — | — | 0.504 | — | — |
| LGP25 | 75388.1 | 0.755 | 0.23 | 7 | — | — | — | — | — | — |
| LGP1 | 76249.3 | 0.758 | 0.18 | 7 | — | — | — | — | — | — |
| CONT. | — | 0.707 | — | — | — | — | — | — | — | — |
| LYD922 | 83821.3 | — | — | — | 12.9 | 0.19 | 24 | 0.573 | 0.18 | 14 |
| LYD922 | 83823.6 | — | — | — | 12.5 | 0.26 | 20 | — | — | — |
| LYD905 | 84145.3 | — | — | — | 12.9 | 0.20 | 23 | — | — | — |
| LYD905 | 84147.2 | 0.884 | 0.27 | 19 | — | — | — | — | — | — |
| LYD901 | 83886.6 | — | — | — | 12.4 | 0.28 | 19 | — | — | — |
| LYD883 | 83912.2 | 0.880 | 0.29 | 18 | — | — | — | — | — | — |
| LYD883 | 83912.3 | — | — | — | 13.7 | 0.09 | 31 | 0.558 | 0.29 | 11 |
| LYD860 | 83625.4 | 0.950 | 0.10 | 28 | 12.4 | 0.28 | 19 | — | — | — |
| LYD836 | 83514.4 | 0.885 | 0.25 | 19 | 13.2 | 0.15 | 26 | 0.567 | 0.23 | 13 |
| LYD833 | 83513.5 | 0.876 | 0.28 | 18 | 12.5 | 0.26 | 20 | — | — | — |
| LYD811 | 83711.2 | 0.897 | 0.24 | 20 | — | — | — | — | — | — |
| LYD755 | 84035.1 | — | — | — | 12.8 | 0.20 | 23 | — | — | — |
| LYD755 | 84035.2 | 0.969 | 0.06 | 30 | 12.4 | 0.28 | 19 | — | — | — |
| LYD739 | 83386.2 | 0.933 | 0.13 | 25 | — | — | — | — | — | — |
| LYD725 | 84190.3 | — | — | — | 12.7 | 0.22 | 22 | 0.563 | 0.23 | 12 |
| LYD725 | 84191.1 | — | — | — | 12.5 | 0.27 | 19 | — | — | — |
| LYD704 | 83785.7 | 0.877 | 0.29 | 18 | — | — | — | — | — | — |

TABLE 180-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| CONT. | — | 0.745 | — | — | 10.4 | — | — | 0.502 | — | — |
| LYD925 | 85844.1 | — | — | — | 13.9 | 0.09 | 30 | 0.607 | 0.17 | 16 |
| LYD897 | 84444.13 | — | — | — | 12.8 | 0.26 | 20 | 0.592 | 0.28 | 13 |
| LYD897 | 84444.4 | 0.817 | 0.23 | 16 | — | — | — | — | — | — |
| LYD897 | 84444.6 | 0.853 | 0.14 | 21 | 13.2 | 0.20 | 23 | 0.610 | 0.18 | 17 |
| LYD869_H1 | 85983.1 | — | — | — | 13.6 | 0.13 | 27 | 0.623 | 0.10 | 19 |
| LYD854 | 84992.3 | 0.841 | 0.16 | 20 | — | — | — | — | — | — |
| LYD826 | 85587.1 | 0.881 | 0.07 | 25 | 13.3 | 0.15 | 25 | 0.606 | 0.16 | 16 |
| LYD824 | 83903.3 | — | — | — | 14.3 | 0.06 | 34 | 0.659 | 0.03 | 26 |
| LYD824 | 83905.3 | — | — | — | 14.2 | 0.06 | 33 | 0.611 | 0.14 | 17 |
| LYD824 | 83907.6 | 0.849 | 0.14 | 21 | — | — | — | — | — | — |
| LYD816 | 85591.1 | — | — | — | 15.8 | L | 48 | 0.695 | L | 33 |
| LYD816 | 85594.2 | 0.897 | 0.06 | 28 | — | — | — | — | — | — |
| LYD814 | 84971.2 | 0.802 | 0.29 | 14 | — | — | — | — | — | — |
| LYD814 | 84973.6 | 0.852 | 0.12 | 21 | — | — | — | — | — | — |
| LYD791 | 85129.4 | 0.874 | 0.09 | 24 | 13.8 | 0.10 | 29 | 0.608 | 0.16 | 16 |
| LYD791 | 85129.5 | — | — | — | 13.3 | 0.15 | 25 | 0.637 | 0.06 | 22 |
| LYD790 | 84574.2 | 0.839 | 0.15 | 19 | 16.6 | L | 55 | 0.675 | 0.01 | 29 |
| LYD774 | 83938.4 | — | — | — | 12.9 | 0.22 | 21 | — | — | — |
| LYD774 | 83940.2 | — | — | — | 13.6 | 0.11 | 27 | — | — | — |
| LYD769 | 84121.5 | — | — | — | 13.7 | 0.11 | 28 | 0.606 | 0.18 | 16 |
| LYD769 | 84123.1 | — | — | — | 14.2 | 0.06 | 33 | 0.598 | 0.21 | 14 |
| LYD769 | 84123.3 | — | — | — | 14.2 | 0.07 | 33 | 0.618 | 0.12 | 18 |
| LYD756 | 85067.2 | — | — | — | 12.7 | 0.27 | 19 | — | — | — |
| LYD756 | 85069.8 | — | — | — | 12.6 | 0.29 | 18 | — | — | — |
| LYD752 | 85049.1 | — | — | — | 13.7 | 0.10 | 28 | 0.610 | 0.15 | 17 |
| LYD741 | 84429.4 | 0.804 | 0.30 | 14 | — | — | — | — | — | — |
| LYD702 | 84412.3 | — | — | — | 12.9 | 0.25 | 21 | 0.593 | 0.30 | 13 |
| CONT. | — | 0.703 | — | — | 10.7 | — | — | 0.523 | — | — |
| LYD809 | 83507.2 | 0.735 | 0.18 | 22 | — | — | — | — | — | — |
| LYD726 | 84595.3 | 0.730 | 0.19 | 21 | — | — | — | — | — | — |
| LYD701 | 84068.1 | 0.713 | 0.27 | 19 | — | — | — | — | — | — |
| CONT. | — | 0.602 | — | — | — | — | — | — | — | — |
| LYD874 | 85656.1 | 0.786 | 0.28 | 18 | — | — | — | — | — | — |
| LYD834 | 84452.1 | — | — | — | 12.1 | 0.30 | 18 | — | — | — |
| LYD829 | 85058.4 | 0.789 | 0.28 | 19 | — | — | — | — | — | — |
| LYD829 | 85058.8 | 0.797 | 0.27 | 20 | — | — | — | — | — | — |
| LYD806 | 85557.1 | — | — | — | 14.8 | 0.01 | 45 | 0.617 | 0.06 | 22 |
| LYD798 | 84533.4 | — | — | — | 13.1 | 0.10 | 29 | 0.604 | 0.09 | 19 |
| LYD765 | 85811.2 | 0.825 | 0.17 | 24 | — | — | — | — | — | — |
| LYD762 | 85112.5 | 0.865 | 0.08 | 30 | 12.8 | 0.13 | 26 | 0.585 | 0.16 | 16 |
| LYD762 | 85114.3 | — | — | — | 13.7 | 0.05 | 34 | 0.605 | 0.08 | 19 |
| LYD762 | 85114.4 | 0.812 | 0.24 | 22 | 12.6 | 0.20 | 24 | 0.575 | 0.29 | 13 |
| LYD754 | 85597.2 | — | — | — | 13.0 | 0.11 | 27 | 0.570 | 0.26 | 12 |
| LYD751 | 85720.3 | 0.813 | 0.19 | 23 | — | — | — | — | — | — |
| LYD749 | 84423.6 | — | — | — | — | — | — | 0.609 | 0.09 | 20 |
| LYD711 | 85315.1 | 0.824 | 0.17 | 24 | — | — | — | — | — | — |
| LYD711 | 85316.5 | 0.790 | 0.28 | 19 | 14.1 | 0.04 | 38 | 0.617 | 0.06 | 22 |
| CONT. | — | 0.664 | — | — | 10.2 | — | — | 0.507 | — | — |
| LYD925 | 85840.1 | 0.659 | 0.27 | 23 | 6.98 | 0.30 | 15 | 0.401 | 0.10 | 17 |
| LYD925 | 85844.1 | — | — | — | 7.38 | 0.14 | 21 | 0.414 | 0.06 | 21 |
| LYD924 | 86507.1 | — | — | — | 7.60 | 0.09 | 25 | 0.407 | 0.09 | 18 |
| LYD884 | 84579.2 | — | — | — | — | — | — | 0.383 | 0.27 | 11 |
| LYD879 | 85963.1 | — | — | — | 7.95 | 0.05 | 31 | 0.383 | 0.28 | 11 |
| LYD878 | 84488.5 | — | — | — | 7.28 | 0.17 | 20 | 0.389 | 0.21 | 13 |
| LYD878 | 84488.8 | — | — | — | 7.23 | 0.20 | 19 | — | — | — |
| LYD834 | 84452.3 | — | — | — | 7.62 | 0.09 | 25 | 0.401 | 0.11 | 17 |
| LYD834 | 84452.4 | — | — | — | 7.32 | 0.16 | 20 | 0.394 | 0.17 | 15 |
| LYD829 | 85058.3 | — | — | — | 7.82 | 0.06 | 29 | 0.398 | 0.16 | 16 |
| LYD829 | 85059.2 | — | — | — | 8.02 | 0.03 | 32 | 0.401 | 0.11 | 17 |
| LYD829 | 85059.3 | — | — | — | 6.99 | 0.29 | 15 | — | — | — |
| LYD813 | 83725.1 | — | — | — | 7.25 | 0.18 | 19 | — | — | — |
| LYD813 | 83725.2 | — | — | — | 7.16 | 0.22 | 18 | — | — | — |
| LYD804 | 84134.1 | — | — | — | 7.84 | 0.05 | 29 | 0.381 | 0.29 | 11 |
| LYD804 | 84138.5 | — | — | — | 7.32 | 0.18 | 20 | 0.386 | 0.25 | 12 |
| LYD798 | 84533.3 | — | — | — | 7.26 | 0.18 | 19 | — | — | — |
| LYD798 | 84533.5 | — | — | — | — | — | — | 0.393 | 0.17 | 14 |
| LYD798 | 84533.6 | — | — | — | 7.42 | 0.13 | 22 | — | — | — |
| LYD784 | 86519.3 | — | — | — | 8.08 | 0.05 | 33 | 0.394 | 0.27 | 15 |
| LYD780 | 86514.2 | — | — | — | 7.61 | 0.09 | 25 | — | — | — |
| LYD757 | 83470.5 | — | — | — | 7.59 | 0.10 | 25 | 0.399 | 0.13 | 16 |

TABLE 180-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYD757 | 83473.4 | — | — | — | 7.59 | 0.09 | 25 | — | — | — |
| LYD754 | 85597.1 | — | — | — | 8.60 | 0.01 | 41 | 0.409 | 0.09 | 19 |
| LYD754 | 85597.2 | — | — | — | 7.59 | 0.09 | 25 | — | — | — |
| LYD754 | 85598.1 | — | — | — | — | — | — | 0.380 | 0.30 | 11 |
| LYD751 | 85720.2 | — | — | — | — | — | — | 0.388 | 0.23 | 13 |
| LYD751 | 85720.3 | — | — | — | 8.07 | 0.03 | 33 | 0.397 | 0.13 | 16 |
| LYD751 | 85722.1 | — | — | — | 7.30 | 0.16 | 20 | — | — | — |
| LYD751 | 85722.2 | — | — | — | 7.15 | 0.22 | 17 | — | — | — |
| LYD751 | 85724.1 | 0.676 | 0.21 | 26 | — | — | — | — | — | — |
| LYD722 | 84941.2 | — | — | — | 7.25 | 0.18 | 19 | — | — | — |
| LYD722 | 84945.1 | 0.655 | 0.25 | 22 | — | — | — | — | — | — |
| LYD702 | 84412.3 | — | — | — | 7.61 | 0.08 | 25 | — | — | — |
| CONT. | — | 0.536 | — | — | 6.09 | — | — | 0.344 | — | — |
| LGP49 | 77651.3 | 0.746 | 0.20 | 16 | — | — | — | — | — | — |
| LGP49 | 77651.4 | 0.727 | 0.22 | 13 | — | — | — | — | — | — |
| LGP49 | 77651.8 | 0.795 | 0.02 | 24 | — | — | — | — | — | — |
| LGP49 | 77652.6 | — | — | — | 9.15 | 0.07 | 19 | — | — | — |
| LGP49 | 77652.8 | 0.755 | 0.11 | 18 | — | — | — | — | — | — |
| CONT. | — | 0.642 | — | — | 7.71 | — | — | — | — | — |
| LGP25 | 75389.4 | — | — | — | — | — | — | 0.449 | 0.13 | 10 |
| LGP25 | 75390.4 | — | — | — | — | — | — | 0.444 | 0.12 | 8 |
| LGP25 | 75391.4 | 0.766 | 0.15 | 5 | — | — | — | 0.430 | 0.16 | 5 |
| LGP1 | 76250.4 | — | — | — | — | — | — | 0.425 | 0.06 | 4 |
| CONT. | — | 0.732 | — | — | — | — | — | 0.409 | — | — |
| LGP44 | 75764.8 | 0.746 | 0.24 | 10 | 7.74 | 0.04 | 11 | 0.329 | 0.02 | 7 |
| LGP10 | 75385.3 | 0.730 | 0.29 | 8 | 7.69 | 0.25 | 11 | 0.334 | 0.09 | 9 |
| CONT. | — | 0.678 | — | — | 6.95 | — | — | 0.307 | — | — |
| LGP8 | 75409.5 | 0.840 | 0.02 | 19 | — | — | — | — | — | — |
| LGP20 | 76941.5 | 0.770 | 0.28 | 9 | 13.2 | 0.10 | 20 | 0.493 | 0.29 | 10 |
| LGP20 | 76945.4 | 0.745 | 0.30 | 6 | — | — | — | — | — | — |
| CONT. | — | 0.705 | — | — | 11.0 | — | — | 0.446 | — | — |
| LYD841 | 85885.2 | — | — | — | — | — | — | 0.402 | 0.43 | 7 |
| CONT. | — | — | — | — | — | — | — | 0.374 | — | — |
| LYD926 | 83826.2 | 0.765 | 0.41 | 15 | — | — | — | — | — | — |
| LYD926 | 83830.2 | 0.756 | 0.42 | 14 | — | — | — | — | — | — |
| CONT. | — | 0.664 | — | — | — | — | — | — | — | — |
| LYD845 | 83397.6 | — | — | — | 13.2 | 0.36 | 15 | — | — | — |
| CONT. | — | — | — | — | 11.5 | — | — | — | — | — |
| LYD850 | 86628.1 | 0.789 | 0.37 | 17 | — | — | — | — | — | — |
| CONT. | — | 0.673 | — | — | — | — | — | — | — | — |
| LYD803 | 85074.1 | — | — | — | — | — | — | 0.582 | 0.26 | 15 |
| LYD803 | 87331.3 | — | — | — | 9.47 | 0.31 | 17 | 0.563 | 0.36 | 12 |
| CONT. | — | — | — | — | 8.11 | — | — | 0.505 | — | — |

Table 180. "CONT."—Control; "Ave."—Average; "% Incr." = % increment; "p-val."—p-value, L- $p < 0.01$.

Example 28

Evaluating Transgenic *Arabidopsis* Under Normal Conditions Using Seedling Analyses of T2 and T1 Plants Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were carefully transferred to plates containing ½ MS media (15 mM N, normal conditions). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program—ImageJ 1.39

[Java based image processing program which was developed at the U.S. National Institutes of Health and freely available on the internet at rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data was calculated, including leaf area, root coverage and root length.

The relative growth rate for the various seedling parameters was calculated according to the following Formulas XIII (RGR leaf area, above), XXVIII (RGR root coverage, described above) and VI (RGR root length, below).

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights were provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

Tables 181-183 summarize the observed phenotypes of transgenic plants expressing the gene constructs using the TC-T2 assays [tissue culture (TC), T2 plants, seedling (plantlets) analyses].

The genes presented in Table 181 showed a significant improvement as they produced larger plant biomass (plant fresh and dry weight) in T2 generation when grown under normal growth conditions, compared to control plants. The genes were cloned under the regulation of a constitutive promoter (At6669, SEQ ID NO: 15751). The evaluation of each gene was carried out by testing the performance of different number of events. Some of the genes were evaluated in more than one tissue culture assay. The results obtained in these second experiments were significantly positive as well.

TABLE 181

Genes showing improved plant performance at Normal growth conditions under regulation of At6669 promoter

| Gene Name | Event # | Dry Weight [mg] | | | Fresh Weight [mg] | | |
|---|---|---|---|---|---|---|---|
| | | Ave. | P-Val. | % Incr. | Ave. | P-Val. | % Incr. |
| LYD921 | 87628.1 | 6.68 | 0.06 | 58 | 124.9 | 0.15 | 50 |
| LYD918 | 85320.1 | 4.95 | 0.10 | 17 | 94.2 | 0.11 | 13 |
| LYD918 | 85321.2 | 7.52 | 0.02 | 78 | 133.2 | 0.03 | 60 |
| LYD890 | 87185.1 | 4.65 | 0.20 | 10 | — | — | — |
| LYD890 | 87189.1 | — | — | — | 97.6 | 0.10 | 17 |
| LYD890 | 87190.2 | 4.83 | 0.09 | 14 | 101.7 | L | 22 |
| LYD880 | 85204.3 | 4.70 | 0.28 | 11 | — | — | — |
| LYD873 | 83410.3 | 5.15 | 0.23 | 22 | — | — | — |
| LYD873 | 83410.6 | 5.12 | 0.25 | 21 | — | — | — |
| LYD873 | 83414.1 | 5.88 | 0.04 | 39 | 100.0 | 0.11 | 20 |
| LYD855 | 84609.3 | 10.4 | 0.02 | 147 | 185.8 | 0.02 | 123 |
| LYD855 | 84609.4 | 8.97 | 0.15 | 112 | 148.3 | 0.15 | 78 |
| LYD855 | 84610.2 | 8.65 | L | 104 | 125.5 | L | 51 |
| LYD855 | 86525.2 | 4.80 | 0.28 | 13 | — | — | — |
| LYD837 | 83392.1 | 4.95 | 0.07 | 17 | 98.2 | 0.17 | 18 |
| LYD815 | 84416.1 | 5.50 | 0.08 | 30 | 100.0 | 0.08 | 20 |
| LYD815 | 84416.3 | 6.83 | 0.03 | 61 | 124.9 | 0.04 | 50 |
| LYD815 | 84417.1 | 5.03 | 0.15 | 19 | 96.4 | 0.25 | 16 |
| LYD796 | 87620.6 | 5.38 | 0.04 | 27 | 100.8 | 0.02 | 21 |
| LYD796 | 87623.3 | 5.28 | 0.14 | 24 | 97.9 | 0.03 | 18 |
| LYD771 | 85463.1 | 5.65 | 0.03 | 33 | 108.6 | 0.06 | 30 |
| LYD771 | 85463.2 | — | — | — | 99.4 | 0.16 | 19 |
| LYD771 | 85463.3 | 8.50 | L | 101 | 155.5 | 0.01 | 87 |
| LYD771 | 85463.4 | 5.70 | 0.13 | 35 | 102.2 | 0.29 | 23 |
| CONT. | — | 4.24 | — | — | 83.3 | — | — |
| MGP5 | 84025.4 | 5.60 | 0.18 | 19 | — | — | — |
| MGP4 | 84018.3 | 6.10 | L | 30 | 106.0 | 0.11 | 23 |
| MGP14 | 85217.2 | 6.00 | 0.11 | 28 | 105.8 | 0.09 | 23 |
| MGP13 | 84007.2 | 5.77 | 0.11 | 23 | 95.1 | 0.12 | 11 |
| MGP13 | 84007.5 | 7.07 | L | 51 | 113.2 | 0.01 | 32 |
| MGP13 | 84010.3 | 5.88 | 0.06 | 25 | 104.0 | L | 21 |
| MGP12 | 84001.1 | — | — | — | 96.8 | 0.08 | 13 |
| MGP12 | 84005.1 | 5.33 | 0.22 | 14 | 95.3 | 0.21 | 11 |
| MGP1 | 84554.2 | 6.10 | L | 30 | 111.8 | 0.16 | 30 |
| CONT. | — | 4.69 | — | — | 85.9 | — | — |
| LYD887 | 84746.1 | 7.35 | 0.01 | 74 | 131.7 | 0.02 | 59 |
| LYD868 | 86633.2 | 6.42 | 0.05 | 53 | 131.2 | 0.07 | 58 |
| LYD868 | 86673.2 | 4.53 | 0.28 | 7 | 86.8 | 0.29 | 5 |
| LYD861 | 85566.3 | 5.10 | 0.05 | 21 | 94.5 | 0.10 | 14 |
| LYD861 | 85568.1 | 5.00 | 0.07 | 19 | 97.8 | 0.13 | 18 |
| LYD861 | 85568.6 | 4.72 | 0.15 | 12 | 93.1 | 0.03 | 12 |
| LYD818 | 87321.4 | 5.38 | 0.30 | 28 | 107.7 | 0.30 | 30 |
| LYD818 | 87323.2 | 5.15 | 0.18 | 22 | 101.7 | 0.14 | 23 |
| LYD817 | 86926.3 | 9.48 | L | 125 | 157.5 | L | 90 |
| LYD817 | 86927.1 | 5.15 | 0.07 | 22 | — | — | — |
| LYD773 | 87162.2 | 5.77 | 0.05 | 37 | 102.5 | 0.14 | 24 |
| LYD773 | 87165.4 | 6.90 | L | 64 | 136.6 | L | 65 |
| LYD768 | 87156.1 | 5.20 | 0.06 | 23 | 105.8 | 0.02 | 27 |
| LYD768 | 87160.4 | 4.68 | 0.29 | 11 | 95.7 | 0.04 | 15 |
| LYD721 | 87318.4 | 5.58 | 0.16 | 32 | 101.0 | 0.22 | 22 |
| CONT. | — | 4.21 | — | — | 83.0 | — | — |
| MGP9 | 87204.2 | 7.28 | L | 74 | 131.4 | L | 54 |
| MGP9 | 87205.3 | 5.45 | 0.15 | 31 | — | — | — |
| MGP9 | 87206.1 | 5.12 | 0.23 | 23 | 101.3 | 0.25 | 19 |
| MGP9 | 87208.1 | 5.20 | 0.18 | 25 | 100.7 | 0.25 | 18 |
| CONT. | — | 4.17 | — | — | 85.4 | — | — |
| LGP85 | 85845.1 | 4.42 | 0.04 | 46 | 83.5 | 0.01 | 76 |
| LGP85 | 85846.1 | 4.38 | 0.06 | 45 | — | — | — |
| LGP85 | 85846.3 | 4.95 | 0.05 | 64 | 100.3 | L | 112 |
| LGP85 | 85846.5 | 5.38 | L | 78 | 120.1 | L | 154 |
| LGP85 | 85849.1 | 4.45 | L | 47 | — | — | — |
| LGP105 | 85298.2 | 6.12 | L | 102 | — | — | — |
| LGP105 | 85298.3 | 4.38 | L | 45 | 95.3 | L | 101 |
| LGP105 | 85298.4 | 5.42 | L | 79 | 98.7 | L | 108 |
| LGP105 | 85298.5 | 5.17 | L | 71 | 105.3 | L | 122 |
| LGP105 | 85298.7 | 5.28 | 0.07 | 74 | 116.2 | 0.02 | 145 |
| LGP102 | 85929.1 | — | — | — | 66.7 | 0.19 | 41 |
| LGP102 | 85930.3 | 3.58 | 0.08 | 18 | 73.0 | 0.07 | 54 |
| LGP102 | 85931.2 | 3.90 | 0.10 | 29 | — | — | — |
| LGP102 | 85933.2 | 5.15 | 0.07 | 70 | — | — | — |
| CONT. | — | 3.02 | — | — | 47.3 | — | — |
| LGP99 | 85617.3 | 8.18 | 0.13 | 23 | 162.2 | 0.17 | 27 |

TABLE 181-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LGP98 | 83620.5 | — | — | — | 146.9 | 0.20 | 15 |
| LGP98 | 83620.7 | 8.18 | 0.06 | 23 | 149.7 | 0.14 | 17 |
| LGP87 | 85864.1 | 10.0 | 0.01 | 51 | 195.2 | 0.02 | 53 |
| LGP86 | 84346.3 | 9.50 | L | 43 | 175.3 | L | 38 |
| LGP83 | 85755.1 | 8.30 | 0.26 | 25 | — | — | — |
| LGP83 | 85759.2 | — | — | — | 142.8 | 0.14 | 12 |
| LGP83 | 85759.4 | 7.65 | 0.16 | 15 | 145.4 | 0.17 | 14 |
| LGP110 | 85612.1 | 8.27 | 0.24 | 25 | 184.3 | 0.25 | 45 |
| LGP107 | 84338.1 | 8.15 | 0.03 | 23 | 164.1 | 0.20 | 29 |
| LGP106 | 85865.2 | — | — | — | 149.2 | 0.28 | 17 |
| LGP106 | 85869.2 | 8.00 | 0.04 | 21 | 155.8 | 0.05 | 22 |
| LGP101 | 85292.1 | 7.35 | 0.20 | 11 | 138.6 | 0.27 | 9 |
| CONT. | — | 6.62 | — | — | 127.4 | — | — |
| MGP9 | 85224.1 | 5.88 | 0.08 | 31 | 113.5 | 0.12 | 40 |
| MGP7 | 86141.3 | 5.05 | 0.24 | 13 | — | — | — |
| MGP7 | 86141.4 | — | — | — | 98.4 | 0.13 | 21 |
| CONT. | — | 4.47 | — | — | 81.1 | — | — |
| LYD857 | 86674.1 | — | — | — | 115.3 | 0.17 | 16 |
| LYD856 | 85693.2 | 12.5 | L | 118 | 200.1 | L | 101 |
| LYD855 | 84609.3 | 12.0 | 0.01 | 108 | 187.0 | L | 88 |
| LYD852 | 85819.3 | — | — | — | 118.8 | 0.04 | 19 |
| LYD810 | 84436.2 | 9.07 | 0.08 | 58 | 158.7 | 0.06 | 59 |
| LYD807 | 84080.1 | — | — | — | 116.3 | 0.20 | 17 |
| LYD802 | 85132.1 | 7.70 | 0.05 | 34 | 133.1 | 0.03 | 34 |
| LYD792 | 85553.1 | 7.30 | 0.12 | 27 | 129.4 | 0.04 | 30 |
| LYD694 | 84125.1 | 9.20 | 0.04 | 60 | 157.3 | 0.02 | 58 |
| CONT. | — | 5.74 | — | — | 99.5 | — | — |
| LYD907 | 84978.1 | 6.65 | 0.02 | 74 | 108.5 | L | 46 |
| LYD906 | 84750.1 | 5.45 | 0.03 | 43 | 100.0 | 0.12 | 35 |
| LYD906 | 84754.1 | 4.62 | 0.19 | 21 | — | — | — |
| LYD904 | 84498.4 | 5.33 | L | 40 | 103.0 | L | 39 |
| LYD904 | 84499.2 | 4.90 | 0.06 | 29 | 88.9 | 0.18 | 20 |
| LYD903 | 85544.3 | 4.92 | 0.02 | 29 | 94.1 | L | 27 |
| LYD903 | 85544.5 | 4.45 | 0.14 | 17 | — | — | — |
| LYD902 | 84948.5 | 4.85 | 0.24 | 27 | — | — | — |
| LYD890 | 87189.1 | 4.25 | 0.25 | 11 | 80.9 | 0.21 | 9 |
| LYD878 | 84487.3 | 5.07 | L | 33 | 97.8 | L | 32 |
| LYD878 | 84488.8 | 5.17 | 0.14 | 36 | 95.8 | 0.13 | 29 |
| LYD867 | 85535.1 | 5.40 | L | 42 | 106.4 | 0.09 | 43 |
| LYD858 | 85796.1 | 4.38 | 0.21 | 15 | 84.4 | 0.09 | 14 |
| LYD858 | 85797.1 | 6.22 | L | 63 | 132.1 | 0.02 | 78 |
| LYD856 | 85693.2 | 4.60 | 0.03 | 21 | 90.2 | 0.07 | 21 |
| LYD844 | 85192.7 | 4.45 | 0.07 | 17 | — | — | — |
| LYD825 | 85883.3 | 4.83 | 0.04 | 27 | 87.3 | 0.25 | 17 |
| LYD812 | 85563.4 | 4.83 | L | 27 | 102.1 | 0.09 | 37 |
| LYD812 | 85564.1 | 4.28 | 0.29 | 12 | — | — | — |
| LYD802 | 85132.1 | 5.65 | L | 48 | — | — | — |
| LYD719 | 85261.2 | 4.17 | 0.16 | 10 | 80.9 | 0.29 | 9 |
| LYD718 | 85458.3 | 5.07 | 0.17 | 33 | 91.3 | 0.16 | 23 |
| LYD699 | 85973.1 | 5.30 | 0.03 | 39 | 94.5 | L | 27 |
| CONT. | — | 3.81 | — | — | 74.3 | — | — |
| LGP82 | 83662.2 | 4.75 | 0.20 | 18 | — | — | — |
| LGP81 | 84957.3 | 4.90 | 0.12 | 22 | — | — | — |
| LGP77 | 81453.2 | 5.70 | L | 42 | — | — | — |
| LGP75 | 85309.4 | 6.47 | L | 61 | 190.4 | 0.10 | 50 |
| LGP74 | 81325.1 | 5.17 | 0.03 | 29 | — | — | — |
| LGP73 | 81449.1 | 5.38 | 0.01 | 34 | — | — | — |
| LGP73 | 81449.3 | 4.83 | 0.03 | 20 | — | — | — |
| LGP72 | 85854.4 | 5.00 | 0.24 | 24 | — | — | — |
| LGP71 | 82502.3 | 4.75 | 0.27 | 18 | — | — | — |
| CONT. | — | 4.03 | — | — | 127.2 | — | — |
| LGP90 | 85764.5 | 7.62 | 0.32 | 15 | 146.7 | 0.39 | 15 |
| CONT. | — | 6.62 | — | — | 127.4 | — | — |

Table 181. "CONT."—Control; "Ave."—Average; "% Incr." = % increment; "p-val."—p-value, L- p < 0.01.

The genes presented in Tables 182 and 183 below show a significant improvement in plant performance since they produced a larger leaf biomass (leaf area) and root biomass (root length and root coverage) (Table 182) and a higher relative growth rate of leaf area, root coverage and root length (Table 183) when grown under normal growth conditions, compared to control plants. Plants producing larger root biomass have better possibilities to absorb larger amount of nitrogen from soil. Plants producing larger leaf biomass have better ability to produce assimilates. The genes were cloned under the regulation of a constitutive promoter (At6669). The evaluation of each gene was performed by testing the performance of different number of events. Some of the genes were evaluated in more than one seedling analysis. This second experiment confirmed the significant increment in leaf and root performance. Event with p-value<0.1 was considered statistically significant.

TABLE 182

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LYD921 | 87628.1 | 0.518 | 0.27 | 20 | — | — | — | — | — | — |
| LYD918 | 85321.2 | 0.587 | 0.02 | 36 | 6.29 | 0.12 | 31 | — | — | — |
| LYD890 | 87185.1 | — | — | — | 6.32 | 0.05 | 32 | 6.62 | 0.30 | 11 |
| LYD873 | 83410.3 | — | — | — | 5.88 | 0.20 | 23 | — | — | — |
| LYD873 | 83410.6 | — | — | — | 6.34 | 0.20 | 32 | — | — | — |
| LYD855 | 84609.3 | 0.598 | 0.03 | 38 | — | — | — | — | — | — |
| LYD837 | 83390.5 | — | — | — | 6.03 | 0.18 | 26 | — | — | — |
| LYD837 | 83390.8 | — | — | — | 7.13 | 0.04 | 49 | — | — | — |
| LYD815 | 84416.3 | 0.561 | 0.06 | 30 | 6.93 | 0.12 | 45 | 6.75 | 0.20 | 13 |
| LYD796 | 87620.6 | — | — | — | 6.14 | 0.05 | 28 | — | — | — |
| LYD796 | 87623.3 | — | — | — | 5.49 | 0.29 | 15 | — | — | — |
| LYD771 | 85463.1 | 0.477 | 0.18 | 10 | 6.10 | 0.07 | 27 | — | — | — |
| LYD771 | 85463.3 | 0.692 | L | 60 | 8.41 | 0.04 | 76 | 6.75 | 0.26 | 13 |
| LYD771 | 85463.4 | 0.530 | 0.28 | 22 | 6.56 | 0.20 | 37 | 6.66 | 0.29 | 12 |
| CONT. | — | 0.432 | — | — | 4.79 | — | — | 5.96 | — | — |

TABLE 182-continued

Genes showing improved plant performance at Normal growth conditions under regulation of At6669 promoter

| Gene Name | Event # | Leaf Area [cm²] Ave. | Leaf Area [cm²] P-Val. | Leaf Area [cm²] % Incr. | Roots Coverage [cm²] Ave. | Roots Coverage [cm²] P-Val. | Roots Coverage [cm²] % Incr. | Roots Length [cm] Ave. | Roots Length [cm] P-Val. | Roots Length [cm] % Incr. |
|---|---|---|---|---|---|---|---|---|---|---|
| MGP5 | 84022.3 | — | — | — | 6.33 | 0.19 | 16 | 6.36 | 0.03 | 12 |
| MGP5 | 84025.7 | — | — | — | 6.76 | 0.12 | 24 | 6.51 | 0.17 | 15 |
| MGP4 | 84018.3 | 0.556 | 0.03 | 21 | 7.36 | 0.01 | 35 | 6.99 | L | 24 |
| MGP4 | 84019.5 | — | — | — | — | — | — | 6.29 | 0.18 | 11 |
| MGP4 | 84020.2 | — | — | — | 6.23 | 0.24 | 14 | 6.32 | 0.15 | 12 |
| MGP2 | 84014.5 | — | — | — | — | — | — | 6.09 | 0.29 | 8 |
| MGP14 | 85217.2 | 0.590 | 0.04 | 28 | — | — | — | — | — | — |
| MGP13 | 84007.2 | 0.560 | 0.06 | 22 | — | — | — | — | — | — |
| MGP13 | 84007.5 | 0.642 | L | 39 | 6.91 | 0.04 | 27 | 6.41 | 0.09 | 13 |
| MGP13 | 84010.3 | 0.570 | 0.04 | 24 | 6.36 | 0.21 | 17 | — | — | — |
| MGP13 | 84010.4 | — | — | — | 6.18 | 0.20 | 13 | 6.36 | 0.06 | 12 |
| MGP12 | 84001.1 | — | — | — | 6.39 | 0.14 | 17 | 6.81 | 0.04 | 20 |
| MGP12 | 84004.4 | 0.551 | 0.15 | 20 | 7.68 | 0.19 | 41 | 6.83 | 0.01 | 21 |
| MGP1 | 84554.2 | 0.544 | 0.04 | 18 | 6.48 | 0.17 | 19 | 6.32 | 0.06 | 12 |
| CONT. | — | 0.461 | — | — | 5.45 | — | — | 5.66 | — | — |
| LYD887 | 84745.1 | 0.502 | 0.17 | 12 | 6.53 | 0.19 | 11 | — | — | — |
| LYD887 | 84746.1 | 0.633 | 0.02 | 41 | 9.26 | 0.02 | 57 | 6.93 | 0.08 | 15 |
| LYD868 | 86633.2 | 0.575 | 0.05 | 28 | 8.37 | 0.14 | 42 | — | — | — |
| LYD868 | 86673.1 | — | — | — | 7.24 | 0.29 | 23 | — | — | — |
| LYD861 | 85566.3 | 0.492 | 0.08 | 10 | — | — | — | — | — | — |
| LYD861 | 85568.1 | 0.533 | 0.09 | 19 | — | — | — | — | — | — |
| LYD818 | 87321.2 | — | — | — | 6.95 | 0.22 | 18 | 6.89 | 0.10 | 15 |
| LYD818 | 87321.4 | 0.532 | 0.25 | 19 | — | — | — | — | — | — |
| LYD818 | 87323.2 | — | — | — | 9.34 | 0.10 | 59 | 6.77 | 0.16 | 13 |
| LYD817 | 86926.3 | 0.711 | L | 59 | 9.30 | L | 58 | 6.63 | 0.15 | 10 |
| LYD817 | 86927.1 | 0.571 | L | 27 | 7.67 | 0.10 | 30 | 6.62 | 0.16 | 10 |
| LYD773 | 87162.2 | 0.533 | 0.07 | 19 | 7.15 | 0.12 | 21 | — | — | — |
| LYD773 | 87165.4 | 0.673 | L | 50 | 9.77 | L | 66 | 7.30 | L | 21 |
| LYD768 | 87156.1 | 0.512 | 0.03 | 14 | 7.12 | 0.14 | 21 | — | — | — |
| LYD768 | 87157.2 | 0.485 | 0.08 | 8 | — | — | — | — | — | — |
| LYD768 | 87160.4 | 0.496 | 0.29 | 11 | — | — | — | — | — | — |
| LYD721 | 87318.2 | — | — | — | 7.50 | 0.07 | 27 | 6.92 | 0.06 | 15 |
| LYD721 | 87318.3 | — | — | — | 6.76 | 0.17 | 15 | 6.61 | 0.16 | 10 |
| LYD721 | 87318.4 | 0.530 | 0.12 | 18 | 8.38 | 0.09 | 42 | 6.73 | 0.07 | 12 |
| LYD721 | 87320.1 | — | — | — | — | — | — | 6.46 | 0.26 | 7 |
| CONT. | — | 0.448 | — | — | 5.89 | — | — | 6.01 | — | — |
| MGP9 | 87204.2 | 0.596 | L | 38 | — | — | — | — | — | — |
| CONT. | — | 0.433 | — | — | — | — | — | — | — | — |
| LGP85 | 85845.1 | 0.402 | 0.03 | 35 | 6.85 | 0.02 | 45 | — | — | — |
| LGP85 | 85846.1 | 0.414 | 0.03 | 39 | 5.65 | 0.14 | 19 | — | — | — |
| LGP85 | 85846.3 | 0.418 | 0.04 | 40 | 7.11 | 0.09 | 50 | 6.94 | 0.29 | 11 |
| LGP85 | 85846.5 | 0.425 | L | 42 | 7.70 | 0.06 | 63 | — | — | — |
| LGP85 | 85849.1 | 0.378 | L | 27 | 7.39 | 0.02 | 56 | 6.77 | 0.30 | 9 |
| LGP105 | 85298.2 | 0.466 | L | 56 | 7.64 | L | 61 | 6.74 | 0.24 | 8 |
| LGP105 | 85298.3 | 0.384 | L | 28 | 7.66 | L | 62 | — | — | — |
| LGP105 | 85298.4 | 0.462 | L | 55 | 8.46 | L | 79 | 7.61 | L | 22 |
| LGP105 | 85298.5 | 0.421 | L | 41 | 7.40 | 0.01 | 56 | — | — | — |
| LGP105 | 85298.7 | 0.420 | 0.03 | 41 | 5.69 | 0.15 | 20 | — | — | — |
| LGP102 | 85930.3 | 0.353 | L | 18 | — | — | — | — | — | — |
| LGP102 | 85931.2 | 0.368 | 0.08 | 23 | — | — | — | — | — | — |
| LGP102 | 85933.2 | 0.433 | 0.08 | 45 | 6.22 | 0.04 | 31 | — | — | — |
| LGP102 | 85933.3 | 0.343 | 0.04 | 15 | — | — | — | — | — | — |
| CONT. | — | 0.299 | — | — | 4.73 | — | — | 6.23 | — | — |
| LGP99 | 85617.3 | 0.679 | 0.04 | 32 | — | — | — | — | — | — |
| LGP98 | 83620.7 | 0.623 | 0.04 | 21 | — | — | — | — | — | — |
| LGP97 | 83609.1 | 0.581 | 0.12 | 13 | — | — | — | — | — | — |
| LGP97 | 83611.2 | — | — | — | — | — | — | 6.27 | 0.29 | 5 |
| LGP95 | 83695.2 | — | — | — | — | — | — | 6.68 | 0.26 | 12 |
| LGP87 | 85864.1 | 0.692 | 0.01 | 35 | — | — | — | — | — | — |
| LGP86 | 84346.3 | 0.652 | 0.03 | 27 | — | — | — | — | — | — |
| LGP83 | 85755.1 | 0.687 | 0.13 | 34 | — | — | — | — | — | — |
| LGP83 | 85759.2 | 0.618 | 0.06 | 20 | 7.98 | 0.03 | 18 | 6.38 | 0.14 | 7 |
| LGP83 | 85759.4 | 0.599 | 0.08 | 17 | — | — | — | 6.85 | 0.01 | 15 |
| LGP110 | 85611.1 | — | — | — | — | — | — | 6.60 | 0.24 | 11 |
| LGP110 | 85612.1 | 0.651 | 0.11 | 27 | — | — | — | — | — | — |
| LGP107 | 84338.1 | 0.628 | L | 22 | 8.09 | 0.10 | 19 | 6.75 | 0.16 | 13 |
| LGP106 | 85865.2 | 0.589 | 0.28 | 15 | — | — | — | — | — | — |
| LGP106 | 85869.2 | 0.594 | 0.10 | 16 | 8.46 | 0.05 | 25 | — | — | — |
| LGP100 | 83691.2 | — | — | — | — | — | — | 6.64 | 0.22 | 11 |
| LGP100 | 83691.6 | — | — | — | — | — | — | 6.43 | 0.16 | 8 |
| LGP100 | 83691.8 | — | — | — | — | — | — | 6.24 | 0.20 | 5 |

TABLE 182-continued

Genes showing improved plant performance at Normal growth conditions under regulation of At6669 promoter

| Gene Name | Event # | Leaf Area [cm²] Ave. | Leaf Area [cm²] P-Val. | Leaf Area [cm²] % Incr. | Roots Coverage [cm²] Ave. | Roots Coverage [cm²] P-Val. | Roots Coverage [cm²] % Incr. | Roots Length [cm] Ave. | Roots Length [cm] P-Val. | Roots Length [cm] % Incr. |
|---|---|---|---|---|---|---|---|---|---|---|
| CONT. | — | 0.514 | — | — | 6.78 | — | — | 5.97 | — | — |
| MGP9 | 85224.1 | 0.471 | 0.03 | 22 | — | — | — | — | — | — |
| MGP7 | 86137.1 | 0.471 | 0.05 | 22 | — | — | — | — | — | — |
| MGP7 | 86141.3 | 0.426 | 0.28 | 10 | — | — | — | — | — | — |
| CONT. | — | 0.386 | — | — | — | — | — | — | — | — |
| LYD918 | 85320.2 | — | — | — | 7.83 | 0.11 | 33 | 6.78 | 0.02 | 19 |
| LYD910 | 85212.1 | — | — | — | 6.98 | 0.21 | 19 | 6.44 | 0.19 | 13 |
| LYD880 | 85204.3 | — | — | — | — | — | — | 6.10 | 0.14 | 7 |
| LYD858 | 85796.1 | 0.561 | 0.21 | 10 | 7.45 | L | 27 | 6.61 | 0.02 | 16 |
| LYD857 | 86635.1 | — | — | — | 7.86 | 0.02 | 33 | 6.63 | L | 16 |
| LYD857 | 86674.1 | — | — | — | 8.97 | L | 52 | 7.20 | L | 26 |
| LYD856 | 85693.2 | 0.976 | L | 91 | 11.3 | L | 91 | 7.23 | 0.01 | 27 |
| LYD855 | 84609.3 | 0.784 | 0.01 | 53 | 9.01 | 0.02 | 53 | — | — | — |
| LYD852 | 85816.1 | — | — | — | — | — | — | 6.00 | 0.14 | 5 |
| LYD852 | 85816.2 | — | — | — | 6.67 | 0.13 | 13 | 6.14 | 0.23 | 8 |
| LYD852 | 85819.3 | 0.578 | 0.21 | 13 | 6.94 | 0.19 | 18 | 6.41 | 0.19 | 12 |
| LYD815 | 84416.1 | — | — | — | 6.75 | 0.23 | 15 | 6.89 | 0.02 | 21 |
| LYD815 | 84416.2 | 0.643 | 0.14 | 26 | — | — | — | — | — | — |
| LYD815 | 84416.3 | — | — | — | — | — | — | 6.16 | 0.23 | 8 |
| LYD810 | 84436.2 | 0.757 | L | 48 | 8.97 | L | 52 | 6.68 | L | 17 |
| LYD810 | 84437.10 | — | — | — | — | — | — | 5.95 | 0.26 | 4 |
| LYD810 | 84437.5 | — | — | — | 8.18 | L | 39 | 6.88 | 0.02 | 21 |
| LYD807 | 84078.1 | 0.546 | 0.27 | 7 | — | — | — | — | — | — |
| LYD807 | 84080.1 | 0.654 | 0.05 | 28 | 8.66 | L | 47 | 6.87 | L | 20 |
| LYD802 | 85132.1 | 0.709 | 0.14 | 39 | — | — | — | 6.81 | 0.11 | 19 |
| LYD801 | 84618.4 | — | — | — | 8.65 | 0.05 | 47 | 6.90 | 0.11 | 21 |
| LYD792 | 85550.1 | — | — | — | — | — | — | 6.30 | 0.22 | 10 |
| LYD792 | 85553.1 | 0.679 | L | 33 | 8.18 | 0.02 | 39 | 6.88 | L | 21 |
| LYD785 | 84430.1 | — | — | — | 7.40 | 0.18 | 26 | 6.72 | 0.09 | 18 |
| LYD785 | 84430.5 | — | — | — | — | — | — | 6.07 | 0.21 | 6 |
| LYD785 | 84430.6 | — | — | — | — | — | — | 6.12 | 0.19 | 7 |
| LYD785 | 84430.7 | — | — | — | 7.47 | 0.04 | 27 | 6.90 | 0.03 | 21 |
| LYD782 | 85902.1 | — | — | — | 7.18 | 0.24 | 22 | — | — | — |
| LYD782 | 85903.1 | — | — | — | 8.10 | 0.03 | 38 | 6.46 | 0.22 | 13 |
| LYD782 | 85904.3 | — | — | — | 6.66 | 0.23 | 13 | — | — | — |
| LYD771 | 85463.1 | — | — | — | — | — | — | 6.56 | 0.10 | 15 |
| LYD771 | 85463.3 | — | — | — | 7.53 | 0.06 | 28 | 6.51 | 0.03 | 14 |
| LYD771 | 85463.4 | 0.605 | 0.28 | 18 | 7.50 | 0.19 | 27 | 6.49 | 0.19 | 14 |
| LYD723 | 84940.4 | — | — | — | 8.28 | 0.05 | 41 | 6.88 | 0.07 | 21 |
| LYD719 | 85261.3 | — | — | — | — | — | — | 5.96 | 0.26 | 4 |
| LYD707 | 85707.1 | 0.561 | 0.16 | 10 | 7.81 | 0.01 | 33 | 6.85 | L | 20 |
| LYD694 | 84125.1 | 0.707 | 0.02 | 38 | 9.03 | L | 53 | 6.02 | 0.10 | 5 |
| CONT. | — | 0.512 | — | — | 5.89 | — | — | 5.71 | — | — |
| LYD921 | 87628.1 | 0.381 | 0.23 | 15 | — | — | — | — | — | — |
| LYD910 | 87192.4 | 0.375 | 0.21 | 13 | — | — | — | — | — | — |
| LYD907 | 84978.1 | 0.512 | L | 54 | — | — | — | — | — | — |
| LYD906 | 84750.1 | 0.443 | L | 33 | 5.50 | 0.18 | 23 | — | — | — |
| LYD906 | 84752.3 | 0.418 | 0.22 | 26 | — | — | — | — | — | — |
| LYD906 | 84754.1 | 0.439 | 0.13 | 32 | — | — | — | — | — | — |
| LYD904 | 84498.4 | 0.467 | L | 40 | — | — | — | — | — | — |
| LYD904 | 84499.2 | 0.453 | 0.04 | 36 | 5.84 | 0.06 | 30 | 6.58 | 0.03 | 18 |
| LYD903 | 85544.3 | 0.441 | L | 33 | 5.46 | 0.15 | 22 | — | — | — |
| LYD903 | 85544.5 | — | — | — | 5.04 | 0.21 | 12 | — | — | — |
| LYD902 | 84948.3 | 0.422 | L | 27 | — | — | — | 6.07 | 0.24 | 9 |
| LYD902 | 84948.5 | 0.380 | 0.19 | 14 | — | — | — | — | — | — |
| LYD890 | 87185.1 | 0.363 | 0.18 | 9 | — | — | — | — | — | — |
| LYD890 | 87189.1 | 0.389 | 0.11 | 17 | — | — | — | — | — | — |
| LYD878 | 84487.3 | 0.419 | 0.02 | 26 | 5.22 | 0.16 | 17 | — | — | — |
| LYD878 | 84488.8 | 0.485 | 0.10 | 46 | 5.71 | 0.15 | 28 | — | — | — |
| LYD867 | 85535.1 | 0.440 | 0.11 | 32 | — | — | — | — | — | — |
| LYD858 | 85796.1 | 0.414 | 0.02 | 25 | — | — | — | — | — | — |
| LYD858 | 85797.1 | 0.488 | L | 47 | 5.33 | 0.16 | 19 | — | — | — |
| LYD856 | 85693.2 | 0.434 | L | 30 | — | — | — | — | — | — |
| LYD844 | 85192.7 | 0.369 | 0.24 | 11 | — | — | — | — | — | — |
| LYD825 | 85883.1 | 0.365 | 0.22 | 10 | — | — | — | — | — | — |
| LYD825 | 85883.3 | 0.389 | 0.15 | 17 | — | — | — | — | — | — |
| LYD825 | 85884.2 | 0.381 | 0.05 | 15 | — | — | — | — | — | — |
| LYD812 | 85560.2 | 0.464 | 0.07 | 40 | 5.24 | 0.19 | 17 | 6.54 | 0.09 | 17 |
| LYD812 | 85563.4 | 0.424 | L | 27 | — | — | — | — | — | — |
| LYD812 | 85564.1 | 0.402 | 0.10 | 21 | — | — | — | — | — | — |
| LYD802 | 85132.1 | 0.450 | 0.01 | 35 | — | — | — | — | — | — |

TABLE 182-continued

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LYD792 | 85553.1 | 0.528 | 0.04 | 59 | — | — | — | — | — | — |
| LYD719 | 87356.3 | 0.381 | 0.13 | 14 | 5.33 | 0.17 | 19 | 6.26 | 0.25 | 12 |
| LYD718 | 85458.3 | 0.442 | 0.11 | 33 | — | — | — | — | — | — |
| LYD707 | 85707.1 | 0.384 | 0.10 | 16 | — | — | — | — | — | — |
| LYD699 | 85973.1 | 0.395 | 0.02 | 19 | — | — | — | — | — | — |
| CONT. | — | 0.333 | — | — | 4.48 | — | — | 5.59 | — | — |
| LGP82 | 83662.2 | 0.436 | L | 20 | 6.46 | 0.01 | 37 | 6.52 | 0.28 | 8 |
| LGP82 | 83664.1 | — | — | — | — | — | — | 6.94 | L | 14 |
| LGP82 | 83666.2 | — | — | — | 6.23 | L | 33 | 7.11 | L | 17 |
| LGP81 | 84957.3 | 0.446 | L | 23 | 7.46 | L | 59 | 7.44 | L | 23 |
| LGP81 | 84957.8 | 0.382 | 0.25 | 5 | 5.41 | 0.11 | 15 | 6.55 | 0.26 | 8 |
| LGP79 | 82510.1 | — | — | — | 5.90 | L | 26 | — | — | — |
| LGP79 | 82510.2 | 0.381 | 0.08 | 5 | 6.66 | 0.05 | 42 | 7.34 | L | 21 |
| LGP79 | 82512.1 | — | — | — | 6.09 | 0.12 | 30 | 6.89 | 0.11 | 14 |
| LGP79 | 82513.4 | — | — | — | 5.89 | L | 25 | 7.04 | 0.04 | 16 |
| LGP78 | 82507.1 | — | — | — | 5.24 | 0.13 | 12 | 6.74 | 0.14 | 11 |
| LGP78 | 82507.4 | 0.422 | 0.26 | 17 | 6.64 | 0.03 | 41 | 6.83 | 0.07 | 13 |
| LGP78 | 82508.1 | 0.396 | 0.09 | 9 | 5.58 | 0.02 | 19 | 6.61 | 0.16 | 9 |
| LGP77 | 81452.2 | — | — | — | 5.47 | 0.08 | 16 | 6.73 | 0.19 | 11 |
| LGP77 | 81453.2 | 0.449 | L | 24 | 6.13 | 0.08 | 31 | — | — | — |
| LGP77 | 81453.3 | — | — | — | 5.84 | 0.11 | 24 | 6.72 | 0.11 | 11 |
| LGP77 | 81454.1 | 0.435 | 0.11 | 20 | 6.36 | 0.05 | 35 | 7.01 | 0.05 | 16 |
| LGP76 | 83653.1 | — | — | — | 5.35 | 0.18 | 14 | — | — | — |
| LGP76 | 83653.2 | 0.440 | 0.04 | 22 | 6.04 | 0.20 | 29 | — | — | — |
| LGP76 | 83653.3 | 0.457 | 0.15 | 26 | 6.77 | 0.01 | 44 | 6.82 | 0.17 | 12 |
| LGP76 | 83654.1 | — | — | — | 6.48 | 0.16 | 38 | — | — | — |
| LGP75 | 85309.1 | — | — | — | — | — | — | 7.04 | L | 16 |
| LGP75 | 85309.4 | 0.507 | L | 40 | 8.43 | 0.01 | 80 | 7.24 | L | 19 |
| LGP74 | 81324.2 | — | — | — | 5.59 | 0.23 | 19 | — | — | — |
| LGP74 | 81325.1 | 0.453 | 0.03 | 25 | 7.87 | L | 68 | 7.03 | 0.05 | 16 |
| LGP74 | 81326.4 | — | — | — | — | — | — | 6.43 | 0.19 | 6 |
| LGP74 | 81328.1 | — | — | — | 5.43 | 0.09 | 16 | 6.87 | L | 13 |
| LGP73 | 81449.1 | 0.495 | L | 37 | 8.11 | L | 73 | 7.78 | L | 28 |
| LGP71 | 82500.4 | 0.402 | 0.24 | 11 | 6.89 | L | 47 | 7.38 | L | 22 |
| LGP71 | 82502.2 | — | — | — | — | — | — | 6.92 | 0.07 | 14 |
| LGP71 | 82502.3 | 0.467 | 0.04 | 29 | 6.20 | L | 32 | 6.92 | L | 14 |
| LGP71 | 82502.4 | — | — | — | 5.37 | 0.12 | 14 | — | — | — |
| CONT. | — | 0.362 | — | — | 4.70 | — | — | 6.07 | — | — |
| LGP94 | 84352.6 | 0.565 | 0.46 | 10 | — | — | — | — | — | — |
| LGP111 | 83612.3 | — | — | — | — | — | — | 6.64 | 0.45 | 11 |
| LGP111 | 83616.5 | — | — | — | — | — | — | 6.51 | 0.31 | 9 |
| CONT. | — | 0.514 | — | — | — | — | — | 5.97 | — | — |
| LGP96 | 88003 | 0.180 | L | 13 | — | — | — | 0.871 | 0.04 | 15 |
| LGP104 | 87557 | 0.159 | 0.07 | 11 | — | — | — | — | — | — |
| CONT. | — | 0.138 | — | — | — | — | — | 0.593 | — | — |

Table 182. "CONT."—Control; "Ave."—Average; "% Incr." = % increment; "p-val."—p-value, L- p < 0.01.

TABLE 183

Genes showing improved plant performance at Normal growth conditions under regulation of At6669 promoter

| Gene Name | Event # | RGR Of Leaf Area Ave. | P-Val. | % Incr. | RGR Of Roots Coverage Ave. | P-Val. | % Incr. | RGR Of Root Length Ave. | P-Val. | % Incr. |
|---|---|---|---|---|---|---|---|---|---|---|
| MGP5 | 84022.3 | — | — | — | 0.728 | 0.12 | 17 | 0.546 | 0.06 | 20 |
| MGP5 | 84025.6 | — | — | — | — | — | — | 0.537 | 0.13 | 18 |
| MGP5 | 84025.7 | — | — | — | 0.786 | 0.03 | 26 | 0.579 | 0.04 | 27 |
| MGP4 | 84018.3 | 0.0509 | 0.13 | 20 | 0.836 | L | 34 | 0.585 | L | 28 |
| MGP4 | 84020.2 | — | — | — | 0.716 | 0.19 | 15 | — | — | — |
| MGP2 | 84014.1 | — | — | — | — | — | — | 0.517 | 0.23 | 13 |
| MGP2 | 84014.5 | — | — | — | — | — | — | 0.538 | 0.10 | 18 |
| MGP14 | 85217.2 | 0.0514 | 0.17 | 21 | — | — | — | — | — | — |
| MGP13 | 84007.2 | 0.0543 | 0.06 | 28 | — | — | — | — | — | — |
| MGP13 | 84007.5 | 0.0619 | L | 46 | 0.797 | 0.01 | 28 | 0.575 | 0.02 | 26 |

TABLE 183-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| MGP13 | 84010.3 | 0.0553 | 0.03 | 30 | 0.748 | 0.10 | 20 | 0.531 | 0.21 | 16 |
| MGP13 | 84010.4 | — | — | — | 0.720 | 0.14 | 15 | 0.541 | 0.08 | 19 |
| MGP12 | 84001.1 | — | — | — | 0.744 | 0.08 | 19 | 0.577 | 0.03 | 26 |
| MGP12 | 84004.4 | 0.0520 | 0.17 | 22 | 0.893 | L | 43 | 0.564 | 0.06 | 24 |
| MGP12 | 84005.1 | 0.0490 | 0.30 | 15 | — | — | — | 0.575 | 0.07 | 26 |
| MGP1 | 84553.1 | — | — | — | — | — | — | 0.519 | 0.24 | 14 |
| MGP1 | 84554.1 | — | — | — | — | — | — | 0.542 | 0.12 | 19 |
| MGP1 | 84554.2 | 0.0517 | 0.15 | 22 | 0.766 | 0.06 | 23 | 0.551 | 0.08 | 21 |
| MGP1 | 84555.4 | — | — | — | — | — | — | 0.516 | 0.27 | 13 |
| CONT. | — | 0.0425 | — | — | 0.624 | — | — | 0.456 | — | — |
| LYD887 | 84746.1 | 0.0589 | L | 41 | 1.05 | L | 53 | — | — | — |
| LYD868 | 86633.2 | 0.0521 | 0.02 | 25 | 0.963 | 0.02 | 40 | — | — | — |
| LYD868 | 86673.1 | — | — | — | 0.849 | 0.12 | 23 | — | — | — |
| LYD866 | 87309.5 | — | — | — | 0.780 | 0.30 | 13 | — | — | — |
| LYD861 | 85566.3 | 0.0457 | 0.23 | 10 | — | — | — | — | — | — |
| LYD861 | 85568.1 | 0.0478 | 0.14 | 15 | — | — | — | — | — | — |
| LYD818 | 87321.2 | — | — | — | 0.803 | 0.21 | 17 | 0.602 | 0.08 | 19 |
| LYD818 | 87321.4 | 0.0494 | 0.16 | 18 | — | — | — | — | — | — |
| LYD818 | 87323.2 | — | — | — | 1.09 | L | 58 | — | — | — |
| LYD817 | 86926.3 | 0.0684 | L | 64 | 1.05 | L | 53 | — | — | — |
| LYD817 | 86927.1 | 0.0529 | L | 27 | 0.914 | 0.02 | 33 | 0.580 | 0.13 | 15 |
| LYD773 | 87162.2 | 0.0487 | 0.13 | 17 | 0.839 | 0.08 | 22 | — | — | — |
| LYD773 | 87165.4 | 0.0622 | L | 49 | 1.13 | L | 64 | — | — | — |
| LYD768 | 87156.1 | 0.0510 | 0.01 | 22 | 0.830 | 0.10 | 20 | — | — | — |
| LYD721 | 87318.2 | — | — | — | 0.860 | 0.05 | 25 | — | — | — |
| LYD721 | 87318.3 | — | — | — | 0.805 | 0.14 | 17 | 0.557 | 0.29 | 10 |
| LYD721 | 87318.4 | 0.0509 | 0.04 | 22 | 0.958 | 0.01 | 39 | — | — | — |
| CONT. | — | 0.0417 | — | — | 0.689 | — | — | 0.505 | — | — |
| MGP9 | 87204.2 | 0.0577 | L | 51 | — | — | — | — | — | — |
| MGP9 | 87205.2 | 0.0449 | 0.28 | 18 | — | — | — | — | — | — |
| MGP9 | 87205.3 | 0.0468 | 0.20 | 23 | — | — | — | — | — | — |
| CONT. | — | 0.0381 | — | — | — | — | — | — | — | — |
| LGP85 | 85845.1 | 0.0389 | L | 38 | 0.841 | L | 48 | — | — | — |
| LGP85 | 85846.1 | 0.0389 | L | 38 | 0.690 | 0.07 | 22 | — | — | — |
| LGP85 | 85846.3 | 0.0401 | L | 42 | 0.865 | L | 53 | 0.661 | 0.14 | 16 |
| LGP85 | 85846.5 | 0.0420 | L | 49 | 0.937 | L | 65 | — | — | — |
| LGP85 | 85849.1 | 0.0366 | L | 30 | 0.895 | L | 58 | — | — | — |
| LGP105 | 85298.2 | 0.0455 | L | 62 | 0.921 | L | 62 | — | — | — |
| LGP105 | 85298.3 | 0.0366 | L | 30 | 0.935 | L | 65 | — | — | — |
| LGP105 | 85298.4 | 0.0441 | L | 57 | 1.03 | L | 81 | 0.712 | L | 25 |
| LGP105 | 85298.5 | 0.0413 | L | 47 | 0.893 | L | 58 | — | — | — |
| LGP105 | 85298.7 | 0.0409 | L | 46 | 0.691 | 0.06 | 22 | — | — | — |
| LGP102 | 85930.3 | 0.0330 | 0.03 | 17 | 0.642 | 0.25 | 13 | — | — | — |
| LGP102 | 85931.2 | 0.0361 | L | 28 | — | — | — | — | — | — |
| LGP102 | 85933.2 | 0.0417 | L | 48 | 0.745 | 0.01 | 31 | — | — | — |
| LGP102 | 85933.3 | 0.0308 | 0.26 | 9 | — | — | — | — | — | — |
| CONT. | — | 0.0281 | — | — | 0.567 | — | — | 0.571 | — | — |
| LGP99 | 85617.3 | 0.0641 | 0.04 | 32 | 0.928 | 0.25 | 14 | 0.639 | 0.09 | 15 |
| LGP98 | 83620.7 | 0.0623 | 0.04 | 28 | — | — | — | — | — | — |
| LGP97 | 83609.1 | 0.0561 | 0.23 | 15 | — | — | — | — | — | — |
| LGP95 | 83695.1 | — | — | — | — | — | — | 0.604 | 0.29 | 9 |
| LGP95 | 83695.2 | — | — | — | — | — | — | 0.632 | 0.14 | 14 |
| LGP87 | 85864.1 | 0.0673 | L | 38 | — | — | — | — | — | — |
| LGP86 | 84346.3 | 0.0627 | 0.05 | 29 | — | — | — | — | — | — |
| LGP83 | 85755.1 | 0.0673 | 0.04 | 38 | 0.984 | 0.18 | 21 | — | — | — |
| LGP83 | 85759.2 | 0.0565 | 0.23 | 16 | 0.963 | 0.07 | 18 | — | — | — |
| LGP83 | 85759.4 | 0.0580 | 0.15 | 19 | — | — | — | 0.674 | L | 22 |
| LGP110 | 85611.1 | — | — | — | — | — | — | 0.636 | 0.08 | 15 |
| LGP110 | 85612.1 | 0.0634 | 0.06 | 30 | — | — | — | — | — | — |
| LGP107 | 84338.1 | 0.0598 | 0.07 | 23 | 0.970 | 0.08 | 19 | 0.625 | 0.11 | 13 |
| LGP106 | 85865.2 | 0.0570 | 0.26 | 17 | — | — | — | 0.609 | 0.19 | 10 |
| LGP106 | 85869.2 | 0.0578 | 0.15 | 19 | 1.04 | 0.01 | 27 | — | — | — |
| LGP100 | 83691.2 | — | — | — | — | — | — | 0.648 | 0.05 | 17 |
| LGP100 | 83691.8 | — | — | — | — | — | — | 0.595 | 0.23 | 7 |
| CONT. | — | 0.0487 | — | — | 0.815 | — | — | 0.555 | — | — |
| MGP9 | 85224.1 | 0.0433 | 0.22 | 17 | — | — | — | — | — | — |
| MGP7 | 86137.1 | 0.0440 | 0.19 | 19 | — | — | — | — | — | — |
| MGP7 | 86141.3 | — | — | — | 0.827 | 0.17 | 26 | 0.655 | 0.09 | 17 |
| CONT. | — | 0.0370 | — | — | 0.659 | — | — | 0.558 | — | — |
| LYD918 | 85320.2 | — | — | — | 0.924 | 0.03 | 37 | 0.576 | 0.02 | 23 |
| LYD910 | 85212.1 | — | — | — | 0.816 | 0.13 | 21 | 0.531 | 0.21 | 13 |

TABLE 183-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYD880 | 85204.3 | — | — | — | — | — | — | 0.534 | 0.11 | 14 |
| LYD872 | 85570.1 | — | — | — | — | — | — | 0.570 | 0.06 | 22 |
| LYD858 | 85796.1 | — | — | — | 0.828 | 0.07 | 23 | 0.521 | 0.23 | 11 |
| LYD858 | 85797.1 | 0.0545 | 0.24 | 20 | — | — | — | — | — | — |
| LYD857 | 86635.1 | — | — | — | 0.912 | 0.01 | 35 | 0.534 | 0.13 | 14 |
| LYD857 | 86674.1 | 0.0540 | 0.18 | 19 | 1.03 | L | 53 | 0.579 | 0.04 | 24 |
| LYD856 | 85693.2 | 0.0884 | L | 95 | 1.24 | L | 84 | 0.526 | 0.28 | 12 |
| LYD855 | 84609.3 | 0.0755 | L | 67 | 1.05 | L | 56 | — | — | — |
| LYD855 | 84609.4 | 0.0539 | 0.22 | 19 | — | — | — | — | — | — |
| LYD852 | 85819.3 | — | — | — | 0.790 | 0.21 | 17 | 0.522 | 0.26 | 12 |
| LYD815 | 84416.1 | — | — | — | 0.783 | 0.23 | 16 | 0.569 | 0.04 | 22 |
| LYD815 | 84416.2 | 0.0575 | 0.12 | 27 | — | — | — | — | — | — |
| LYD815 | 84416.3 | — | — | — | — | — | — | 0.527 | 0.17 | 13 |
| LYD810 | 84436.2 | 0.0683 | L | 51 | 1.00 | L | 49 | — | — | — |
| LYD810 | 84437.5 | 0.0532 | 0.25 | 17 | 0.975 | L | 44 | 0.607 | L | 30 |
| LYD807 | 84078.1 | 0.0514 | 0.28 | 13 | — | — | — | — | — | — |
| LYD807 | 84080.1 | 0.0586 | 0.05 | 29 | 1.00 | L | 48 | 0.553 | 0.05 | 18 |
| LYD802 | 85132.1 | 0.0667 | 0.02 | 47 | 1.05 | 0.07 | 56 | 0.575 | 0.07 | 23 |
| LYD801 | 84618.4 | — | — | — | 1.02 | L | 51 | 0.583 | 0.06 | 25 |
| LYD792 | 85550.1 | — | — | — | 0.794 | 0.24 | 18 | 0.555 | 0.07 | 19 |
| LYD792 | 85553.1 | 0.0612 | 0.01 | 35 | 0.931 | L | 38 | 0.565 | 0.02 | 21 |
| LYD785 | 84430.1 | — | — | — | 0.850 | 0.11 | 26 | 0.534 | 0.24 | 14 |
| LYD785 | 84430.7 | — | — | — | 0.881 | 0.03 | 30 | 0.615 | L | 31 |
| LYD782 | 85902.1 | — | — | — | 0.843 | 0.11 | 25 | — | — | — |
| LYD782 | 85903.1 | — | — | — | 0.935 | 0.01 | 38 | — | — | — |
| LYD782 | 85904.3 | — | — | — | 0.781 | 0.23 | 16 | — | — | — |
| LYD771 | 85463.1 | — | — | — | — | — | — | 0.573 | 0.03 | 23 |
| LYD771 | 85463.3 | — | — | — | 0.865 | 0.05 | 28 | — | — | — |
| LYD771 | 85463.4 | 0.0580 | 0.09 | 28 | 0.888 | 0.05 | 31 | 0.559 | 0.07 | 19 |
| LYD723 | 84940.4 | — | — | — | 0.955 | 0.01 | 41 | 0.607 | 0.01 | 30 |
| LYD707 | 85707.1 | — | — | — | 0.867 | 0.03 | 28 | 0.528 | 0.14 | 13 |
| LYD694 | 84125.1 | 0.0644 | L | 42 | 1.07 | L | 58 | 0.527 | 0.11 | 13 |
| CONT. | — | 0.0453 | — | — | 0.675 | — | — | 0.468 | — | — |
| LYD907 | 84978.1 | 0.0491 | L | 50 | — | — | — | — | — | — |
| LYD906 | 84750.1 | 0.0433 | L | 32 | 0.643 | 0.15 | 19 | — | — | — |
| LYD906 | 84754.1 | 0.0401 | 0.16 | 23 | — | — | — | — | — | — |
| LYD904 | 84498.4 | 0.0449 | L | 37 | — | — | — | — | — | — |
| LYD904 | 84499.2 | 0.0439 | 0.02 | 34 | 0.696 | 0.02 | 29 | 0.629 | 0.02 | 20 |
| LYD903 | 85544.3 | 0.0429 | L | 31 | 0.646 | 0.13 | 20 | — | — | — |
| LYD903 | 85544.5 | — | — | — | 0.604 | 0.30 | 12 | — | — | — |
| LYD902 | 84948.3 | 0.0387 | 0.11 | 18 | — | — | — | — | — | — |
| LYD890 | 87189.1 | 0.0372 | 0.24 | 14 | — | — | — | — | — | — |
| LYD878 | 84487.3 | 0.0403 | 0.05 | 23 | 0.625 | 0.16 | 16 | — | — | — |
| LYD878 | 84488.8 | 0.0482 | 0.01 | 48 | 0.681 | 0.06 | 26 | — | — | — |
| LYD867 | 85535.1 | 0.0439 | 0.03 | 34 | — | — | — | — | — | — |
| LYD858 | 85796.1 | 0.0420 | 0.02 | 29 | — | — | — | — | — | — |
| LYD858 | 85797.1 | 0.0467 | L | 43 | 0.634 | 0.15 | 17 | — | — | — |
| LYD856 | 85693.2 | 0.0410 | 0.02 | 26 | — | — | — | — | — | — |
| LYD825 | 85883.3 | 0.0375 | 0.21 | 15 | — | — | — | — | — | — |
| LYD812 | 85560.2 | 0.0430 | 0.04 | 32 | 0.629 | 0.18 | 16 | 0.600 | 0.12 | 14 |
| LYD812 | 85563.4 | 0.0419 | 0.01 | 28 | — | — | — | — | — | — |
| LYD812 | 85564.1 | 0.0381 | 0.15 | 17 | — | — | — | — | — | — |
| LYD807 | 87413.1 | 0.0392 | 0.18 | 20 | — | — | — | — | — | — |
| LYD802 | 85132.1 | 0.0409 | 0.04 | 25 | — | — | — | — | — | — |
| LYD792 | 85553.1 | 0.0449 | 0.03 | 37 | — | — | — | — | — | — |
| LYD719 | 87356.3 | — | — | — | 0.647 | 0.12 | 20 | 0.601 | 0.14 | 14 |
| LYD718 | 85458.3 | 0.0442 | 0.03 | 35 | — | — | — | — | — | — |
| LYD699 | 85973.1 | 0.0386 | 0.09 | 18 | — | — | — | — | — | — |
| CONT. | — | 0.0327 | — | — | 0.541 | — | — | 0.526 | — | — |
| LGP82 | 83662.2 | 0.0413 | L | 19 | 0.783 | L | 41 | — | — | — |
| LGP82 | 83664.1 | — | — | — | — | — | — | 0.660 | 0.02 | 19 |
| LGP82 | 83666.2 | — | — | — | 0.708 | 0.01 | 27 | 0.648 | 0.05 | 17 |
| LGP81 | 84957.3 | 0.0433 | L | 25 | 0.882 | L | 59 | 0.707 | L | 28 |
| LGP81 | 84957.8 | 0.0371 | 0.25 | 7 | 0.651 | 0.09 | 17 | 0.620 | 0.20 | 12 |
| LGP81 | 84958.2 | — | — | — | — | — | — | 0.622 | 0.23 | 12 |
| LGP79 | 82510.1 | — | — | — | 0.680 | 0.03 | 22 | 0.627 | 0.18 | 13 |
| LGP79 | 82510.2 | — | — | — | 0.799 | L | 44 | 0.672 | 0.02 | 22 |
| LGP79 | 82512.1 | — | — | — | 0.730 | 0.02 | 31 | — | — | — |
| LGP79 | 82513.4 | — | — | — | 0.698 | 0.01 | 26 | 0.616 | 0.22 | 11 |
| LGP78 | 82506.1 | — | — | — | 0.624 | 0.26 | 12 | 0.629 | 0.16 | 14 |
| LGP78 | 82507.1 | — | — | — | 0.627 | 0.18 | 13 | 0.635 | 0.11 | 15 |

TABLE 183-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LGP78 | 82507.4 | 0.0398 | 0.18 | 15 | 0.793 | L | 43 | — | — | — |
| LGP78 | 82508.1 | 0.0377 | 0.17 | 9 | 0.669 | 0.04 | 20 | 0.618 | 0.19 | 12 |
| LGP77 | 81452.2 | — | — | — | 0.659 | 0.06 | 19 | — | — | — |
| LGP77 | 81453.2 | 0.0441 | L | 27 | 0.738 | L | 33 | — | — | — |
| LGP77 | 81453.3 | — | — | — | 0.711 | 0.01 | 28 | 0.643 | 0.08 | 16 |
| LGP77 | 81454.1 | 0.0414 | 0.04 | 19 | 0.775 | L | 39 | 0.693 | 0.01 | 25 |
| LGP76 | 83653.1 | — | — | — | 0.620 | 0.26 | 12 | — | — | — |
| LGP76 | 83653.2 | 0.0402 | 0.05 | 16 | 0.738 | 0.02 | 33 | — | — | — |
| LGP76 | 83653.3 | 0.0408 | 0.17 | 18 | 0.805 | L | 45 | — | — | — |
| LGP76 | 83654.1 | 0.0391 | 0.25 | 13 | 0.775 | 0.01 | 39 | — | — | — |
| LGP75 | 85309.1 | — | — | — | — | — | — | 0.691 | L | 25 |
| LGP75 | 85309.4 | 0.0524 | L | 51 | 1.02 | L | 83 | 0.686 | L | 24 |
| LGP75 | 87225.2 | — | — | — | 0.622 | 0.29 | 12 | — | — | — |
| LGP74 | 81324.2 | — | — | — | 0.675 | 0.07 | 21 | — | — | — |
| LGP74 | 81325.1 | 0.0429 | L | 24 | 0.952 | L | 71 | 0.627 | 0.18 | 13 |
| LGP74 | 81326.4 | — | — | — | — | — | — | 0.612 | 0.22 | 11 |
| LGP74 | 81328.1 | — | — | — | 0.654 | 0.07 | 18 | 0.620 | 0.15 | 12 |
| LGP73 | 81449.1 | 0.0473 | L | 36 | 0.987 | L | 77 | 0.745 | L | 35 |
| LGP71 | 82500.4 | 0.0388 | 0.17 | 12 | 0.830 | L | 49 | 0.680 | 0.01 | 23 |
| LGP71 | 82502.2 | — | — | — | 0.648 | 0.23 | 16 | 0.644 | 0.11 | 17 |
| LGP71 | 82502.3 | 0.0437 | L | 26 | 0.747 | L | 34 | 0.651 | 0.05 | 18 |
| LGP71 | 82502.4 | — | — | — | 0.653 | 0.09 | 17 | — | — | — |
| CONT. | — | 0.0347 | — | — | 0.556 | — | — | 0.553 | — | — |
| LGP94 | 84352.6 | 0.0546 | 0.41 | 12 | — | — | — | — | — | — |
| LGP90 | 85764.1 | — | — | — | — | — | — | 0.605 | 0.37 | 9 |
| CONT. | — | 0.0487 | — | — | — | — | — | 0.555 | — | — |
| LYD758 | 85109.6 | 0.0528 | 0.40 | 17 | — | — | — | — | — | — |
| CONT. | — | 0.0453 | — | — | — | — | — | — | — | — |

Table 183. "CONT."—Control; "Ave."—Average; "% Incr." = % increment; "p-val."—p-value, L- p < 0.01.

Results from T1 Plants

Tables 184-186 summarize the observed phenotypes of transgenic plants expressing the gene constructs using the TC-T1 Assays (seedling analysis of T1 plants).

The genes presented in Tables 184-186 showed a significant improvement in plant biomass and root development since they produced a higher biomass (dry weight, Table 184), a larger leaf and root biomass (leaf area, root length and root coverage) (Table 185), and a higher relative growth rate of leaf area, and root coverage (Table 186) when grown under normal growth conditions, compared to control plants grown under identical growth conditions. Plants producing larger root biomass have better possibilities to absorb larger amount of nitrogen from soil. Plants producing larger leaf biomass have better ability to produce assimilates. The genes were cloned under the regulation of a constitutive promoter (At6669; SEQ ID NO: 15751). The evaluation of each gene was performed by testing the performance of different number of events. Some of the genes were evaluated in more than one tissue culture assay. This second experiment confirmed the significant increment in leaf and root performance. Event with p-value<0.1 was considered statistically significant.

TABLE 184

Genes showing improved plant performance at Normal growth conditions under regulation of At6669 promoter

| | Dry Weight [mg] | | |
|---|---|---|---|
| Gene Name | Ave. | P-Val. | % Incr. |
| LYD823 | 7.00 | 0.16 | 11 |
| CONT. | 6.30 | — | — |
| LGP109 | 8.85 | 0.01 | 21 |
| LGP103 | 8.92 | 0.08 | 22 |
| CONT. | 7.31 | — | — |
| LYD819 | 5.87 | 0.14 | 24 |
| CONT. | 4.71 | — | — |

Table 184. "CONT."—Control; "Ave."—Average; "% Incr." = % increment; "p-val."—p-value, L- p < 0.01.

TABLE 185

Genes showing improved plant performance at Normal growth conditions under regulation of At6669 promoter

| Gene Name | Leaf Area [cm²] | | | Roots Coverage [cm²] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYD823 | — | — | — | 6.52 | 0.23 | 21 | — | — | — |
| CONT. | — | — | — | 5.37 | — | — | — | — | — |
| LGP109 | 0.632 | 0.12 | 11 | — | — | — | — | — | — |
| LGP103 | 0.631 | 0.20 | 11 | — | — | — | — | — | — |
| CONT. | 0.569 | — | — | — | — | — | — | — | — |
| LYD763 | 0.496 | 0.14 | 17 | 5.01 | 0.15 | 32 | 5.49 | 0.18 | 14 |
| CONT. | 0.425 | — | — | 3.80 | — | — | 4.84 | — | — |

Table 185. "CONT."—Control; "Ave."—Average; "% Incr." = % increment; "p-val."—p-value, L- p < 0.01.

TABLE 186

Genes showing improved plant performance at Normal growth conditions under regulation of At6669 promoter

| Gene Name | RGR Of Leaf Area | | | RGR Of Roots Coverage | | |
|---|---|---|---|---|---|---|
| | Ave. | P-Val. | % Incr. | Ave. | P-Val. | % Incr. |
| LYD823 | — | — | — | 0.770 | 0.24 | 23 |
| CONT. | — | — | — | 0.629 | — | — |
| LGP109 | 0.0610 | 0.28 | 10 | — | — | — |
| LGP103 | 0.0621 | 0.25 | 12 | — | — | — |
| CONT. | 0.0553 | — | — | — | — | — |

Table 186. "CONT."—Control; "Ave."—Average; "% Incr." = % increment; "p-val."—p-value, L- p < 0.01.

These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass, a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number, as demonstrated by the leaf number parameter, exhibit a potential to improve biomass and yield important for forage and plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

LENGTHY TABLES

The patent contains a lengthy table section. A copy of the table is available in electronic form from the USPTO web site (http://seqdata.uspto.gov/?pageRequest=docDetail&DocID=US10006042B2). An electronic copy of the table will also be available from the USPTO upon request and payment of the fee set forth in 37 CFR 1.19(b)(3).

SEQUENCE LISTING (16485 sequences)

SEQ ID NO: 1 - DNA, 60 bp, Zea mays
gtcaaagcagagtctgcccctccccgcgccgttctttttggttccccactccccagtccc

SEQ ID NO: 2 - DNA, 60 bp, Zea mays
ctcgacaaagcccacgccgcgccctcgccctcgccctcgcccccctgcctagggctccgc

SEQ ID NO: 3 - DNA, 60 bp, Solanum lycopersicum
atatttttaagaaaatgtttaaattgctgtttctgttggctatcttactgttgagcagcg

SEQ ID NO: 4 - DNA, 1572 bp, Arabidopsis thaliana
acatctctatatcaccacacaaaaaaccataaaatcaaaaatcgttacccacatttctttcattctatcctaaatcctcatcactcaacctgagctcacaaagctaaacaaaaaaaaaagagcttaggcggagaagaagaggagaccaaaacaccaaacaaacaacaatggctgtctcaactatctactcaacacaagctctcaattcaactcatttcttaacctcttcttcctcctccaaacaagtcttcctctaccgtcgtcaaccacaaaccaaccgtagattcaacacactcatcacttgcgcacaagaaaccatcgtgatcggactagctgctgactctggctgcggcaaaagtacctttatgcggaggctcaccagcgtctttggtggcgctgctaagccaccaaaaggcgggaaccctgattccaacacactcatcagcgacacgaccactgtgatctgtcttgatgattaccattctttggataggtacggtaggaaagagcagaaagtcaccgctttggacccacgcgccaatgactttgatctcatgtatgagcaagtcaaagctcttaagaatggtatagccgtcgagaaaccgatttataaccatgtcactggacttcttgaccctccggagcttattcagcctcctaagattcttgtcatcgaaggtcttcacccaatgtttgatgagcgagtaagagacttactagacttcagtatctacttggacattagcaacgaagtcaaattcgcttggaaaattcagagggacatggctgaaagaggtcacagtttggagagcatcaaagcgagtatcgaagcccgaaagcccgacttcgatgcattcatcgacccgcaaaagcagtacgcggatgcggtcatagaagtgcttcctacgactctgatcccagatgacaacgaagggaaagtgttgagagtgagattgataatgaaggaaggtgttaagtacttcagcccggtttacctgttcgatgaaggttcaaccatctcgtggattccttgcggccgcaaactcacttgctcgtaccctggcatcaagttcaactacgaacctgactcctacttcgaccatgaggtatcagttttggagatggatggacaatttgatagactggacgagctgatttacgtggaaagtcacttgagcaacctctcgaccaaattctacggagaagtcactcaacaaatgctcaaacatgctgatttcccgggtagcaacaacggtactggtcttttccaaaccattgttggattgaagatcagagatctctatgagcagctcattgccaacaaagccactgctcgtgcagaagctaaagcctaaaacaaacgaagcgaagccaaatagaacgcgtcgataaatacatccgcagtttcttctttttcttatttctttctttctttatgcgttgtttaccgcggattttcatggcgaaaaggacggtcttgcttgtttgtaatttgtgtggagataaaaagaaaaagcctgtaatgtagagaagtgaatagcagagcaataacagttcagtttatagaacgcc

SEQ ID NO: 5 - DNA, 2745 bp, Arabidopsis thaliana
cctggaaaaaacctttcactgcttgctttctcagtctctctgtctccaatggcgttcacctttctctctcctcacccagtctttctctctctaactggaacaacctcttccttctcctacaaaccagttctcttaccattctctcgaaattcccgtactctcacggttgcggcgggacctgctcgccggaattcgtacccgaaccctgctgatgacgatccacctgaagcaccggaggattcaatgcacggagtttcgaagtttcagcagatccagcgtcaagctgctcgtgcacggaagctagaggaagaagatttcgagaagaatcggaacacttatctctccgctatcgccgatgtggaagacgcggcggagacgggacgagatgacgaagaatctggtggagacttgttctctgatatcgatagagcaatctccatgaaacgtagtgagtttgttaagcaaggattgctcaaacctaatcctcccaaaacggcatcgcttaagaagattggggaggagggaaatgaggaagaaggtgatgttactgacgatgttgatgagcttgatgaagaagaagttgttgatttggatgaaattgataaattaactggattaacagagatttctgatgaagaagattgggttgatgaggaaggtaacactaggatcaacaagaagaaggagtttgggtctgatcatcaatttgaattcgatttggatgattttggtgaatctaaagcgagaatcgtggaacctaagttcaaaatgtgcttagctgagcttttagatgagagtaaagtggtaccaatctcagtttacggcgatttagatgtcgaaatcaccgggattcaacatgattcgcgcggtgtgagcgccggagatctcttcgtgtgttgtttaggaagtgaaaatttcttgagtgaagcagataagagaggagcagtggcggttgtagctagcaaagagattgatattgaagatactttaggttgcagagcacttgtcattgttgaagatacgaatgcagttttagcagctttagcttcttccttttataggcatccctcgaagaacatgtcggtgattggagttactggtacggatgggaaaacgactactacgtatttgattaagagcctctatgaagcgatgggtgtgagaacaggaatgtttagcacagtttcttgttatattcatggcgataacaaattggatacgcctaatgctacgatgaatcctgatgctgttttggttcagagtttgatggctaagatgttgcataatggaactgaatctttggttatggaagcttctcctcaagaacttgctttagggaaatgtgatgaagtggatttcgacattgcggttttcacaaatttgactagagaaaatacggattttcgtggtactgatgaagagtatagagatgctgaagccaagttgttttcaagaatggttgatccggaaaggcataggaaagtggttaacatagatgatccaaacgcagcattctttgtccagcaagggaatcctaatgttcctgttgtgacatttgccatggaaaacaccaaagccgatgttcacccgttaaagtttgagctttccttgtttgagacacaggttttggttaatacccctcaaggtatactggagatctcttcgggtttgttaggacggcataacatttataatattcttgctgctgtggctgttgggattgctgttggagctcctcttgaggatattgttagaggtgttgaggaagtcgatgcagtcccaggaaggtgtgagttgattgatgaggaacaagcttttggtgttattgtggatcatgcaaacacacctgatggcttgtcaaggctgctagattcaattcgagagcttaaaccgagaagaatcattaccgttattggttgtgagggtgagaatgaaagagggaaaagaccgcttatgacgaaaattgctactgaaaagagcgatgtgacgatgttgacatctgataatccgaggaatgaagatccattggacatcttggatgacatgttgtctgggattggatggacgatgcaagagtatttgaaacatggcgaacacgattactatccgcctttggcaaatggtcatagactcttccttcacgatattagacgtgtagctgtacgttgtgctgttgctatgggtgaagaaggtgatatggttgttgtagctgggaaagggcatgaagcgtatcagcttgaaggtgaaaagaaagagttttatgatgacagagaggaatgtcgggaagcattacaatacgttgatgagcttcaccaagctggaatagacacaagcgagttcccatggcggttaccagagagtcattaatatctctgtggtgaaatcattagaagagaagttagcttagtccatgaaaccagattttcttccaccatggtccaattctcttgcgaagatcgatttgcacagaggtaatgaattctacacaagtgacataaaaatcatgcccaaggaaaagagattacaccactgggaggaggaagattttaaaggtggaagaagatgcgtacaaattttgtaagggttaaaaacccaaaaatgtaagtggttctgttttgggtatgttttgatagcatgtgtttaatttagatgaaccaattcaaaccgaaccaacaaaaatagattccggtttaaattatttattttcttacatgtatccaaacttgaaaaaagtgaattcaaaga

SEQ ID NO: 6 - DNA, 1000 bp, Arabidopsis thaliana
gactatatcatctctcggtttcactattgaacgtgtaacactggtcgaaagaagacgaacataaactcgtctccggtaaccaaaaatggtttccatgactacttcatcttcttcgtacggaacattctctacagtcgtcaacagttctagacctaattcctcagcaacctttctcgtcccttccttgaaattctccaccggaatatcgaatttcgcgaatctgagtaatgggttttctctaaaatctccaattaatcctgggtttctcttcaagtctcgtcctttcactgtccaagctagagctgctgcagaaaaaaccgttcacgatttcaccgttaaggacattgatgggaaggatgttgctttgaacaaattcaaggggaaagttatgttgattgtcaatgttgcttcaagatgtggtttgacatcatcaaattactcagagctttcacatctgtacgagaaatacaaaactcaaggatttgagattctagcttttccctgcaatcagtttggtttccaagagcccgggtcaaactccgagatcaaacaattcgcttgcacccggtttaaagcagagttccctatatttgataaggttgacgtgaatggaccaagcacagcgccgatctacgagttcttgaaatcaaacgcaggaggattcttgggtggtctcattaaatggaactttgagaagttcttgattgataaaaagggaaaggtcgttgagaggtaccctcccaccacatcccctttccaaatcgagaaagacatccagaagttgcttgccgcttaaaaacttttgctcatgagtgagcatatagagactgatggttaaagtaaccgtaaattgtgacataaagtttccggttattgcttgtataccttcttacattctaagttgtactaatcgcttaataatttgcgtataatggtaatgttatatacattatattataaaaatggtgttatatatacaataagacaatctcgctcgcgc

SEQ ID NO: 7 - DNA, 1045 bp, Arabidopsis thaliana
aaaacacgatctaattaaattttgttttatttcataaacatagattagtttagaaaacgccatatgcaaatgtgtatcacctaattcttgggacctttcagaattcatatatacacataacaaacagtcttttcatttactttctctattcaatctcacacgcgctaaaccataacccgatattactaatgacgaactacggtgcgattccgacgtcgtctcatgcatctccgttggtggatgtcgagtctctctcacgcgctaaacaccgtatcaaagccgggctagccacgcgccgtgcttggagagtgatgttcgatttccactccatgggactgcctcacggtgtctccgatgcgttcacaagaatcaagaccaatcttgcttacttccgtatgaactacgcaatcgttgtcttgatcgttatcttcttcagcttgatctggcatccgacatcgctcatcgtcttcaccgtcttggtcgttgtttggatctttctgtattttctccgtgatgagcctatcaagctgttccggtttcagatcgatgatcggacggtcttgattgttttatcggtgttaaccgtcgttttactcctgttgaccaacgcgacgtttaatattgttggagcgcttgtgaccggagctgtgttggttttgatccattcggtggttaggaagacggaggatcttttcttggatgaagaagcggcgacgactgagacttctgggctgacgtcatacccgtcgacttaaatcgtttcatctcgaaatttgtgtatcttttctatttttgtatattatcttgtttttttaattatgcgtaatcaatttttattggtgtgagtttggtttgagactttctctctctcttttgttttctgagttttgagctctgtctgaagtttgaacaattctaatttgttataatttttattactccctctgtccataaaagataaattttttaggaaaaatatttgtcttacaaagatagaaattttatatttgcaatgcaaattttaaaattgttttcccgttttacc

SEQ ID NO: 8 - DNA, 1741 bp, Arabidopsis thaliana
ttctcttacatctctatcttcttaagttctttcctttgttcttcgatttgatcaccaactctcacatatttcgaaatcgtcacactttgttgcgtgtcgtcttctctctctcataattcttgagtttcacgtctcaagatttgatcacttctgccaattttccagattgatctctctaattatggcttccatgagtttcgccttgaatcgcttctctggactctcctctaaaaccaccttatcagctgacttcgatccatcctctcgccggagttttctaccgccgactagagttggacttaagatctcttccgccgccgaatcggagcctgatctcagtgtcactgtaaatggcctgaaaatgcccaatcctttcgtgatcgggtcgggtccaccgggtaccaactacaccgtcatgaagagagcctttgatgaaggttggggggccgtcatcgccaaaaccgtatctttagatgcatccaaagttatcaacgtgacacctagatatgctcggctacgaaccggatccaatggctcagccaaaacagatgtaattgggtggcagaacatagaactcatcagtgacagacctcttgaaaccatgctcaaagagtttgagcggttgaaaaaagagtatcctgatcggattctgattgcttcagtcatggaggaatataacaaaactgcttgggaagagcttatcgaccgtgttgagcaaactggtgttgatgctttagaaatcaacttctcgtgtcctcatggtatgccagagcgcagaatgggtgccgctgttggacaagattgtgcgcttctcgacgaggtttgcggatggattaatgctaaagctacagttcctgtatgggctaagatgactcctaatattactgacataactgagcctgctagggtgtcactaaaatccggatgtgaaggaattgcagcgatcaatacaatcatgagtgtaatgggaattgatatgaagacgttgcgtcctgagccatgcgttgaaggttactccactccagggggatactcttataaggccgttcgcccaattgcactggcaaaagttatgaacattgccaaaatgatgaaatctgagtttagtgaggatcgctcgctttcgggtattggaggagttgaaactggctatgatgccgctgaattcattctccttggatcaaatactgtacaggtatgcaccggtgtgatgatgcacggctatggtcatgtgaaaaccctttgcgctgagctgaaagatttcatgaaacaacacaacttctctacaatagaagagttcagagggcattcgctgcagtactttacaacacacacagatttagttaagagacagaaagaagcagttgagcagagaaaagctgagaagagaggcttgaaatctgataaagattggaccggggatgggttcgtgaaggagactgagagtatggtttctaactaagttagtagcctgatgaagttatgaccacccaaatatttcaataaaggttcagcaacttcattcacaactcacatgcaaattacgaaggctctttctttcaaatgtttaaaatcaacttcttaaatctcacttgaaaagaaataactaaattttatgtttcttaattttcttctcgttgtgtattattcatcttgtatccatccatagcaaccatttctttgttacttcaagttggcttaaattttggccaataataataccatagaccttctccatgaa

SEQ ID NO: 9 - DNA, 1741 bp, Arabidopsis thaliana
gcgtttcgttttttccctcccctaatattccaaaacgtcttgaattcatcattactagtttcctttccttagtaaaaccctacatttctccgcccgcctttgatttctccccggccgttcccgccgccggtctccgatttaaccaggattgagtctaattccttctttttgtgctcattgctgtcggattctctaccggcgttacatcgaccagccagactcttccccatttgactgctttactgattcaatcgctcttttagattctggaagttgtgactcagtatctccccttcaacgaattagcatcctgcgcaagaatgtctattgcatcatcacttacttcagccacactttgcggcgcctcagtttttcctaaagcattagcctgcagctctgagttccctatcaatcttcccagcccttttgaaagttcaaagatttgtttgacttcgtttcctgcctctagggatctcaagaaaaatgctactttgaatctgactcgaaatgttggtccagtcaggtgtcatgctatgcaagctgggacgagggagttgaagaaatttgaacttagtgatgtgattgaagggaaacagtttgatagagagatgctaagcgctatattcgatgttgcacgcgaaatggaaaagatagaaaagagctcttcacaaagtgaaatcctcaagggttatttaatggctaccctcttttatgagccttctacccgtaccaggctttcatttgaatctgctatgaaacgccttggaggtgaagtcttaactactgagaacgctagagagttttcgtctgccgcgaaaggggaaacacttgaagacacaataagaacagtggagggttattcagatataattgtgatgcgacattttgaaagcggtgctgcaagaaaagctgcagctactgccaatatacctgtcattaatgcaggtgatggtcctggagagcatcctactcaggctctattggacgtctataccatccaaagtgaaattggaaaattagatggcatcagtgtagccttagttggagaccttgccaacggaaggactgtgcggtctcttgcatacttgcttgccaagttcaaagacgtgaagatctactttgtttcccctgaaattgtgaaaatgaaggatgatataaaagactatttgacatcaagcggggttgaatgggaagaaagttcagatttaatggaagtagcatccaagtgtgatgtagtttatcaaacacgaatccaaagagagaggtttggagaaaggctggacctttacgaagcagctcgtgggaagtatatcgtagacaaggatctgttaggagtgatgcagaaaaaagctattatcatgcatcctttaccgagattggatgaaatcaccgcagatgttgatgctgatccaagagctgcctacttcagacaagcaaagaacggtttgttcattagaatggctcttctaaagctactgcttgtcggttggtgattggatagttcatggtcgttaagttaaatcctttaatggactgattctcaagcctaccatgagctcaaggaatctgcaataataaaatccgaagctttagtgatttttgagtgttaagcacaaaagctgtgatcttgatgttaattaaaagaaggatctgttggtttgttggttaaaagactgatatgaggaagagttgttgaacttaatgaataaattgatttgagctatttttcacagtttggcct

SEQ ID NO: 10 - DNA, 2058 bp, Arabidopsis thaliana
ataaagcttttacataaatacacacacccaaactaaaaaagaaaaaaaaaagaaagagagagagagaagaagaatcgtggagatggcttcgaccccgaagcttaccagtacaatttcatcatcttctccatctcttcaattcctctgcaaaaaactcccaatcgcaattcatctaccatcatcttcttcctctagctttctctcgcttcctaaaaccctaacctctctctattctctccgtccccgtatcgccctactctcaaaccaccgctattaccactctcgccggttttctgtttgtgccagtaccgataatggagctgaatcagaccgccactacgattttgatctcttcactatcggtgccggaagcggcggcgtccgcgcctctcgcttcgccactagcttcggtgcatccgccgccgtttgcgagcttcctttttccactatctcttccgatactgctggaggcgttggaggaacgtgtgtattgagaggatgtgtaccaaagaagttacttgtgtatgcatccaaatacagtcatgagtttgaagacagtcatggatttggttggaagtatgagactgagccttctcatgattggactactttgattgctaacaagaatgctgagttacagcggttgactggtatttataagaatatactgagcaaagctaatgtcaagttgattgaaggtcgtggaaaggttatagacccacacactgttgatgtagatgggaaaatctatactacgaggaatattctgattgcagttggtggacgtcctttcattcctgacattccaggaaaagagtttgctattgattctgatgccgcgcttgatttgccttccaagcctaagaaaattgcaatagttggtggtggctacatagccctggagtttgcggggatcttcaatggtcttaactgtgaagttcatgtatttataaggcaaaagaaggtgctgaggggatttgatgaagatgtcagggatttcgttggagagcagatgtctttaagaggtattgagtttcacactgaagaatcccctgaagccatcatcaaagctggagatggctcgttctctctgaagaccagcaagggaactgttgagggattttcgcatgttatgtttgcaactggtcgcaagcccaacacaaagaacttagggttggagaatgttggcgttaaaatggcgaaaaatggagcaatagaggttgacgaatattcacagacatctgttccatccatctgggctgttggggatgttactgaccgaatcaatttgactccagttgctttgatggagggaggtgcattggctaaaactttgtttcaaaatgagccaacaaagcctgattatagagctgttccctgcgccgttttctcccagccacctattggaacagttggtctaactgaagagcaggccatagaacaatatggtgatgtggatgtttacacatcgaactttaggccattaaaggctaccctttcaggacttccagaccgagtatttatgaaactcattgtctgtgcaaacaccaataaagttctcggtgttcacatgtgtggagaagattcaccagaaatcatccagggatttggggttgcagttaaagctggtttaactaaggccgactttgatgctacagtgggtgttcaccccacagcagctgaggagtttgtcactatgagggctccaaccaggaaattccgcaaagactcctctgagggaaaggcaagtcctgaagctaaaacagctgctggggtgtagagaaggttgcaaaaaagattgtatttacggcattggagccccctgataaggagaacattgtgtctgtgaagaagaagcttttcttttggcagagaatattttttcataatgtcgtgtgaagatatgatcgctgtcctgcaatacttttgatcgtttgacacacgaccaaattcctcgagagagagaggttgtaactattccgaaagagctctaaaactgaagctttcagttcttgtgacatcataatgaaggctgtatagatataacagtttcgagtt

SEQ ID NO: 11 - DNA, 1989 bp, Arabidopsis thaliana
agtcattttgagaaattttcgattttgagatttttttccaaatattacaaaaggaaataattagattcctctttctgcttgctataccttgatagaacaatataacaatggtgtaagtcttctcgctgtattcgaaattatttggaggaggaaaatggagtgtgttggggctaggaatttcgcagcaatggcggtttcaacatttccgtcatggagttgtcgaaggaaatttccagtggttaagagatacagctataggaatattcgtttcggtttgtgtagtgtcagagctagcggcggcggaagttccggtagtgagagttgtgtagcggtgagagaagatttcgctgacgaagaagattttgtgaaagctggtggttctgagattctatttgttcaaatgcagcagaacaaagatatggatgaacagtctaagcttgttgataagttgcctcctatatcaattggtgatggtgctttggatctagtggttattggttgtggtcctgctggtttagccttggctgcagaatcagctaagcttggattaaaagttggactcattggtccagatcttccttttactaacaattacggtgtttgggaagatgaattcaatgatcttgggctgcaaaaatgtattgagcatgtttggagagagactattgtgtatctggatgatgacaagcctattaccattggccgtgcttatggaagagttagtcgacgtttgctccatgaggagcttttgaggaggtgtgtcgagtcaggtgtctcgtaccttagctcgaaagttgacagcataacagaagcttctgatggccttagacttgttgcttgtgacgacaataacgtcattccctgcaggcttgccactgttgcttctggagcagcttcgggaaagctcttgcaatacgaagttggtggacctagagtctgtgtgcaaactgcatacggcgtggaggttgaggtggaaaatagtccatatgatccagatcaaatggttttcatggattacagagattatactaacgagaaagttcggagcttagaagctgagtatccaacgtttctgtacgccatgcctatgacaaagtcaagactcttcttcgaggagacatgtttggcctcaaaagatgtcatgccctttgatttgctaaaaacgaagctcatgttaagattagatacactcggaattcgaattctaaagacttacgaagaggagtggtcctatatcccagttggtggttccttgccaaacaccgaacaaaagaatctcgcctttggtgctgccgctagcatggtacatcccgcaacaggctattcagttgtgagatctttgtctgaagctccaaaatatgcatcagtcatcgcagagatactaagagaagagactaccaaacagatcaacagtaatatttcaagacaagcttgggatactttatggccaccagaaaggaaaagacagagagcattctttctctttggtcttgcactcatagttcaattcgataccgaaggcattagaagcttcttccgtactttcttccgccttccaaaatggatgtggcaagggtttctaggatcaacattaacatcaggagatctcgttctctttgctttatacatgttcgtcatttcaccaaacaatttgagaaaaggtctcatcaatcatctcatctctgatccaaccggagcaaccatgataaaaacctatctcaaagtatgatttacttatcaactcttaggtttgtgtatatatatgttgatttatctgaataatcgatcaaagaatggtatgtgggttactaggaagttggaaacaaacatgtatagaatctaaggagtgatcgaaatggagatggaaacgaaaagaaaaaaatcagtctttgttttgtggttagtgaccgagaaatgtttaaatcaacaagagtaaaaatgttcaacacatgcttttaatttttatcaatttatttcgcttatattgtt

SEQ ID NO: 12 - DNA, 1280 bp, Brassica juncea
atttcatttcctctgcaatggcgactgctttgaatgctgctgtctctctcacatcttcaaaatcttcttctcttccagctacaagctgtgccattgctcctgaaaggatcaggtttggtaagggtgctttttactacaaaagcaacaatgtagtgacaagcagaagagtggtttcggtaagagctgaagtcacaacagatactcctccagtgaagaaagtagagaaagagtcaaagaagaacgaggaaggtgtgatcaccaacaagtacagaccaaaagagccttacaccggcaaagtccttctcaacaccaagatcacagctgatgatgcccctggagagacctggcacatggttttcagccatcaaggtgaaataccgtacagagagggacaatctgttggtgtgattgcagatgggattgacaagaatgggaagcctcacaaggtcaggctttactccattgcaagcagcgctcttggagacctcggcaactctgaaaccgtttctttgtgcgtgaaaaggcttgtttatactaatgacgcaggagaggttgttaaaggagtttgctcaaatttcttgtgtgacttgaaaccagggagtgatgttaagctcactggtcctgtaggaaaagaaatgcttatgccaaaggatccaaacgccactgttattatgcttgccacagggacaggaatagctcctttcaggtctttcttgtggaagatgttcttcgagaaacatgatgactacaagtttaatggcttagcttggctgttcttgggtgtaccaaccactagttcattgctctacacagaggagtttgataagatgaaagcaaaggcacctgagaatttcagggttgattacgctataagcagagaagaaacgaacgataaaggagagaaaatgtatattcagaccagaatggcgcagtacgcacctgaactatgggagttgttgaagaaagacaacacatttgtctacatgtgtgggctcaagggcatggagaaaggaattgatgacattatggtctcattagctgctaatgacggtattgactggtttgattataagaagcagttgaagaaggcagagcaatggaacgttgaagtctactgatttaacattcagtggcaagtatagtggagcaacaagtgtaattttcgcatccaagtttctgtaatctgaagataagctatgttttagatatatatattatactaaggaaatttttttttttaacctccaaaatacatatcattatgaacagagagaagaaat

SEQ ID NO: 13 - DNA, 2614 bp, Hordeum vulgare
actccccgccccaccactccgccgcgctcggctcacacgccaccggcgatggcctcccgcctcctccgcctgcaccaccagctccggcgccggcgccaccacggcacgagccccgtcccctgcaggctcctctcctcctcctccgccacggagccgccgccgccgccccagacggtggagaaggcgctggtggccaaccggggcgagatcgcgtgccgggtcatgcggacggcgcgccggctcgggatcgccaccgtcgccgtctacagcgacgccgaccgcgccgcgctgcacgtgcgcgccgccgacgaggccgtccggctcggcccgccccccgcgcgggagagctacctcaacgccgccgccatcgtcgacgccgccctccgcaccggtgcgaaggcgatccaccctggatatgggtttctttcagagagcgcagattttgcacagctctgtgaatccgaggggctaacatttattgggcctccgccatctgcaatccgagatatgggtgataagagcgcctcaaagaggatcatgggtgctgctggtgtaccgcttgttccaggctaccatggggctgaccaagacattgagttgttaaaacttgaagctgataagattggatatccagttttgattaaacccacccacggtggaggcggcaaggggatgagaatagttcaagggcctgatgactttgtcgattctgtacggagtgctcaacgtgaagctgcagcatcatttggtatagacacactgttgattgagaagtatattactcaacccagacatatagaagtccaggtatttggtgacaaacatggaaatgctattcacctttacgagagagactgcagcctacaaagaaggcatcagaagatcatcgaggaagcaccagctccaaatgtgacaactgagtttcggactcatattggtgaagctgctgtgtcggctgcgaaggcagttggttactacagtgctggaacagtggagtttatcgtggatactctttcaggagaattctatttcatggagatgaatactcgactccaggttgaacacccagtaacagagatggtcgttggtcaagatcttgcggagtggcaaatacgtgttgcaaatggagagcgcctgccattatcccaggagcaagtcccattaaatggacatgcatttgaagcccgaatatacgctgaaaatgttccaagaggatttcttcctgcaacaggaaccttacatcactatcaaccagtcctgtcttccccaacagtaagagttgaaactggagttgaagaaggagatgctgtcagtatgcattatgatcccatgatagccaaacttgtagtttggggtgaaagtcgcaatgctgcactagtcaagctaaagaactgtttgtcaaactttcagattgcaggtttgcctacaaatgttgctttccttcaagaactcgcaggccataatgcctttgaaagaggcctagttgatacacatttcattgagcggtacaaagatgattttcaaagtacttctgctaaggcctcgggtgaagcacatgatgcagctaagcttggtgcaattttggctgctgcctgcatttgtaaaaaggatcacattacctctgaagaatcccttcgtgacaagacactttcggtatggtatacccgtccacctttcaggatgcatcactccgcgaagcgtttgatggaatttgagttagatgaagaacttgaggagttgagtgatgagcttcttaaattattggttacgtataaatctgatggaggctacttcattgagactgaagatggctcttctcctggttttgatgtcaaagtagatggtaggagtgaaaatgattttcgggttgaagttggtggtgtgcaaacagacgtgacattagcattttattcaaaggataatagcaaacatatacacatctggcatgggaagcatcaccatcattacaggcagaccatgagagctgagcatttgcttgatgacagttctcagccaaggcaggcttccgagggaaggtcacatccaaaaggaagtgttttggcaccaatggctggtttggtcgttaaggttttgcttaaggatggggtacatgtggaagatggtcagcctgtcatggttatcgaagcaatgaagatggagcatgtcgtgaaggcgcctcgggcaggttatatagaagggctgaaggctaccgctggacaacaagtttttgactccagtgtccttttcactgtcaaggataagagcacaaactgatgaaccaagaaattggggccccatatcggaattgaagtggcgcctccgtccttcggaaagaagaataagcaaacaagcagctggagatcatcctgtgactaaataatactaggtgatctccctagtatagccggagatcgtatcttgtggcgcccatttcctgtatagcctgtacattaatgtcagtggcattgtgcaatgtaacaaatcatgtgagtatgtaacgcaatttgtctgccttgcattgtccaatgtgaaccttcttgattgagaaattcgatggtccaacaacaaaaaaaaaaaaaaaaaaaaaaaaacactgtcatgccgttacgtagcg

SEQ ID NO: 14 - DNA, 1715 bp, Hordeum vulgare
acgccttcgccccgggacctcgctgcttctagaagcttctagaaacaccctctccgccccatcagcctagccaggcctacgtgctggtgtaggccgacacgacccgctgacccgtgccgcatccttagccccggttgtgcgaaggatgctggcgtccagggtctgttctaggtccgcgtcgcagtcctcgaccgcctccccgcgtgccttgacttccgcagcggcctcggcggctaggtcccttctgctgcggtccggcatgcaggctacccctggtctctcagagcggccttgccccgggataggcgaggccggtgttcgcaaggccgatgcgccgccgccgtgttcttcttcaggcgattcgcgagaagaacatgcttgcagaaggcagacaaatcaaaggcatccggtgtctaatcgagccaagtctgtcggagggaaccgccatgttctttatgcaagttatctttcacagaaccaacaaaactacagatgtttttcggcttcttccgaccaagagaggatagaagctgcaaacaggataatacatgatctgccaaggtgtgtgaaaattgtagaagttgggcctcgagatggactgcagaacgaaaaaaatacagtgccaacacctgtaaagattgagctcataaagagattggcaacctctggattatcagttgttgaggcaacaagttttgtctccccaaaatgggtgccacagctagctgatgcgaaggatgttatggaagtggttcggaatattacaggtgtaaattttcctgtattgactccaaacctcaagggatttgaagcagcagccgcagcaggtgccaaagaagttgcaatatttgcgtcagcttctgaagcattttcaaagtcaaacataaactgttcaattaaacagagccttgttcgctataatgatgttgctcttgcagcaaaaaagcaagaaattcctgtacgagggtatgtttcttgtgtggttggatgcccagtagaaggatcagtaccaccttcaaatgtagcttatgttgccaaagagctttatgacatgggctgctatgaggtttcgcttggtgatacgattggagttggtaccccaggcacagttataccaatgcttgaggcagttatgtccgtcgttcccgtggaaaagcttgctgtccatttccacgacacctacgggcagtctctttcaaacatactcgtctctctccagatgggcgtcagtgtcgtggactcctccgtcgcgggcctcggtggctgcccgtatgcgaagggcgcgtcgggtaatgttgctaccgaggacgtagtgtacatgctaaacgggttggggatcaagacgggtgtagatctgggcaaggtaatggcagccggcgagttcatctgcaagcacctggggcgccagtctgggtccaaggcagctaccgccttgagcaaggtcacagcgagcgcctcaaagctatgaggctgctcttagtgctgttactccgtaacatcataatggcatgtccgtttatcgtatgcagtgaccccctgttgaagaagatacatgtacaataccgaaacccaaaaaagtactccctccgtttaagacgatttcgcagttcaatctgtactgccaaaacgtcttatatttatgaacagaggtggtacataaaatgaataaatggcacatactgtatgatgttctgcctaatgaaatggcattctga

SEQ ID NO: 15 - DNA, 2176 bp, Hordeum vulgare
ccaatcgtctcgcctctccccttcttttcccctcctcacacttccggcggcagcgcggcgagagctcggacctcggagaaagagagagagagagagagccatggcgacaaccgcggccctccctttctcctgcgccgccaccctccagaccctgacccgcaccctctccccgcgccgctccatcctcatccaccgccaccgcctccgctctctcgccgcctccccgcggctcccggaccgcccccgcgcccgcctatgccgccccgtctcggcgtccgccgcgcccaacggatcctcctccgcgggggagtacgactacgacctcttcaccatcggcgccgggagcggcggcgtgcgggcctcgcgcttcgcctccaccctctacggcgcccgcgccgccatctgcgagatgcccttctccaccatctccgcggacgacctcgggggcctcgggggaacatgtgtgcttcgcgggtgtgttccaaagaaactgttggtgtatgcatctaagttctctcatgagtttgaagagtctcatggctttgggtggacatacgatactgatccaaagcatgactggagcactctgatagccaacaaaaatacagagctgcaacgcctcgtcggcatttacaaaaatattttgaagaacgcaggagttgatctaattgaaggccgtggaaaggtggtcgatgcacatactgttagtgtggatggcaagctgtacactgccaagaacatacttatagctgttggtggtcgaccatcgatgccagatctcccaggaatagagcatgttatagattctgatgctgcactagatctgccgtcaaaacctgagaaaattgcaatagtgggaggtggatatattgccttggagtttgctggcattttcaatggcttaaaaagtgacgttcatgtgtttattcggcaaccgaaagttttaagagggtttgatgaagaggtcagagatttcattgctgaacagatgtctttgaggggtgtcacatttcatactgaacatagtcctcaagctataaccaaatcaaatgatggtttactatctctgaagacaaacaaagaaactattggtgggttttcacatgtaatgtttgcaacaggtcgtaaaccgaatacgaagaaccttggactagaggaggttggtgtcaaaatggacaaaaagggggctatagtggtcgatgagtattctcgaacctcagtggattcaatttgggctgttggagatgttactgataggatcaacttgactccggttgcactgatggaaggtggagcatttgcgaaaactgtattcggtgatgaacctaccaaaccagagtacagagctgtaccagctgctgttttctcccaaccacccattgggcaagttggccttaccgaggagcaggctattgaagagtatggagatgttgatgtctacttatcaaacttcagacctcttagagccactctttctggattacctgatcgcgtactaatgaagctcattgtgtgtgctaccacgaacaaagttgtaggagtgcatatgtgtggtgatgatgcccctgagataatccagggaattgcaattggtgttaaagctgggttgacaaagcaagattttgatgccactgttggcgttcacccgacatctgcagaggaatttgtcactatgaggagtccaactagaaaagtacgaagaaaaactgcagccgaggcagagtctaaggatgaggtcgtcgctcagaagtagataatgccgttgaccgctgtacatagaagtcattcttgaggacgagtccctgccaccacgcgaaacctgactggaaatacgcagctagacttgtgcacagttgcccgagaaatctgccacaatgattgtatcataacgatgaatgtccacctctgcttttttgcccctcccatctgcgcattttctttgctgcttgaggcttgagcacgctggtcgttgagtttcttttccccatctgctattcatgtaataaatggtgtacaatgtggctgtgggtgggtagtatctcaacctggaaacgccgctccggaatactagaaaaccagtgaagagtacaagtactagtgacgtggacgtggttttccccttgattcgttcacctgtgctggcttgtatcatgtgttattaccagcaaatctaccg

SEQ ID NO: 16 - DNA, 1908 bp, Lactuca sativa
gtagacagagttcgagatattttccttcaatttttcgtaattaaattatcgtttccgaaacaaatgacgtgaaagttcttcaaaattgaattaattgtaatcctgaaaacttgatttgtgatagaagaatcaatggagtgctttggagctcgaaacatgacggcaacaatggcggtttttacgtgccctagattcacggactgtaatatcaggcacaaattttcgttactgaaacaacgaagatttactaatttatcagcatcgtcttcgttgcgtcaaattaagtgcagcgctaaaagcgaccgttgtgtagtggataaacaagggatttccgtagcagacgaagaagattatgtgaaggccggtggatcggagctgttttttgttcaaatgcagcggactaagtccatggaaagccagtctaaactttccgaaaagctagcacagataccaattggaaattgcatacttgatctggttgtaatcggttgtggccctgctggccttgctcttgctgcagagtcagccaaactagggttgaacgttggactcattggccctgatcttccttttacaaacaattatggtgtttggcaggatgaatttataggtcttggacttgaaggatgcattgaacattcctggaaagatactcttgtataccttgatgatgatgctgatcccatccgcataggtcgtgcatatggcagagttcatcgtgatttacttcatgaagagttgttaagaaggtgtgtggaatcaggtgtctcatatctaagctccaaagtagaaagaatcactgaagctccaaatggctatagtctcattgaatgtgaaggcaatatcaccattccatgcaggcttgctactgttgcatcaggggcagcttcagggaaatttctggagtatgaacttgggggtccccgtgtttgtgtccaaacagcttatggtatagaggttgaggttgaaaacaacccctatgatccagatctaatggtgttcatggattatagagacttctcaaaacataaaccggaatctttagaagcaaaatatccgactttcctctatgtcatggccatgtctccaacaaaaatattcttcgaggaaacttgtctagcttcaagagaagccatgcctttcaatcttctaaagtcaaaactcatgtcacgattaaaggcaatgggtatccgaataacaagaacgtacgaagaggaatggtcgtatatccccgtaggtggatcgttacctaatacagaacaaaagaatctcgcatttggtgctgcagctagtatggtgcaccctgccacagggtattcagttgtccgatctttgtcagaagctcctaattatgcagcagtcattgctaagattttaagacaagatcaatctaaagagatgatttctcttggaaaatacactaacatttcaaaacaagcatgggaaacattgtggccacttgaaaggaaaagacagcgagccttctttctattcggactatcacacatcgtgctaatggatctagagggaacacgtacatttttccgtactttctttcgtttgcccaaatggatgtggtggggatttttggggtcttctttatcttcaacggatttgataatatttgcgctttatatgtttgtgatagcacctcacagcttgagaatggaactggttagacatctactttctgatccgacaggggcaactatggtaaaagcatatctcactatatagatttagattatataaataatacccatatcttgcatatatataagccttatttatttgttttgtatccttacaacaacatactcgttaattatatgttttttaagtaatgctcacaatatttttttgaccaacttatactgttgtgtggactactttggaatgtgttatgct

SEQ ID NO: 17 - DNA, 1331 bp, Zea mays
aaaaaatgaaaaccatatagaacgtcgttcgcgaccccaccgtatccccctccctcgccccctcactgctctcgctttcgctcgccatccgccgtcccgctccgcacaccggccctgcccgatgccttcgcccgccgcggccgcggcggcgcctttccaccgcatcgcatgcgcgcgtcagcacctccctcaaacccgtctcttcttcctcccatcccgcgcgctgctcaaatccgaccgcctcaccgtcccggctccgctgcgcgtccacgcgctgaggctgcctccgacggtgccacgggcggcaagccacgatgccgccacgggcgtgagatcgcccacatctggcggccagatgctggtgttcgtcccgccgcacccgctcataaagcattgggtctccgtgctgcgcaacgaacagacaccctgcgtcatcttcaagagtgccatggcagagcttggtcggctgctcatatacgaagcatccagagattggttgcctacaatcacaggagagattgagacacctgtagctgtagctagcgtagaatttattgatccaagagagcctgttctggttattccaatactgagagctggtcttgcactagctgaacttgcttcatcagttctgccagccaccaagacttaccacctcggctttcgtagggatgaagaaacgcttcaaccttcaatatacctgaacaacctgccagacaagattccagagggtactcgtgtgctagttgttgacccaatgctggccactggtgggacaatggttgctgctattgacttgttaatcgagtgcggagttactagcaagcagattaaagttatatctgctattgcatcacctcctgccctgcaaaagctcaataacaagttccctgggctccacgtgtacacaggaatgattgatccagaagtaaatgagaaaggttttatagttccaggactgggggatgctggcgacagaagctttgccacataatcagactgcccaatttgattgggtcagtgttcgacctgcgagaatctttgcttgagtttcacagaaacggagcgactgccagtagcagtgtttattgctgtagattactttcgtttgagattttgttccttttttcagtgttatcagctgcctaccattttgtagcacccattctgtatgattgtgtagaatacaaggctagttcaaatgtccccagatggtaaaatgctcgagagaacaaggttccgttcaaaatgacggattattgaagtttctgctctctaatattttgccagtcgatggaataaacatacgtcattgtgcttaatcttgttta

SEQ ID NO: 18 - DNA, 2214 bp, Zea mays
gtgccaatccaaaaccgccacgtgccatatccggtgatacgcctccccggcctctcgtgtctcgtcgtctccctctccctccacaacggcatagctgcagcagccaagtcctctccgctctcttcgccgccaccgccgacaaataaccgccgcaattcgaagcaagagagccgcaccaggagaagatatagtgagagtgagagcccgaggagggggtggcgcgatggggctctcgggcgcgacgatctcggcgccgctcggctgctgcgtgctgcggtgcggggcagttggcggaggtaaggccctgaaggcggacgcggagaggtggcggcgggcgggatggagccgacgcgttggcggaccgaaggtgaggtgcgtggcgaccgagaagcacgacgagacggcggcggtcggggcggcagtgggcgtggatttcgcggacgaggaggactaccgcaagggcggcggcggcgagctgctttacgtgcaaatgcagtcaaccaagcccatggaaagccagtccaagatcgcttccaagctatcgcccatatctgatgaaaatacagtgcttgatttggttatcattggttgtggtccagctggtctttctctagcttcagagtcagctaagaaaggtctcactgtaggtctcattgggcctgaccttccattcacaaataactatggtgtgtgggaggatgaatttaaagatctcggtctagagagctgtatcgagcacgtctggaaggatactattgtctacctagacaataacaagccgatactgattggccgttcttatggcagggtgcaccgtgacttgctccatgaggaactgctgaaaagatgctatgaagctggcgtgacatacctgaactccaaagtggacaagatcatagaatctccagatggacacagagtagtctgttgtgacaagggtcgcgagataatttgcaggcttgccattgttgcttcgggggcagcatctggtaggcttctagagtatgaggttgggggtccccgtgtttgcgtgcagactgcatacggagtagaagttgaggtggaaaataacccatatgatcctagcttaatggttttcatggactacagagattgtttcaaagaggaattctcacacactgaacaagaaaatcccactttcctgtatgctatgcccatgtcacccacacgagttttctttgaggaaacatgcttagcttctaaagatgctatgtcttttgatctacttaagaagaggctgatgtatcggttgaacgcgatgggaattcgtatcctgaaagtttatgaggaggaatggtcctacattcctgttggagggtccttaccaaacacagatcagaaaaaccttgcattcggtgctgcagcaagtatggtgcatcctgcaacagggtactcagtggtcagatctttgtctgaggctccaagatatgcttctgtgatatcggacatcttaggaaatcgagttcctgcagaatatatgctcggaaattcacaaaattacagtccatcaatgcttgcatggagaacactgtggcctcaagagaggaaacgccaacgatccttcttccttttcggattagcgttgataatccaactgaataatgaaggcatacaaacattcttcgaagcctttttcagggtgccgagatggatgtggcgaggatttcttggctcgaccctttcatccgtcgatctcatactattctcattctacatgtttgcgatagctccaaatcaattgcgaatgaaccttgtcaggcatctcctctctgacccaactggctcatccatgatcaagacctacctgaccttataaaaccatttgcaccaggctgcaagaactcttagaaactgtacagttttgtagttgtacataagttagagaggatctggggggttacttggcggcggatctaggggttagcagcaatgctataatacactgtaaatcttttatggttgctatggtgattggatagagaagcacaccgtgttgtgcacgatggaagaataataagagagatcaggtgatggtcatggttcctgcattggccaattttaggttgcatttgctgtttcaaggcttcttacatgtccaatcaattacacccttattttaggttgctcaatgccaattttcttgtggaacaatatttgcaaaagcaaaaaagggaaaaacataattggatgtgc

SEQ ID NO: 19 - DNA, 1601 bp, Solanum lycopersicum
cactctatatattatggttaatattatttgaggttactccgtctcaaagggaacagagaaattcatatatttttcggtattccttcttctctttgaatggccggccaaacagtcattgtttccggtttgaatccggcggccattcttcagtccacaatcggtggagctccggtggcagcggcggcggagaacggccatacgagaaaagttgttcctctgtcaaaagatgcccttcaggatttcatggtttcaatcataacacagaaattacaggacgataaacaacccttttatgttctagatttgggtgaagttgtttcccttatggaacaatggaactctgctttaccaaatatccgtccgttttatgctgttaaatgtaaccctgaaccttcatttctctccatgttgtctgctatgggttccaattttgattgtgctagccgtgctgaaattgagtatgttttgtctcatggtatctcgccggaccggattgttttcgctaacccttgtaagccggaatccgatattatcttcgccgagaaaattggggttaatctcactacttacgattccgaggatgaagtttacaagatccgtaaacatcacccaaaatgcgagcttttgcttcgaatcaaacccatgaccgacggcaacgcgagatgcccaatgggtccaaaatacggcgcattaccggaggaaatcgagccgctcctccgtacagctcaagccgctagactcaccgtctccggcgtgtccttccatatcggcagcggagacgccgattccaacgcttatctaggagccatagccgcagcgaaacaggttttcgaaacagcagctcaactcggaatgccaaaaatgacggtactcgacatcggcggcggatttacctccggccaccaattcaccaccgctgctcccgccgttaaatcagctctggaaacccacttccacgacttccctgagctaaccatcatcgctgaaccaggtcgtttcttcgccgaaacagcgttcactttagcaacaaccatcatcggcaaaagagtcagaggtgaattaaaagaatactggatcaacgatgggttatacggatcgatgaactgtgtactttacgaccatgcgacggtgacggcgacgccattagcgtgcatgtcgaatcgtaataacctcaactgcggcgggtcgaaaacgtttccgtcgactgtattcgggcccacctgtgatgcacttgataccgtgttaagggattaccagttaccggagctacaggttaatgactggctgatttttcctaatatgggtgcttatacaaaagctgctggatcaaatttcaatggatttaacacatccgccattgttactcaccttgcttatgcttatccaaactaatgattaattaggctttaattagcatggtcattgtaattttttttcttctaattttgttcttgtttggtaatttattttccaatcagcttgtagtttcttttttctttttggtctcataagataagcaaggattagtcaattggatttgcatgtacttatattttatgtctaaataatccaatttcatgtattgaattttgtgttcgaat

SEQ ID NO: 20 - DNA, 1009 bp, Solanum lycopersicum
ttcctattttacccttatatatacgactaaatcgatggttccctcacagtttcagccatggcttccatgatcgaatctgcttgggcgtttcttcttgcaaattttagtgatttccaattgacttctcttggaggtttcattgttcatgagagcgctttcttcttgtctggaatccctttcatccttttcgaaaaggcagggtggtttggcaagtacaaaattcagaaaaagaccaacaccccggaagctcagcagaaatgtattactcgtctgctgatatttcatttttgtgttaatcttccaatcctgatagttacgtatccgctctttaaattcatggggatgcgatctactcttccattgccatcctggaaagtggtttcaacccaagttttattctatttcatcttggaggatttcgtattttactggggacacagagttttacatacgaaatggctctacaagcacgtccacagtgtccatcatgagtacgcgacaccatttggtttgacatctgagtatgctcaccctgctgaaattctcttccttggatttgctacggtcattggtcctgcaatcaccgggccacatttgataacattatatctatggatctctcttagaatcctcgagacagtcgaggcacattctggataccatttcccctggagcccgtcaaacttcttgccattatatggagggtctgattttcatgattaccatcatcgactgctctacacaaagtctggaaactactcatcgactttcgtttacatggactggttatttggtactgataagggttacagaaagttgaagatgctgaaggagcaagagggcaaagcaatgtaaacaagatgggaaagtagagggggaataaaattacatgtttgtttgagtgtataagaaatagtactgaacagattctattagtaatgatgagattaataacgtaaggattagttatgttggcattattaatgcaagaagtagttataacatgcac

SEQ ID NO: 21 - DNA, 2049 bp, Solanum lycopersicum
atccgtataacttattctctctgttttcctccatccaaaaaaaaacagcaaaattcccaaaatctatatcaaattaatcttcaattcttgcaaatttcttcaagatttttcagttttcgaacacccaattgactaaaataatggaaaaagatctcagattttgaacatttttgaagaaaaaagaagcaaagaagctaagataaaaggggatatacttgaaaatggagtgtgttggagctcaaaatgttggagcaatggcagtttttacgcgtccgagattgaaaccgttggtcgggaggagagttatgccaagaaaaaagcaatctttttggcgtatgagcagtatgaaagtaaaatgtaatagcagtagtggtagtgacagttgtgtagttgataaagaagattttgctgatgaagaagattatataaaagccggtggttcgcaacttgtatttgttcaaatgcagcagaaaaaagatatggatcagcagtctaagctttctgatgagttacgacaaatatctgctggacaaaccgtactggatttagtggtaatcggctgtggtcctgctggtcttgctcttgccgcggagtcagctaaattggggttgaacgtggggctcgttgggcctgatcttcctttcacaaacaactatggtgtatgggaggacgagttcaaagatcttggtcttcaagcctgcattgaacatgtttggcgggataccattgtatatcttgatgatgatgaacctattcttattggccgtgcctatggaagagttagtcgccattttctgcacgaggagttactcaaaaggtgtgtggaggcaggtgttttgtatctaaactcgaaagtggataggattgttgaggccacaaatggccagagtcttgtagagtgcgagggtgatgttgtgattccctgcaggtttgtgactgttgcatcgggggcagcctcggggaaattcttgcagtatgagttgggaggtcctagagtttctgttcaaacagcttatggagtggaagttgaggttgataacaatccatttgacccgagcctgatggttttcatggattatagagattatgtcagacacgacgctcaatctttagaagctaaatatccaacatttctttatgccatgcccatgtctccaacacgagtctttttcgaggaaacttgtttggcttcaaaagatgcaatgccattcgatctgttaaagaaaaaactgatgctacgattgaacacccttggtgtaagaattaaagaaatttacgaggaggaatggtcttacataccggttggtggatctttgccaaatacagaacaaaaaacacttgcatttggtgctgctgctagcatggttcatccagccacaggttattcagtcgtcagatcactttctgaagctccaaaatgcgcctctgtacttgcaaatatattacgacaaaattatagcaagaacatgcttaccagttcaagtatcccgagtatatcaactcaagcttggaacactctttggccacaagaacgaaaacgacaaagatcgtttttcctatttggactggctctgatattgcagctggatattgaggggataaggtcatttttccgcgcattcttccgtgtgccaaaatggatgtggcagggatttcttggttcaagtctttcttcagcagacctcatgttatttgccttctacatgtttattattgcaccaaatgacatgagaaaaggcttgatcagacatcttttatctgatcctactggtgcaacattgataagaacttatcttacattttagagtaaactcctcctacaataattgttgaatcagaggcctcattacttcagattcataacagaaatcgcggtctctcgaggcattgtatataacattttcactaggttaatatgcttgaataagttgcatagtttcagtttttgtatctgcttctttttttgtcctagatcatgtattgatccaatctatatacattgccaatatacataaattttataatattgctagtttttttttttttttt

SEQ ID NO: 22 - DNA, 1323 bp, Arabidopsis thaliana
ctctccaaatttcttcttcttctccggcgaagaaatcgaaaagtcattaccctaagagtcccagagtcgtcagaaggaacagcttttgaaatggacggtgtcacctaccaaagattcccaacggtgaagatccgtgagcttaaagatgactacgccaagttcgagcttcgtgaaaccgacgtttcaatggccaacgctctccgtcgcgtaatgatctccgaagtccccaccatggcaatccatctcgtcaaaatcgaggttaattcctctgttctcaacgacgagttcattgctcaacgacttagtctcatccctctcactagcgagcgtgctatgagcatgcggttctgtcaagattgtgaagattgtaatggagatgaacattgcgagttctgctctgttgagtttccccttagtgctaagtgtgttactgaccaaaccctagatgttactagtagggatctctacagtgctgatcctactgttactcctgttgatttcactagtaactcatctacttctgattcaagcgagcacaagggaattatcattgcgaaactacgcaggggacaagagttgaagcttaaagcattagctaggaaaggaattgggaaagatcatgcgaaatggtctcctgcagctactgttacgtatatgtatgagcctgacattattatcaatgaagagatgatgaacactttgacagatgaggaaaaaattgacttgattgagagcagtcctaccaaagtgtttggcattgacccagtcaccggacaggttgtggtggttgatcctgaagcatacacttacgatgaagaagtgatcaagaaagctgaagcaatggggaaaccgggactcattgagatccatccgaaacatgatagttttgtattcactgttgagtccacaggtgcattgaaggcttctcagctggtactaaatgccattgatatcctgaagcagaagcttgatgcaatccgtctctcagataacactgtagaagccgatgatcagtttggtgaactcggtgcccatatgcgtgaaggatgaaatcgtagctctttttttacctgtttgatcagggtttaagtttcttctagaccagactaatatattaaccgtagcggcactgccttgtttgatagcaacatgtaaagtggcagtcttgtctttgttcccgacctctgactgatccttgtgttcctgaaccttgttatgttgggttatttttagtcgttgaactctctcgtaattggcgttttttttgttgtcattgttaagaatgggttagttaatataggaaaaaagattttaattgatatt

SEQ ID NO: 23 - DNA, 1335 bp, Arabidopsis thaliana
attctgatttcttctcctatctccttctccggcgaagaaattgaaaattcattatccctaaaaccctaataaaggtccagagagtcgtcagaaaccaccgattagcttttgaaatggacggtgccacataccaaagattcccaaagatcaagatccgtgagcttaaagatgattacgccaagttcgagcttcgtgaaaccgacgtttctatggccaacgctctccgtcgcgtaatgatctccgaagtccctaccgtcgcaatagatctagtcgaaatcgaggttaattcatctgtactcaacgacgagttcattgctcatcgattaggtctcattcctctcactagcgaacgtgctatgagcatgcgtttctctcgagattgtgatgcttgtgatggagatggacaatgcgagttttgctctgttgagtttcggcttagttctaagtgtgttactgatcaaaccctagatgttactagtagggatttgtacagtgctgatcctactgttactcctgtggatttcactattgactcgtctgtatctgattcaagcgagcacaagggaattatcattgtgaaactgcgtcggggacaagagttgaagcttagagcgatagcgaggaaagggattgggaaagatcatgcgaaatggtctcctgcagctactgttacgtttatgtatgagcctgacataattattaatgaagatatgatggatactttgtcagacgaggaaaagatcgacttgattgagagcagtcctaccaaagtgtttggcatggatccagtcaccagacaggttgtagtggttgatcctgaagcatacacttacgatgaagaagtgatcaagaaagctgaagcaatggggaaaccgggactcattgagatcagtccgaaagatgacagttttatattcactgttgagtccacaggtgcagtgaaggcttcccaactggtactaaatgccattgatcttctgaagcagaagcttgatgcagtccgtctctcagatgacaccgtagaagcggatgatcagtttggtgaactcggtgcccatatgcgtggaggatgaactcaagtgattaattcgagctctttgttatacctgtttgtttcaggttttgagtttcttctggagcagactgatattaaccgtagtggcactgtcttgtttgataacatgtgaagtggcagtcttctatttgttctggacctctgatccctctgttcctgaatcttgttaagtttggttgttgttagttgttagactcgctcgtaacgaaaataaacgcaaggattaaattcaatacattgaacaagtatgattaaaatgg

SEQ ID NO: 24 - DNA, 1592 bp, Helianthus annuus
gcgggaatcaggggaaaaataaaagatgttcatcactgtgcgtctatcttctctgtagaccgactttcaaaaccctagagagaaaacaaaaccctagagagagaaaatggacggagcatcataccagaggttcccaaaggtcaaaatccgcgagctaaaagacgactacgcgaaattcgagctccgagaaaccgacgcaagcatggcgaacgcactccggcgagtgatgatcgcagaggttccgacaatcgcgatcgatctggtcgaaatcgaggtgaactcatcggttctgaacgacgagttcattgcgcatcgtctcggcctcattcctctgacaagcgagcgtgcgatgagcatgcgcttctcacgtgactgcgatgcctgtgacggtgacggccagtgcgagttttgttctgtggagtttcatttgagagctaagtgtattaatgatcagacgcttgatgttacgagtaaggatctctatagctctgatcatactgttgtgcctgttgatttctctgatgctacttctggttttgagaatcctgaagatcaaaggggcatcaccattgtgaaacttcgcaaaggacaagaactgaggctaagagcaatagctagaaagggtatcggaaaagatcatgcaaaatggtcacctgctgcaactgtgactttcatgtacgagcctgagattcacatcaatgaagaaatgatggagacgttatcacttgaagagaaaacaagtgttattgagagcagcccgacgaaagtctttgccttaaatccccatactcagcaggtggaagtggtggatcccgaggcatacacatatgacgatgaagtgctgaagaaagtggaagctatggggaaaccagggcttattgaaatctatgcaaaagaagacagcttcatcttcacggttgaatcaactggtgcagtcaaggcttctcagttggtgattaatgccattgatgtcttgaaacagaagctggatgcggttcgcttgttggaagatactgtcgaagcagatgatcagtttggggaattaggtgctcatatgcgtggaggttgatcgtaactttgtgtttgcgatatctaacagtcagcttctttggtatggaaaactgggttttttctttatgttattgtaattagattgtagggtggcgttatctgactttttgctacattggaaaactaagaatatgatctttagataaggatatcaacctataatgatcatgccgcacaaatcacggctagttttgtttaaacgggcatgtcttgcttactcatgagagtaaagcgtaaacattgagggtaggcctggcaatcttgacttgaagaaccagttttgggctcattcggcttatgtattgcctagaccacctggatgatggtcatttgcaccattgttggttcagatgttaggtgggtgtcgtctgtactggatggttggtgtgtcatcaaattgctaatcattttggagtcgcttgagttttgtagcagcaatgcaagccataattaaatactttattattaagaaacctttaaattagttaaggactgaagttgttgtttttcttattcagcct

SEQ ID NO: 25 - DNA, 1312 bp, Solanum lycopersicum
cgtaaatcagaaggatcaatacataagttgagtacttgttacaaatttcacttttagcagagcagagagcaaaaccctcaatactcaaagcaagcaacaatggagggcgtttcgtaccagagattcccaaagataaaagtacgtgaagttaaagacgatttcatgaaattcgagctccgggacaccgacgccagtatagctaacgctctccggcgtataatgatagctgaagtacctactatagctatagacctagttgaaatcgaggtcaattcctctgttctcaacgatgagttcatttctcatcgtttagggcttgtgccgctaacaagtgaacgagcgatgagtatgcgtttctcacgtgactgtgatgcttgtgatggtgatggacaatgtgagtactgttcggttgagttttatctacgggtgaaatgtcttagtgaccagacgcttgatgttactagcaaggatttgttgagttctgaccatacggttgttcctgttgattactccgatgcttcctcgagttttgataatactcctaataagggaatcataattgtgaagctacgacgtggacaggagttaaggttaagagctatagcacggaaaggaattggcaaagatcacgcgaaatggtcacctgcagcaactgtgactttcatgtatgaaccagagatctacatcaatgaggacatgatggaatccttgactctcgaggagaaaacagaattagttgagagtagtcccacaaaagtctttggcattgaccccgagaacaaacaggttattgtcgttgatcctgaggcatatacttacgatgatgaggtgctcaagaaggctgaagccatgggaaaacctggagttgtagagatacatgccaaggaagatagttttattttcacagttgaaacaactggcgcagtcaaagcttcacaattggtgctcaatgcaatagaagtgcttaagcagaagttggatgcagtacgcctttcagatgacaccgttgaagcagacgatcagtttggagagctgggcgctcatatgcgtggaggttaaaaaccgcgataactgttcatgtttaatatatctcctgtaacaagacatccttaaactaacttacccattttccctttagcaacttacctcgactgatgatggaaacgtaggacactctttctgtttcgcttaagtacatgtttttgtccattgttttgtactgatactgcacttcctccgttggatttcatctcgcaattgatcatcaatcccccgtctatggattttgtttcgagctgagtctattaaaata

SEQ ID NO: 26 - DNA, 1118 bp, Brassica napus
tttgatacgtaaaggctctctcttttacatctcttggtgtgatccatgggcgcgaatatctcaggcgttacgccggagtttgaccggagcagtgaacccagattatccgatttgccggagaactgtgtggcgctgatcatgatgcggcttgacccgccggagatttgtcggctcgctcgtctcagcagggtcttccgtcgcgcgtcgtcagctgatttcgtgtgggagtcgaagctgcctccgagttaccgagctattgcgcggaaggtgttcgacgaaattactctgaggaagttgttgataaagaaggatctttacgcgaagctctgtaggcccaatctcttcgagggtggcacaaaggagctgtggattgataagaacactggtcgtctctgtgtatcggtttcttcaaaggcgttaaggattactggaattgatgatcggagatactggagtcatatcccaaccgatgaatccaggttccactcagttgcgtatgttcaacagatatggtggttcgaagtaggaggagagtttgagatccagtttccatccggaacatacagtctcttcttccgcatccagctcgggaaaacatcaaagagacttggacggagaatctgcaactccgaccacatccacggatgggacattaaacctgttaggttccagctcgcaacttcagacaaccaacaagctgtttcgctgcgttatctgaacaacaaccctggacactggagtcactatcacgtcggggatttcaaagtggtaaatccagatgtatcaacaggagtcaagttctcgatgactcagattgattgcactcacacgaaaggtggcctgtgcatagactctgttcttatagtacctaaagaaaatgcaagaaaggtcgttgaatcagaatagttaattttttgtagatatagagtgagattgttgtaaatggtgagaagaatctttttttttttattgatctggaacttgtacacatggtttggttgtctctggttttgtctgtagttacagtgattgtaagagacttaaggtattgaacttgaacattgaagaatcctctcagccatgtagaaacagagtcttgttcagaatattaagtatca

SEQ ID NO: 27 - DNA, 2211 bp, Arabidopsis thaliana
gacaaaaagtggtttcgttaacaaaaagtaaaattgacatgacttgcattgcggagaacaaaaatcagtctctcatcactcactcataatcatgaatttgatcttcatcatcttcatcgacccaaccgcttaaacctctctctctctctttctctctaatttctaatggtacttcttccttcgatgacgtcgcttcttctggtgttcctcttcctctacggcgtttctccggttatctccgacggctccgatcaccgttacaaggtcggtgatgatgttcctctttacgctaacaaagtcggaccgtttcataatcccagtgaaacatatcgatactttgatcttccgttctgttcatcagctcctgttaaggagaagaaggaggctctaggggaagttcttaatggagatcgattagtcagtgcaccttacaaacttgagtttttgggtgagaagaactctgaagttgcatgtagaaagaggttgagtagagaagacgttgctaagtttcgtgatgtgattgcgaaagattattactttcagatgtattatgatgacttgcccatttggggattccttggaaaagttgtcaaggagggaaagactgacccatctgagtataaatattatctcttcaatcatctgcagtttgagattttctataataaggaccgtgttatcgaaattatcgtgaggacagaccagaatttccttgtggacttgactgaggacaaggaagtccaagtggatttcacatacacagttcgatggaaggaaactgaaattccattcgagaagaggatggagaaatactcactggcttcatcaatgccacatcacttggaaatccactggttctccatcattaattcatgtgtcacagttcttctcttgactggtttccttgcgacgattctcatgcgagtcttgaagaatgattttgtcaagtatgcacatgatgaagaggcagttgatgaccaagaagagactgggtggaaattgatccatggtgatgtatttaggttccccaaacacaaatccctgctggctgcagcccttggttctggcacacaattgtttacactagctgttttcatcttcatgcttgcattagtcggtgtcttttatccctacaaccgtggagcattgtttactgcattagtggtcatatatgctcttacttcagggattgccggatatactgctgcttctttctattgccagctagaaggaactaactgggttaggaatgttatactgactggaagcctcttctgtggacctcttttgatcacgttctccttccttaatactgttgcgattgcttaccaagccactgcagcgttgccatttgggacaattgtggttattttccttatatgggctctggttacttcaccattgttaatattaggaggtattgctgggaagaacagaaaatccgagtttcaagctccttgtcgtaccacaaaatatccaagagagatcccaccaatgcgttggtaccggagaacacttccgcagatggctatggctggttttttaccgttcagtgccatttacatcgagctttactacatatttgccagtgtttggggtcacagaatatacaccatctatagtattctgtctatcgtcttccttattctcgttatagtcactgcttttatcacggttgcattaacgtacttccaacttgctgctgaagaccatgagtggtggtggagatcattgctatgcggtggatcaacgggcttattcatatatgcctactgcttgtattactactatgcacgatcagatatgtcagggttcatgcagacttccttcttctttggctacatggcttgcatctgctacggattcttcctcatgctcgggacaatcggattctgtgcttcccttctctttgttcgtcacatttaccgctcaatcaagtgcgagtaaaacttgaagattcttcactccctcaactactagcgatggtgatgaggcgatccggcgaggttgtctatttttgttttgttttgttacccttctatttttttcagatcttatatttttagttattctcttgtggtatgatgtccttgagaacgatagtgagacagtaggtacgaacacaagtttctcgtagatattttttcccacaaaatagtgaaagactaatacgatgtctactaattctactgatacaagcaaaaattattt

SEQ ID NO: 28 - DNA, 825 bp, Brassica juncea
gtacgcggggatcacagagagagagaggagctgattcctatggctgctgcttcactttctgcgaatcaaggtttactaggaacttccttctatggaggttgggggagttcaatctccggcgaggattaccacaccatgctcgccaagacaactgcgccacggcaaaactttgctaaactctcacggaaacccatcagagtacagccaatgatgaagaatgtcaacgaaggcaaaggcttgttcgctcctctagtcgttgtcaccaggaacatagtaggcaagaagaggttcaatcagcttagaggcaaagccattgctttacactctcaggtgattacagagttctgcaaatcgataggagctgatgcaaagcagagacaaggattgattaggcttgctaagaagaatggagagaggcttggcttcctcgcttgagatccctccctcttcttctcgtctctgtatacaatcatcttcttcttcttcttgtctcctgtctagatgtattttttccaaacctctttgaaaacataaactgccattctcattctcaaagttatctgcatcactctctgagatgatattactctttgaaacccacattaatcttatatgtataaaacaaaaaaattacacttttgttctcagaaaaataaaatgtcagagctgaatagtattcttggtaacacagatacaatcatgtaaaactctggaaactgtctttaagcctaatcataactttgaaacaattaacagatacaaaaagatgggtaagctttctttttgagataatatcaattctcgtcaaagaaagaatctccagga

SEQ ID NO: 29 - DNA, 3038 bp, Arabidopsis thaliana
tggaaacagtacagttgtgttttttaattggtctatctctctatctttctcatcgtctttgctccttttaaagactgtgtactatatttccatgagttgcagctgataaagctactctggttgactattcattactctgtttcgccataagaaagagaataaagaaacgttatggagaggccaagagcccctccatctcctttgaatgatgcggagtcattaagtgaacgtagatctcttgagattttcaacccttcgagtggaaaagagacacatggatcaacttcttcttcttcaaagcctcctcttgatggcaacaacaaaggtagtagtagtaagtggatggagtttcaagattccgctaagattacagaaagaaccgctgaatggggattgtcagctgttaagccggattcgggagacgatggcattagtttcaagctgtccagtgaagtggaacgaagcaagaacatgtctaggaggtcatccgaagaatctacatcttctgaatcaggggccttccctagagtatcccaggagctcaaaactgctctatccacgttgcagcagacttttgttgtctctgacgctacacagcctcactgtcccatagtctatgccagcagtggattctttaccatgactggttattcttccaaggaaattgttggaagaaactgccggtttctgcaagggccagacaccgacaagaatgaggttgccaaaatcagagattgtgtcaagaatggaaaaagttactgtggaaggctgttaaactacaaaaaggacggaactcccttctggaatcttctcacagtcactcctatcaaggacgaccagggcaataccatcaagttcattgggatgcaggttgaagttagcaaatacacagaaggggtaaatgataaagcattgaggcctaatggactctccaaatccttgattcgatatgatgctcgccagaaggagaaagctttggattccatcacagaggttgtgcaaactataagacatcgtaagtctcaagttcaggaatccgtgagcaatgacactatggtaaagcctgatagttctactacacctacacctggtagacaaacaagacagtcagatgaggcttcaaagtctttcaggacacctggacgtgtttctactccaacggggtcaaagctcaaaagctcgaataacaggcatgaagatcttttacgtatggaacccgaagaattgatgttgagcacagaagtaatagggcagagggacagttgggacctatcggatagagaaagggatatacgccaagggattgatctagctaccactcttgagcgcatagagaagaatttcgtcatcagtgatcctcgtctccctgataatcccattatctttgcatcagacagctttcttgaattgacagagtattcacgcgaggaaatattggggagaaattgtcggtttcttcaggggccagagacagatcaagcgactgtccagaagataagagacgcaattagagatcagagggagattactgtgcagttgataaactacactaaaagcggaaagaaattctggaacttattccacttgcaacctatgcgtgatcagaagggagagcttcaatacttcatcggtgtgcagcttgatggaagtgatcatgtagagcccctccaaaatcgtttgtctgagagaacagagatgcagagttcgaaattggtgaaagctacggcaacaaatgtagatgaagctgtcagagagcttccagatgctaatacgcggcccgaagacctgtgggctgcacactcgaagcctgtctatcctctgcctcacaataaggagagtacgtcctggaaagcaataaaaaagatccaagcgagtggagaaacagtgggactacatcatttcaaaccaataaaaccgttgggctctggtgatactggcagtgtccatttggttgagctgaagggcacgggtgaactatatgccatgaaagcaatggagaaaacaatgatgttgaatcgtaacaaggctcaccgagcgtgcatcgaaagggaaatcatttcccttctggatcatccattccttcctactctctacgcttcttttcagacctctacgcacgtctgtttgattacagacttctgcccaggtggagagttgtttgcactacttgacagacaacctatgaaaatattgacagaagactctgcaaggttctatgcagcagaggttgttatcggcttagaatatcttcactgcttaggaattgtatatcgagacctgaagcctgagaatatactgctcaagaaggatggacacatagtattggctgactttgatttatcattcatgacgacctgcacaccccagcttattattccagctgcacctagcaaacgaaggagatccaaaagtcaaccactacccacatttgttgcagaaccaagtacccagtcaaactcgttcgtaggaactgaagaatacattgcgcctgagataatcacgggtgctggtcatacaagtgctattgattggtgggcactgggtatcttgttgtatgagatgctttatggtcgcacacctttcaggggtaagaataggcaaaagacatttgccaacatcttgcacaaagatctcactttccccagcagtatccctgtgagtcttgtaggtagacagttgatcaacacgttgttaaatagagatccgagcagtcggttaggatccaaaggtggggcaaatgagataaagcagcatgctttctttcgcgggatcaattggcctctcatacgaggcatgagtcctccaccactggatgcaccgttgagcataatcgaaaaagatccgaatgccaaagatataaagtgggaagatgatggagtgcttgtgaattctacggacttggacattgacctcttctaatcctattcttcctctctctgcctttgattctcaaattatgcaaaactcttcttctcaataaaagccaaggtgttgttgtacttgtagttgcttaaatataaacggctcttttcatgttt

SEQ ID NO: 30 - DNA, 1061 bp, Gossypium hirsutum
atttcttctccattcctaaaaacctctccacaatgcttttgagaccagtttcatctttgtgtgtgcaagccaagcaaggggataatctaatttgttcccttaagggctcccctgtaacatcatcatcatcatctgctctgagttttcttcccagaaaacatggaagggctttgggtgtttatgcatccataggaaccaacaatcatgcacttacaggggtagtgttccagccttttgaagaggtgaaaaaggaggaacttgatatcccaatcgctcctcatctttcgctggctcgccagaaatatgctgatgcctgtgaagccgccatcaatgagcaaatcaatgtggaatacaacgtttcctatgtgtaccactcgttgtatgcttacttcgacagagacaacgttgcgctcaaaggctttgccaaattcttcaaggaatcaagtgaagaagaaagagagcatgcggagaagctgatggaatatcagaacaaacgaggaggaagagtaaaactacactctattctgatgcccccttcagagtttgatcatgctgagaagggagatgcactatacggtatggaattagcattgtccttggagaagctgacaaacgagaagcttttgtgcctgcacaatgtagcggtgcaaaacaatgatgctcagatggccgatttcatcgaaagcgaatatttagctgagcaggttgaagccattaagaagatatcagaatatgtttctcaattaaggcgggttggaaaaggacatggcgtgtggcacttcgatcaaatgctactccacgaaggggcgtgatgctgcccataatcaccatctaaatgctgcatctttctgttgttttagtgcttcacagatgttctatatatacatatatgatgagggacaggtagtggagaagaataaattgttgttgtaaaatatctatatctatatgccattgtagcagccccttaacatttgccatgtaagagacaataaacagcttggtttttgaaggcgttgagtaaatatggaataacaatgtgatttggaaccaaaaaagaa

SEQ ID NO: 31 - DNA, 2560 bp, Brassica napus
gaatggttcacaaaatttcttcctttctgtcatctaattatctcctgaatttcttctcataacctctcctttaaatctgatgatgcgtttgagcaacctctcatcactacactgagaaaccaaagtaaaagattcacaagagtgagctacacagagagagtaacgatggatgatcatgaaagccctcttttgtccaaggagtcatcatcgtcgtcatcatcatcatccgtggtggcttcctcgtttaaatggattctgaaagttttaatgtccgtgattttcgttgcatgggttgttttcctttttgtgtaccctgggaaactcggcgatggaattcttacaaattggagagctgtttcttcccacactctcttcggcaccacaggaagcatgttcttgattttcagtggtccgattcttgttatctccgtcttagcttctctctatctgatcatctccggagaagagaatgtgttcactaagaagaagatatcgaaattcccaaggttcaggctgtggacatttcctgttcttgtggatgggccatttggagttgtttctgcagctgagtttcttggaattatgatcttctctgtcttcttcctctgggctatctatgcatataccatgagggatcttgaccttcttgatctcttccatgtgcttcccgaggatagaagtatgcttctgttggagataaccggtctgcgtttcgggatgattggactgttgtgtatggtgtttttgtttcttccaatctcgagaggctccattctcctccgtcttgtcgatatccctttcgagcatgctacaaagtatcacgtttggcttggtcatatcaccatggctttcttctcctttcatggcctctgttatgttgttgcgtggaccgttcaaggtcgacttttagagcttttattcgagtggaaagctattggaatcgcagtgttacctggagttatcagtcttgtagcgggtttacttatgtgggttacatcgttacagtacgtgaggaagcattactttgagcttttcttctacacccatcaactctatattgtcttcgtcgtcttcttggcacttcacgtgggtgactacttattcagcatagttgctggaggaatattccttttcattctcgaccgtttcttgaggttctgccaatccagaaggactgtagatgtaatctctgcaaagagttttccctgcgggactttagagctcgtcctttcgaaaccaccgaatatgcgatacaatgcactgagttttgtcttcctccaagtaagggagctatcatggctacaatggcatcccttcagtgtttcatcaagccctctagatgggaagcatcatgttgccgttctcataaaggttcttggtggatggactgcaaagcttagggacaagttgtcaaagctatacgaggcagagaacccagatcagctcctttctcctctgtcatatcccaaaatcacaacttgcgtggagggcccttatggccatgaatctccataccacctggcgtacgagaatctggtcttagtagcaggaggaatcgggatttcgccatttttcgccatcttaagtgatatcctacaaagaaaaagagatgggaaagcttgtctaccaaagaaggttttagttatctgggcaatcaaaaactcagacgagctctctctcctctcatcgatcgacattccttccctttgcccttctttctctcagaaaataaaccttgagattaacatctatgtcacaagacaatccgagcctctcttggaagatggaatggttcacaagatggtgaatccttctgtgaagccaaggagcaacgggtgtcccatgtcggtattagttggtacaggggataatatatgggctggactctatctggtatcatccaccatcgggtttgttttaatgatcacattgttggacatcttttacataaacaaattcaacataacggcgtggtggtacaagggacttcttttcgtggtttgtatggttgcaagtgtgttgatttttggaggtcttgttgttgttttctggaatctttggggtgaaaaagccggtgatgtagaaccaaatggccacgacaaggtgactacgaatggaggagaactacataatccatctgcggaacttaaaggccttaacacagaagacgatattcagagtttcatcactactcgttatggcacgagacctgattttaaagagatatttgagtcattgaatgagaaatggggaagtgttgatgttggagttattgtatgcggaccggccagtcttcagtctaccgttgccaaagagatacgttcacatagcatctggcgatccacgaatcatccacttttccacttcaacagccacagcttcgacttgtaactttgctttcaaggctgaagagaattatgtaatcaatctgtggaatctaaaagaaaaagtatgcatatgtatgtaatagcagtctgtatgtattaaggatacagctatggggaatatgtgactttctattttcatgtataattatgcaaatatatgagcttcttatatt

SEQ ID NO: 32 - DNA, 2236 bp, Brassica napus
ttctatcctctctctctctcctcattttctatcaaagagagagtaagaaaactatggaattaacactgaattcctcgagttctctaatcaaacgtaaagatgccaaaagctcaagaacccaagaaaactcctcaaacatgtcctttgccaaaacgaagccaccaacttatcagttccaggcaaagagctctgtcaaggaaatgaagttcactcatgagaagacctacaagccagaaagtgaaaccactgagaggtgggagaagctccacgttctctcctacccacaccccaagaacgactccagcgttcctgttttcgtcatgttgccgctcgacacggtaacaatgtcagggcacttgaacaaaccaagagccatgaacgctagtttgatggctctaaaaggagccggtgtggaaggtgtaatggttgatgcttggtggggattggttgagaaagatggaccaatgaagtataactgggaaggctatgccgagcttatacagatggttcagaagcacggtctcaagctccaggttgttatgtctttccatcaatgcggaggaaacgttggagactcttgcagtattcctttgcccccatgggtgcttgaagagatcagcaagaaccctgatcttgtctacacagacaaatctgggagaaggaatcctgagtacatctccttgggatgtgactctgtgcctgtcctcagaggaaggacacctatccaggtctactcagatttcatgaggagtttccgtgaaagattcgataattacataggaggtgttattgcggaaattcaagtgggaatgggaccttgtggagaactgagatacccatcataccctgagagcaatgggacatggaggttcccaggaattggagagttccagtgctatgacaagtatatgaaatcgtcgcttcaagcatatgctgaatcaatagggaaaacaaactggggaacaagtggacctcatgacgccggaaagtacaagaacctcccagaagacactgagtttttcaggagagacggaacatggaacagcgagtacggaaagttcttcatggaatggtactccgggaagctactagagcacggagaccagctcctgtcttcagccaaagcaatctttcaaggctccggagctaagctatcaggaaaagtagcagggatccactggcactacaacacaaggtcacacgcagccgagctaaccgcaggttactacaacacaagaaaccacgacgggtatctcccaatagccaagatgttcaacaaacacggcgtcgtgctaaacttcacttgcatggagatgaaagacggcgaacagcccgagcacgcaaactgctctcctgaaggtctagtcaagcaagtgcagaacgcgacgaggcaggctggaaccgagctagcgggggagaacgcattggagagatacgactccagcgcgttcgggcaagtggtcgcgacaaacaggtctgattcggggaacgggttgaccgcgtttacgtacctaaggatgaacaagaggctgttcgagggtcagaactggcagcagctggtggagtttgtgaagaacatgaaggaaggtggacatgggaggagactctctgaggaagacacaacggggagtgacctttatgttggtggatttgtgggaagcaagatctctgagacggttgaggaagccgttctagtgtaaagttcccactccacataggtacatatagtgtgtgtggtatataattataataaacaatagagatgactgagagagagagcaaaccagagtagtagtgttaaaaaaaagctttagaatgttgcacaattctggatctgggcaaagagaagatgatgtacactttatatgactgtgtaatatgcttatgaacttttcatcttcaaactctcatctcaaataatatgcatttttgttttgttacaatcttatcaatatgcatttcttgtgtagacaatgaatactttgataacacatacaataattgctcagaacatgaaagaaactatcatcaaatcaacattctggaaaacgtaaatggagcaatcgaaatcaaaactaagagattctttcttctaatggaagtgtctggtggaattgtgagcagttaactcacgagttgggaggggaagaagaatcgggacctccgcgacggagttcttcgatcaaaccgcctagctcttttctcgccgattctctaccgaacatgaatccatacc

SEQ ID NO: 33 - DNA, 1100 bp, Sorghum bicolor
caccgcaccgccgtcgcctgtgtgcttcgcttcaacttcctcggcaagcagaagaggagggagggaggtcctgctcgctcgatccagacgcatccgccgaccgccgtcaccggagtcgccgacaggatgtttctcacgaggacggagtacgaccgcggggtgaacacgttctcgccggaggggcggctgttccaggtcgagtacgccatcgaggccatcaagttgggatccactgcgatcgggttgaagacaaaggatggtgttgttctcgccgtcgagaaacgtgtgacctctccactgctggaaccaagcagtgtggagaaaatcatggaaatcgatgagcacataggctgtgccatgagtggacttattgctgatgctagaacgctagtggagcatgctcgtgttgagactcagaatcataggttctcatatggggagccaatgaccgtagaatcttctacacaagctatctgtgacttggctctgcgctttggcgaaggtgatgaagagtcaatgtcacgaccatttggagtctctctcctaatcgctggacatgatgagaatggacctagcttgtactacactgacccatctggaaccttctggcaatgcaatgcaaaggctattggatcaggctctgaaggagctgatagctccttgcaggagcagtacaacaaggaactgaccctccaggaggcagagaccatagccctttctatcctgaagcaggttatggaagagaaggtgaccccaaacaatgtcgatatcgccaaggttgcccccaagtaccacctctacacccctgccgaggttgaagctgtcattgcgaggctgtaaaacacttcagatttctcgatttcccatcatcaatcacggtcgttgtatgaagcatggacatcttgatgctggcctgtcagcctagtgtgtgttgctatgtttgtcaccatgttctgtcaactccacaagggcagttcatgatagattaattggcagcccggtcagttcaatgatttaagtagcattgagaagtttgtactgccagaaagaatgtatacttctttttacgaatttaacttcaatttcttcttttcccagcc

SEQ ID NO: 34 - DNA, 1514 bp, Arabidopsis thaliana
gagaaaagggttttttaggattctttaaacgcagagctgagctgagttacataagatcgagagaattcgcaaactcgtttcttcattcgtcttcgtctttcgccatggctgctctacaatacttggaatctctgaaaaatacgcatccagagctcggcgaatggtacaattcccttgcagatctgtatcagaaaaagctctggcatcaactcacccttaagctcgaacagttcatcgctctcgctgtctttcaggctggtgatgctttgattcagttctatcacaatttcatcactgactttgagacgaagatcaatcttctgaagcttgcgcattttgctgtggtggtctctcgacagtactctgagaaagaagctgcagttagctatcttgaaagcgtgattgagaaacttagagctactaaagagcctaggattactgaaccaatcatttatattgaaacacaaaaagctttattcaagcttgagcaaggtgatcagaaggagtgcaaaaaaatcttggacgatggaaagagctctcttgatagtatgactgacattgatccatcagtctatgccaacttctattgggtgtcttctcagtaccataagtgccgtcaagaattttctgatttctacaaaagtgctctgctttatcttgcatacacgtctgtggaggacctttcagaatcgtttaagctggatttggctttcgatttgtcactatcagctctacttggggagaacatctataactttggggaactgttagcccatcccattttgaaaagtctccttggaacaaatgtggaatggctctaccacattctacaggcattcaaccatggtgatttagttcagtatcaagaactatgccgtgtgcacaacgcatccttgattgctcaaccagcacttgttgagaacgagaagaagcttttggaaaagatcaacattctctgccttatcgagatcatcttcagccgacccgctgaagatagaaccattcctttgagcatcatcgctgagcgtactaaactttccattgaagatgttgagcaccttctcatgaagagcctttctgtgcatttgatcgagggcatcatagaccaagtgaacggaacaatttatgtctcatgggcgcaaccgagagtactagggattccacagatcaaggctttgagggatcaattagacagttgggttgacaaagttcacaccactttactatctgttgaagccgagacaccagatcttgttgcagcataagagaaaagaaaaccttcttcctccttttgaagctactgaatgtaaaacaccatcttctctgggattagattcaagttttttatttcagtcgtagaagaaattacaattgctttttaatcttttgacttccatttcaagatgtccgaaatttcagttctacatttagactattttcatacattttttcttaaaacatgtccttgacaatcattcattattcacataaccataacaagtcaatcagtttat

SEQ ID NO: 35 - DNA, 1169 bp, Brassica napus
ttttttttttctcgtcttcgttcgtcagttagagcttcttcatcttcttcttcttcttctcgcttaacccttctttctctcattttgattacttttcttcgacaagggttttaacaatgaagcttgatactagtggattcgagacctccatgccaacgattggtttcggctcgagcaacgatatgcttgatgggttttcgactgttccctcgtttgatcttccccgcactacagattttgatgggtttcagaaagaagcagtacagatggtgaagccagcgaaaggaacaacaacactcgcttttatcttcaaagaaggtgtcatggtcgctgctgattctcgtgctagcatgggtggatatatctcctcacaatctgtgaagaagattattgagatcaatccttatatgcttggtacaatggctggaggagctgctgactgccaattctggcacaggaatcttggaattaagtgccgtctacatgaactggcaaacaagaggagaatctctgtttccggagcttcaaaacttctcgcaaacatgctctactcataccgtggaatgggactttccgtcggcaccatgattgctggatgggacgaaactggtcctggactatactatgtcgacaacgaaggaggaaggctcaagggagacaggttttcagttggttctggttcgccatacgcttacggtgtactagacagcggatacaagttcgatatgtcagttgaagaagcttccgagttggcaaggagatcaatctatcatgcgacattccgtgatggagccagtggtggtgttgctagcgtgtaccacgtgggtcctaatggatggacgaaactgtcaggagacgatgttggggagctacactatcactactaccccgtgccaccagccattgcggaacaggtcatggaggaagcagctgctgagtaaaactaagactttcttttacttcctaatcaattcactccctttctttagcttaagctctggtgttcactctattaagattctcctttttattttctgcaaacacatattctctttactttgttcaaacagctttttcaactcttcagtctttgtttcaaccgtgaaattaggaacataagttgaataattataaagaaaatgtttggttgaaaaatatcagttcgctga

SEQ ID NO: 36 - DNA, 1144 bp, Gossypium hirsutum
acgctcccttcgctcaacctgctcatcttcaccctccacgtttcatcccatccctctctcacgcttttactttgctttcctaatctcacctctctttcctttctgctgctgcttcagctgtcttttctatcaaaagcttgggtttctttttctttcttttttgtcgccatgttgctgaaagctgctccagctttttcttcgttaaatcctcaactggaaaatcagggtgccctgttttcccctttttcttcttcgattaatcatcagctatcttctctaagaaatggacctgggtctcttgtagtttgtgcagccaaaggagccaaccacaagccactaagtggtgttgttttccagccctttgtggaagtgaaaaaggaactcgatcttgtcccctccgtgcctcaactttctctggctcgccaaaagttcactgatgactgtgaagcttccatcaacgaacaaatcaatgtcgaatacaatgtttcctatgtgtatcatgctatgtttgcttacttcgatagggacaacgttgcactcaagggtcttgccaagttcttcaaggaatcgagtttagaagagagagaacatgctgagaaatttatggaataccagaacaaacgaggtggaaaagtgaagctgcagtccatagtgatgcccctctctgagtttgatcatgcagagaaaggagatgcattatacgcaatggagcttgccttgtccctggagaaactaacaagtgaaaagctctttaacctacgtaatgtagccgtgcggaaccatgatgtgcagttgacggatttcattgaaggcgaattcttagctgagcaggtggaggccatcaagaaaatatcagaatatgtagctcaattgagaagagttggaaaaggacacggggtgtggcacttcgatcaaatgcttcttcgtgagggagaggaagctattgcatgaagccccaacttgctgcttcgttccatgtcaaaagtttgtgcataaggtcttatttcagtagttctttgtttatatattttggctgtatgttgaaagatagtgccggatctttggtttgatgataaaagctcgtaagggatttatttttggtagtccttttaatcaaagtagttatagattcgtggatttccta

SEQ ID NO: 37 - DNA, 1769 bp, Arabidopsis thaliana
gagtatcgacgggaattatccgtaaacagagtgacagtgaggtgtgaaggaagaagacgatggcgtcaatgtctctctccttttcttcttcgctatgttcatccagaatccccgaaggtaagcgtaggtttcgtcacagagatgtgggcatcgttagatgcgttttggctgcttcgaaatcttctccgggaagtgttacgaagaagaggctttggaaagacggcgaattccccggaatcacggagccggttaatcagagaagaactccgataaagaatgtgaagaagaaacttgacaggagaagcaaagctaacggatgggttaacaccgtcactgaaactttgtccgatctcatcgccaaaaagcagtggttacaagctctcgaggtttttgatatgttgagggaacaaacattttatcaaccaaaggaaggaacttacatgaagctgcttgttcttctcggtaaatctggtcaacccaatcgtgcacagaagctgttcgacgaaatgcttgaagaaggacttgaaccaactgttgaactctacactgctcttctcgctgcttacactcgcagcaatctcatcgacgatgctttttcaattcttgataaaatgaaaagctttcctcaatgccaacctgatgttttcacgtacagcactctgctcaaggcttgtgtggatgcttctcagtttgacttggtggattcgttatacaaggaaatggacgagcgtttgataactccaaacactgtgacccagaacatagttttaagtgggtacggtagggtcggaaggtttgatcagatggagaaagttttgtctgatatgttggtgagtactgcttgcaaacccgatgtgtggactatgaatatcatccttagtgtgtttggaaacatgggtaagatagacatgatggagagctggtacgaaaagttcaggaactttgggattgagccagagactcggactttcaatattttgattggttcttatgggaagaagagaatgtatgataagatgtcgtctgtcatggaatacatgcgaaagctagagtttccgtggacaacatcaacctacaacaatatcatcgaggcgtttgcggatgttggtgatgcaaagaacatggagttgacatttgatcagatgcgtagcgaaggtatgaaagcagacacaaagaccttttgctgtctcataaacggatatgccaatgccggtcttttccacaaggtgataagtagtgttcagttggctgctaagtttgagatacccgagaatactgccttttacaacgcggtgatatcagcgtgtgctaaagcagatgatctgatagagatggaaagagtgtacataagaatgaaggagagacaatgcgtatgcgattcaagaacgtttgagatcatggtcgaggcgtatgaaaaagaaggtatgaatgataagatctattacttggaacaagagaggcaaaagcttatggatcgcactgttgctacaaaagagatggagaatcttccggcaggatgattgcggtttgtgtgtgaatctctctctctctctctctgcaaggagagatcgatgtctcacttgaaagagtagaataaaagagtttgtaatacacttgattgttcttgcagctatgcgtgttatatattttgatgggcccaaaattatgaatagaggcccatagataaactgtgacgtgcacaagaaatcggacaagtccaaaaagtggataagtgcgtgtcgtctttctataaataatctcttttctct

SEQ ID NO: 38 - DNA, 1815 bp, Cajanus cajan
gaagtaaaaatgtggtagaatatcatgttgtttggggggagagaatggtgaattggattgagcctcactcacactcttttcttctgtggctatggtttccatctctttctctttttcttcttccatagttcccactccatttcccctcgacaaatccaccaaaacccgcgcccaaaatcccatctttcgggtcacccgtttcgccatttcagctcctccttccaattccgttgtcaaaaagaggcactggaaacaaggagagtttcctggtacttccgaaacatcgttgccccacagtacgaggaggacccccattaagaacatcaagaagaaattggagaaaaagaatgaggcaaaggcatgggtcaacaccgtcaccgaatccttatctgaacgcatcgacaagaagcagtggcttcaagcccttcaggtatttgatatgcttagagaacaaaccttttaccaacccaaagaagggacttacatgaaacttattgtgttgcttggtaaatctggtcaacctcaccgtgctcatcagctttttaccacaatgattgaagagggtttagaccctactcccgcactgtacacggcgttgctctcggcgtattgtaggagcaacttgattgatgaggcatttttggttcttaatgagatgaagaagcttcctctttgccagcctgatgttttcacttacagcaccttgattaaagtttgtgtggatgctttcaagtttgatttggttgagttgctgtatgaagaaatggctgaaaggtcaatcatgccaaacacggttactcagaacattgttttgagtggttatggcaaggcggggaagtttgacctgatggagaaagtgctgtccagcatgctggagagcactacatgcaagcctgatgtttggacaatgaacacaatcatcagtgtctttggtaatatgggtcagattgatatgatggagaaatggtatgaaaagttccgtaattttggtatagaacctgagacacgcacttttaatattttgattggcgcctatgggaagaaaagaatgtatgacaaaatgtcatctgttatggagtatatgcgtaagctgcaatttccatggacaacctctacttataacaatgtgattgaggcatttgcagaagcaggtgatgcaaagcacatggagtgtacatttgatcagatgcgggctgagggtatgaaagcagataccaaaactttctgctgccttatcaatggttatgcaggtgcaggtctcttccataaagtaattagcagtgttcgcttggccggaaagtttgagatacccgagaatatagaattttataatgcagtcttatctgcgtgtgcaaaagcagaggatttgatggaaatggagagagttttcaagcgtatgaaagatagtcaatgtcagccagacgacacaacatactccatcatgatcgaggcatatagaaaagagggtatgaatgacaagatatactatttggagctggataagaagactatgatgactgatgataaacaagtgagccagtttgagaatgaaatctttagttgatttgtggtttatagttcaggctgttattacatctgtattctatacctccattttctgggagcagctgtttatagtgaaggcgtgaccagttgctgagttgcacaatgaagcttcaattttcatgatgaatgacagtaactcctacctaacttccttgttgtaaagttaaacttctacactttttggtgtacagagtttatgaactgatagtagagtttattagtttattgtcaatttttgggctcgtgtta

SEQ ID NO: 39 - DNA, 2154 bp, Sesamum indicum
aaaagttgcctatgtgtttttgcaaaaaagcgcaaaatctcattcgataggaaaataggtttaaatacccaattgtgtttctaaaaatattacgtactactcgttaccgttcctgttcgtaaaataacactaacactattacaaaatacaagttctgctgtagatagataataataatggacagagagggcattcccgactttttaaactgcttcatccacacagacacacactccgaacaccattcaaagtgtagtaaacaaattaagctgaacgcaaatggcggccgccttacaactctccctttcctcctctttcctcgcatcccctctcccctcctccaccctcagacccaccgccagtcgcccactccgcagactccttatctcctccgctaccgctccttcatcatcatcatcaacaacattgaatttgcccaagaaaaagcactggaaagtaggggaataccctggtgtctctgaagcctccatcacacatttctccagcaataacaagaatagaacccccattaagaatatcaagaaaaagctggacaagaagaataatgccaaagcatgggctaatacagtcaccgaagctctctctgacgccattgacaaaaagcaatggctccgtgcccttcaggtgtttgagatgctaaaggcgcaacctttttaccaaccaaaagaagggacatatatgaagctccttgttcttcttgggagatgtggacaacctgggcaagcctgtcagctctttgatgaaatgcttgaagaaggactggaaccaacagcggaactctacacagctttggttgctgcgtgttgcaggagcaatctgattgataaagcttttgccattcttgaacaaatgaagtctcttcctctttgccagcctgatgtctacacctacagtatactgattaaagcatgtgttgatgcttctcgttttgaactagttgactctctttatgatgaaatggccgaacgattaattaccccaaacactgtaactcaaaatatagtgttgagtggttatgggaaggcaggaaaatatgaggagatggagaaggttctttccaggatgcttgagagtacgacaagcaaacctgatgtatggactatgaataccattattagcttgtttggtaacgagggtcagattgaaatgatggaaaggtggtatgaaaaatttcggaattatggaatagagccagaaactcgcacttttaacattttgattggtgcttatgggaagaaaaggatgtatgataagatgtcatctgtgatggagtacatgcgtagactttcatttccctggacaacctcaacctacaacaatgtaattgaggcattttcggatgctggtgatgcgaaacacatggaatacacatttgatcagatgcgtgctgaaggcatgaaggcggacaccaagaccttctgctgtcttatcagaggttacgccaatgctggcctctttcataaagtgatcagcagtgttcagttggctggaagattggagataccagagaatacgtcgttctttaatgcagtcatatatgcttgctcaagggcagaagatataatggagatggaaagagttttcaagagaatgaaagataagctatgccaaccagattgtacgacttactctatgatgatggatgcatacaggaaggaaggtatgagtgacaaggtctatgatttggagcaagaaatgcagatgatgactggtaagacttgcaaagaataccatgatgttgaaacagacgctgctcctgacggcgagaaagtgctgttaatctgagtgttggtcgaattagtttgtgggacaaagcaataagtgtctttgagcagggtcaggatatgcatgtccaaagtggataaataaactaaagtcctgctcgaggtgttaatcctaatgattgaggtagcctcattggataattttgggataactggaagctaaattgtatgtttcccatctggtctgatgaagatgaagccttacacgggtctagaggaatatgtggtgctgtgagctaaagaagaattggcaacaacataaacctggcatttacaattgtaactggatgatattggaacctctaaaatgtcaattttgcttctttaagttaatatgattgatttccat

SEQ ID NO: 40 - DNA, 2107 bp, Cephalotaxus harringtonia
ttgactgaggacataaaccacacctttgaatttcactcatccactacgggaccaaaatctctgtacagcatcatatttccagaagaaattatccaacgccaggtcagagagtttcttccttgcattgaactaatgcgggtggtctaggatttgctggctttcagactggttgagatgaggttcatatcatagcaactagaagatttggctctgttccagtttaacccatcttcagggaagaaattgtctgtttcattaaaaccacattgtgaaagaaaggcacaaaggaagacggtgcatatgatatttgaatcctaggcataggttgcagggtggaatgataataatttttatcggtaaaaagcagaaagccaccgatgagtataggcgcattcatcggagtcggggcaggaaaacaggttctacgctcttcatttcttccaacagagtttgcagacaaatcgatttcatttcctgatcaaggagctttacggtttaccactagtgtttggaaacatgtagtgcttgcaaagaaaggttcaaattctagaacacaaagtagatctgtcaaacaaatacaaagaaagactttgaaggcatttagagaggatgtagatggattctcaatatcttctgccaatgaagcatcaagcacaagctctgctgttatagacaaaaattataggcttgagcctgaggtagaacgatcactggaggctctctttctgctccagaagtctatgctggagaaacaatggtatctttctcttgatccaaccaaattcagagaatctgactctttgaacagccacaaaagaacagaagttttccgttcagggaaagtatctgctaggcagcgtcggcagcatgcaagaacagggtcttcaactcacaattttgttgaagtggaactcactgatcaaacagcatataaaagcaatcaggagcatgtggctgtgcaagtgggatcagtaagggataccatgacagattcaatgaaaggcatgccaaatcaaaagttgcttacacatgaagaggttttatgcctgtcaaagaaaatacagaatggccttactttacggaaacacaaatcaagattgaaagccaagttaaaatatgaaccttctaatgcacagtgggctgcttctatgaatatgtctgtaactgaactaaacagaaatctgatggagtcttccattgctggacaaaaattgtcaatgtgcaatatacgtcttgttgtctcgatagcccgaaagtatgaaaacatgggcgttgatctgggagatttgattcaggagggcttaatggggctgagacatggcattgagaaattcgattcgtctagaggcttcaagctatcaacttacgtgtattggtggatacgtcagggtattataaaagcactgattgactatcgaaggacagtaaaaatacctaatcatgtgcatgagagactgagtttaattaggaaagcaaagttatccctaatggagagtggtgtggtcccttctcttaagactgttgcagcaaccataaacatgtcagagaaaaaggtgaaaaatgcaacacaggcaatcaagaggacacgttctcttgacaaagaatattctggatacgaaaatagttcaggtcgaacttttcatagtagtcttgcagatcgtaatgatgaaaatcattcatggtttactgcagaaagggacactttaaaagaggatgtggataaacttattaatgtgacattaaaagatagagagaaagtaataatcaggctatattttggcttagatgcacatagccgtacatgggaagatgttagtaagagtcttggattgtccagagagagggtgaggcaaattgggcgtatctcattggaaaagctgagacgagcaactagacgtcataagctggaaccactattttaatgcagacttgttgatgatgccaatcagcagcagcagcaactacagattttactttattgatattgttgttagtacttagcattgaatcacagcatagcttacatatttacatgcagattgttatttcttgtaatccagattgtagtaggagatatatatataaataaaatgtccataagttgcaa

SEQ ID NO: 41 - DNA, 2152 bp, Oryza sativa
aatggcctcccgccctctccgcctcctctaccctatcctctccctccacaccccactccgaccaccaccaccacctcgcccgcggtaacgccgccgccgtcgctcgccgcggtaaaaccagcgcgcgcgagagagtgggtgtccgtgtggcctactacttgcttcctcggcgcgcgcggcgcgtgtgtgcctcgcatcctccaccaccactagtgcagccaagtgcgtgcgtgtgtgtgtgtgcggacaccgttgctgccgccgccgccgccgccgcgcgcagggtggtgacaagatgacggcgacgccagcggtgatcgggctgagcgcggggaacaggctgctgagcgcgtcgttcgggccgaccgacctgatgccggacaaggtcagcctcggcgtcggcggaggcgggggaggaggaggaggtggtggaggtggggacgcgatgtcgttcgcgccgccggcgcccgcgacgccgaagctcaccgcggtcgccgcgcacaggctcaagctctccccgcatggccgcgcgcaggtcatgcgcgcgctcaggcaccactcctccgcggcggccgcgctcgcgcccccgcccccgcccccgcccccgccgacgccgtcgcccgcctcgcgcgccgcccacgcccatgacctcgagtcctccctcgaggccatcgtgctgctgcagaggtccatgctcgagaagcagtgggagctccccttcgacgacgacaaccacgccatggccatcggcttggccgaggatgacgacgacaccagcaaggccaccgtcgtcgtggcgcggtccagtgtctcggcgcggcagaggaggatgagcgggcggcggcgggggaggaccaagaacggcgcggcgcacttcgccgtcagccccgagctgatccagagcaggaacaggatctacctcaggggcaccgtcagcaaggagctcctcacgcacaagcaggtcgtccacctctcccacaagatcaaggatggcatctggctgcagcagcaaagatcaaagctgaaagagaagctgggaaatgagccctcatacaaacagctggcgcattcgctgaagatatcaccgcccgagctacgatcaaggatgcacgagtcgtttcttgcaagggagatgctaacaatgagcaacctccgtttggtcatttccattgcccagaagtatgataaccttggtgttgagttggctgacctcattcagggtggtctgatagggttactccgtgggatcgaaaaatttgatgcatccaggggctttagaatttccacttatgtatactggtggatacgccagggtgtttcaagagcattagctgaaaactcaaaaacattcaggcttccaacttatctgcacgagcggctgattgcgattcgtggtgcaaagtatgagttggaagatcaaggaattgctccaacaatagaaaacatagcagggtcactcaacatatcagaaaagaaagtactcaatgctacagaggctgtgaacaaggttctttcgttggatcaacaagcatttccatccttaaacggcttacctggagagacactgcacagttacatagaggatcaaaatgtcgcaaatgatccatggcatggatttgaggagtggtatctcaaggaagaagtcaacaagcttttaaactcaactctcaacgagcgtgagagggacattatccggttatatcatggcataggaaaacaatgccatacatgggaggatattagcagacaattcgggttgtcgagggagagggtgaggcaagtaggactcatcgcaatggagaagctgaagcatgctgcgaggaggaaaaatttggaggcattgcttgaggattattgagttgaggggctttttgtttgagtcagatccacaaacacagcggttgtatatactcagaaaacatagggtacatccttcaaaaggcgtactgccactcacatgaaagtaattatacgtgtacattttgtgacattagggagatgcatgatcaaaatctctatgcctgtgttatgaccaaggcaatcaggaaacagagagatgatgtttttccttcaaggtttacaattattctgtaatatatatgtaagtatgatttagcttgatcaatagagcaacacttaaaagttctgagcc

SEQ ID NO: 42 - DNA, 1837 bp, Flaveria ramosissima
attaaaaatatatatttctaacactttttatgattttttagaaattaaacgtctttaaaaaagcgagaaagcccatacatacagtcatactcaaactaccatcaccacgagttaaccacggtctccatatctctttcatagatctctttcgaattacagcagcaatcaagctacatctgttaaggagttattagtgatcttcaagaaacctgaagttcagcattttggtttatggttgctgtgaagcaacattctcaaagtatgtggtactatttctattaagttaactcgcgtgacatatatgatggctacaaatgcagttgttggactaagagcaggagaatggttattaggttcaacttgttattactctgaggtcagtgaaaagctgtcctgcagtagcaatcttgggttcatatttgttccaactacaagttcaatcacttctaagaagtcacccaactatagccatagtcttgtgaacaaacgagatattcaccctactagagccgtgaaggaacatgtagatactgctctgaattcttcaagtacagatcaatgggatgattgggttcagaggcttgactatctgaatgaagaagtctctgaacatgagcttccagttgatgctttactcttattacataaatctttattggaaaaacaatggacactatcaacagaggagacaacaactacagaaaagaacagcaaaaaggtagtcactggttcagggatatcagctcgtaggcgtcgattaaatgctcagaataaaacaccagcaaaaagttgttctgtaaatcaagatggcagaaacaagcagttgcgatccataatcagttcagagctccttcaaaattgtcaaaaagggtatcttaaaggtgtaaaaaacgaagcgttgctaactcattcggaggttgttgctttatcagaaaagatcaaaattggtctacaattagaggaagagaagtcaagtttgagggaaagattgggatccgaaccatcagagaaacaactagcagattttctaaagatttcacaagttgacttgcaaaccaaacagatggagtgcgctttggcaagagagaagctgactctgagcaacattcgtctggtgatgtctgttgcacaaaaatataaacacatgggagcagatatgtctgacctaattcagggtggtctaattggactgcttagagggatagagaaatacgattcatctagggggcacaagatttcgacatatgtctattggtggatacgacagggtgtcacgagaaccttctttgaaaactctaaaacccttagattgcctacacatttgcatgaaagattgagtgcaatccgaactgccaaggccaaactggaaagaaagggaataactccatcaattgatagaattgcagaaagcctgcgtatgtcaagaaagaaagttacaaatgccactgaggcagtctgtaaagtgttctcgctcgacaaggaagctttcccttctttaaatggtcttcctggagatacgcttcatagttacattgcagatgattgcccggacaacaacccatggcatggagtagatgaaggggctctcaaggaagaagttagaaatctcattaaaaagactctaggggaacgggagagagagatcatatatctttactatggtctggacaatgaataccttacttgggaggatatcagtagaaggaaggggttgtcaagggaacgagttaggcaggttggtcttgttgcacttgagaaactaaaatatgcggccaaaaatacaaagttagctgcaatgcttgtctatgattgatttttggtacactttttttttttt

SEQ ID NO: 43 - DNA, 2017 bp, Gossypium hirsutum
aactccgacaacctcatgttttgctaaatattctgatttccacattggaacattcgtctctttctttctttctttcttttttccttatatttcttcttgggtgtaacatttccttcctcttttagctaatgtctaccatttttttgagtgacagaataccttaaaggagtttatcatatcaaagaagtttagcttaattgcctactgaatatacagttgaagagttgtatgaaattgaaacagcttgttaaaattgtgtgatggtaattgtgccatccggagaagaagctgtatgatggcaacagctgctattatcggacttactgttggaaagcgattcttgagttcttcgttttcgtattccgatatcattgagaagcactcgtatgccggtgattatggcggagctccacattatcaaactgctcccactaaaagtttaatagttgcaaagaaatcatctaattgtagccaaagtgttccttcatatgatcggcgtagtcggtcgatcaaagctcttaaggagcatgtggatgctgcttcccttgtttcaactgccgaaccttggtttcagggatccaatgattttgaagaagaaagctatgaacttgactactctgtggaggctcttcttttgtttcagaagtctatgctcgaacagcaatggactctttcattcgaaaggacggtgttcactgaatcaccaagtagaaaaactaaaaagaaggtacctgttacttgttctggggtgtcagctcggcaacggagattcaatactaggatgcaacctaatgctaagcagctaagatcattgatcagtccggagctgcttcgaagtcgtttgaagggttatgtgcgaggtgttgtaagtgaagagttgctcagccatgcggaagttgttcgattgtcgaagaaaatcaaagccggactttccttggaggatcagagattgagactgaaggagaggctcgggtgtgacccgtccgatgaacagcttgcaacttccctgaagatttctcgtgccgagttgcgttcaatgttaattgaatgttcattggcaagagacaaattggcaatgagcaatgttcgtttggttatgtccatagctcaaagatacgataacatgggtgctgaaatgcctgatcttattcagggtggtttgatcggactattgcgcggcatcgaaaaattcgattcttcaaagggatataaaatttcaacttacgtttactggtggatacgtcagggtgtatcgagagcattagttgataactcgagaactttaaggttgcctactcatatgcatgaacgactgggattaatccgaaatgcaaaatatagactcgaagagaaaggaataacgccaactattgataggattgccgagagtctgaacatgtctcagaagaaagtccggaatgcaacgaaggcagacagtaaggtcttctcactcgaccgcgttgcgttcccctcattgaacggtcttcccggagagactcatcatagttacattgcagataaccatgaagaaaacaatccttggcatggagtagatgaaggggcactcaaggatgaagtgaacagactcatcggtataacactgggagaacgagaaagggagatcataaaactttatcatggtctcggtaaagaaagtcttacatgggaggacatcagtaaacggatcggtttgtcgagagagagagtccggcaaatcgggcttgtcgcgctggagaaactaaaaaacgcggcgaggaagaatggaatggaagctatgctattgaaacagtgattttcgaaattcagacataaacattggtaaaaacgattgtatatatatacagaaagcaaaattgtatcttcaatgtcaagactaaaagggcatggctgccatgaacttaaaactccctgtaaccagagttcaacaaactgactgtattacggatcgggaaaaaattttatgcatcgaatttttctgtaattatgatgataaacatgttgtttgaatgcaaaaaga

SEQ ID NO: 44 - DNA, 2124 bp, Physcomitrella patens
gctgctatggcggtctcatctctggtcttcattgcccctacgtcgtcgtcgtgtggttgctctgggatccaatacagggctttgaatcttgcgcacactgctcgggggcggggattagagtcgtcatcgtcgctgtattttttcggagggaagttgcagacgtggaaatttgttgaaaatgcagctaagtggaggaatgcggcggggtcgctgcgggtgcgctgtgacgcgggcgtggcgctggtggagcagcgagtagaggaggaacagaagcagcggttgagctccgattttaccacggttatgaagtttgggggttcgtctgtcgcctccgcacaccgaatgagagaagtggcgcaactgattttgagttttccggatgagaggcctgtcattgtgttatctgctatgggaaagacgacaaacaaccttctgaaggcaggagaaaaagccgtgtcatgtggtgtcgaggagtccggcaatattgaggagctccaagttatcagagacctgcataagacgacagcacgtgaactcaaagtggatgaatctttggtcacagagctttttgaagagttggaacagctggtaatggggattgctcttatgaaggagctgacgctgcgcaccaaggattacctggtttcctttggagagcgcctctcaacccggctattcacggcctatttgaatagcatcgggacatacgctcgacagtatgacgcttttgacctcggaatcattacaaccgatgagttcacgaatgctgaaatcctggaggtcacatacccgacagtaagagagaggcttcttaaagatcttaaagccgacgctgataggggtacacccatatgcgttgtgacaggcttccttggtaagggggttgagactggttgtgtaacaaccttaggacgaggagggagcgacttgacggccacagccctcggtaaagcgctaggtctccgggaaattcaggtgtggaaagacgttgatggtgtcctgacatgtgatccccgtgtatactccaatgcattaccagttccattcctgacctttgatgaggcatctgagctggcttatttcggagcccaggttttacatcctcagtcaatgagaccagcccgcgatgcaaacatacctgttcgtgtcaagaattcttataacccacaggcacctggtactctcataacaggggaacgcgacatgagtgaggcagagatgacaagcatagtgctgaaaaaggacgtgacaatgttggatattcaaagcacacgtatgcttggccaagttggatttcttgcaaaggtgttcactacgtttgaacatttaggcatttcagtagatgtggtggctaccagcgaagttagcatatcattgacgttggacccttcaaaactttgggagcgtgaactcattgaacaggcaagccaatgtttgtggttacagcaggaattggacaaaatgaagtcagaattgtcaaaaatcgccaacgtacaacttttaaagaagaagtctataatttctctcattagcaatgtgaagcagtcatcagctgttcttgaaaaagtctttagggtcttcaagaagaacgacatcaacgtacaaatgatctcacaaggtgcttccaaggtaaacatatcaatggtggtggatgatgatgatgctcccaagtgtgtgcaagagctgcacaaagtattttggcctgatgctgacgaggcgacggaaagaaatggtcatgtctaagaacaagacgttccgttagtttttaacatccctgacttgggaagtcgatacttttaagtcctcctcagagacatttttgtagatgttaatcaatccatggttacgcattgtttaagttctggctgtagagagggcttcctgtattcagttcaggcaggctctgattattagcaaaccattcaagtgctgatgtaatgctgcaaaggcgcactattctctttaaattgctgcagtcaatattgcagccgcagtgattattgtatgccacactggttcagtcaaccagtggattagtttattccatctaagtggttgcgtaaggtattacgccagttttcaagtggcgaacaggaagctgcacgcccttactctgatgaaagt

SEQ ID NO: 45 - DNA, 1864 bp, Brassica napus
gttttcagaacagagaactgttgaagaggtttcaacaaagtttccatctttggcgtctcactaaacattctcctcctcctccgatggcggcggctgctagggttcagtgtcataacaatacctctttcaccggatcaccactcccccgccgccaccacaactcgtcgacgctacacgcttctccaaatcgcgtcaatttcacaccgctgaaatggatcggagacggctcatcctcctgcacaaggacggtttcaggtcgacccctcaaaggcggcggcaccactactgcacgagctgcgtttgaagaggagaagaagacagacgcggtcaatgaggtagcagaagagaagaggagattcacgtgcgtgatgaagttcggaggatcgtcggtggcgacggcggagaggatgagggaagtggcggatttggttttgacgtttcctgaggagagtcccgtcattgttctttccgcgatggggaagactactaacaacctcttgcttgcgggagagaaggcggttagttgtggtgtttctaatgcttctgagatcgaggagttgagcgttatcaaggagttgcatctcaggacagtgaaggagctcgagatcgacccctctgttgtttcgtcatttttggaagaactggagcaactcctgaaaggtatagccatgatgaaggagctgacacttagaaccagagactacttggtctcttttggagagtgcttgtccacaaggattttcgcggcttatcttaacaaaattggagtcaaggcacgccaatatgatgcatttgaaattggtttcatcacaacggatgatttcactaacggagatatcttggaagcaacttatccagctgttgccaagagattatatgatgattggatgcatgatcctgctgttccagttgtaacaggtttccttggaaagggttggaaaacttgtgcggttactaccttggggaggggtggcagtgacttgacggcaaccacaattggtaaagcattgggtttgcaagagattcaggtgtggaaagatgttgatggtgttctaacatgtgaccctactatttataaacgagctacaccagtaccatatctaacgttcgacgaagcagccgagctagcttattttggtgcacaggtgttgcatccacagtcaatgagaccagcaagagaaggtgggattcctgttagggttaaaaattcttataaccctaaagctcctggaactatcatcaccaaaacaagagacatgaccaagacggttttaacgagcattgttctgaaacgcaatgtgaccatgctggatatagcaagcacccggatgcttggtcaagttggctttcttgccaaggtattttcgatatttgaggatcttgaaatatccgtagatgttgttgccactagtgaagtcagcatatctctgacactggacccgtcaaagctttggagcagggaactgattcaacaggagcttgatcatgtagttgaagaacttgagaaaattgcagttgtgaatctcgcaaaaggaagagcaatcatctctctaatcggaaatgttcaacactcctccctgattctagagagggcgtttcatgttctgtggaccaaaggcatcaatgtccagatgatatcacaaggagcatccaaggtaaacatttcccttatagtaaatgatgctgaagctgaaggatgcgttgaggctcttcacaaatccttcttcgagagcggtgacctctcagagttattgatacaacccagacttggcaacgggtcacctgtcagggcaatgcaagtagagaactgacttgactagctcattgcttgaatctgcagtttccatcaagaactgcttgttgt

SEQ ID NO: 46 - DNA, 2039 bp, Oryza sativa
tacagtgagctcccctctccctctctcactctaccaaactgcagaggagaggagaatggcgatcgctctccgattagcggccgcgccgctccgcctccgcctcgtctcgccggcccctccggcgatcggcggcgcgggagatggaggacgacgaggaggaggaggagcagctcgtatcggtgtcctgggcagggctcgctgccgccgccgccgcggcggaggcgggagactggaggtggcggcggcggccgccgatgactccgctcgctgtcgggccaagggagtgggcgccgccgccgccgcggcggaaaccctaggtgggatcggggtgggaggtggggaccagctgagcgtggtgatgaagttcggggggtcgtcggtgtcgtcggcggcgaggatgcgggaggtggcgggcctcatcctcgccttccccgaggagcgccccgtcgtcgtcctctccgccatggggaagaccaccaatctcctcctcctcgctggtgagaaggcagtgggatgcggcgtgatccgtgtttcggaaattgaagagtggaatttgatcaaagatctacacattaaaactgtggaggaacttgcactgccaagatctgtaatacacactatgctggatgaactggagcagctcttgaaaggtattgcaatgatgaaagagctgacacttcggaccactgactaccttgtttcatttggggagtgcatgtctacacggatttttgctgcttatttgaacaaaatcggagtaaaagcacggcagtacgacgcatttgatattggtttcataacaacagacgatttcggaaacgcggacatcttggaggcaacttatcctgctgttgcgaagagattacatggagactggattcgtgatccagcgatacctattgttactgggttccttgggaagggctggaaatcaggcgctgtaaccactttaggccgaggtggcagtgacttgactgctacaaccattggtaaagccctggggttgagagaaattcaggtatggaaagatgttgatggtgtactgacctgtgatccaaatatctacccgaatgcaaccactgtgccatacttaacatttgaagaggcagcagaacttgcttattttggtgcccaggtattacatccacaatctatgagacctgctagagaaggtgatataccagtcagggttaagaattcgtacaaccctaaagctccaggcaccctgatcactaaacaaagagagatggataaggttgtgctaactagcatagtgctcaagtcaaatgtcactatgttggatatagtaagcactcggatgcttggtcaatttggttttctggcaaaggtcttctctatattcgaagatctagggatatctgtagattgtgtggctactagtgaagttagtatttctgtgtcgcttgatccatcaaagatctggagcagggaacttattcaacaggaacttgaccatgtagttgaagagcttgagaaaattgcagttgtccatctacttcagcagagggcaataatatcactcattggaaacgtacggcgatcatctcttatactggaaaaggcctttcaagtgttgaggaaaagcggggtgaatgtccagatgatctcgcaaggtgcatccaaggttaacatgtctctgattgttcatgatagcgaggcaaagcagtgcataaaggccctccaccaggcgttcttcgaggacgatgtcctgacagaagtcgaggaagaagcccttcacatgagctgatcagcttagtccgtacaaccccagaaaaacaaatattgcaacctggagcaggttttctagcatcgcctccagttattttttcactcgtatgaccagcattcgatgcgttgtttcctcgctagttcaggtggtttagtttgacatttggtagctcgatctgttttttaccaggatgcaaaacgactggagcatgcgtcacaagttcctcgcttgaatgtgctttcactttggatctaaagtgccttaaaagtattaaaaaaacttgatctaa

SEQ ID NO: 47 - DNA, 1924 bp, Brassica napus
gggaagatacaaaaagatgaagcagagcaactctgtcttctagagtttcgtctacgcaggaacattggagtcttctcgtctcccaatcttttgatggcattgatacaacaacctgttcaaggttcttcttctctttgcgccaatgaaatcatacaaacgattcactgcttttctcggcgtgtagcctctgtttcagcgatgcacacaacgtgctcgacgaaaagccccaaagaacgtaaagataaaaagagctctgggttgatatcaacaaaacaccaagtagatcccaagagagaattatctcggattctgagaacagacgctgctgttaagagcatcgagaggaaagccaactccgaaaagtacaacactttatggccaaaagctgttctcgaagcacttgatgatgctgtcaaagagaatcgatggcagtctgctctcaagatattcagtcttcttaggaagcagcattggtacgaaccaagatgcaaaacctacacaaagctattcaaactccttggcaactgcaaacagcctgagcaagcgagcttactcttcgaactattgctgtccgaaggactaaaacccaccatcgacgtctacacgtctctcatatccgtctacggcaaatgctctcttctagagaaggcatttgcaacgctcgaatacatgaaatcggttagcgactgcaccccggacgtcttcactttcaccgttctcatcagctgctgctgcaaactcgcccggtttgatctagttaaccgcgtcctcctcgagatgtcgtaccttggagtcaggtgcagcacggtgacttacaacactatcctcgatgggtatggtaaagcaggaatgtttgaggagatggagaacgttttagctgatatgatcgaggatggagactctcttccagatgtttacacgtttaactcaatcattggctcttatggaaacggcggcaacattaggaagatggagagctggtataaccggttccagcttatgggagtggagccagacatcaccacgttcaacgtactgatcctgtcctttggtaaagctgggatgtataagaagatgagctcggtgatggattacatggagaaaagattcttctcgccgacggttgtcacttacaacatagtgatcgagacgtttgggaaagcggggaggatcgagaagatggaggaggtgttcaggaagatgaagtatcgaggagtgaagcctaactcaatcacttactgttcgcttgttgacgcgtatagcaaagctggtcttgtgggtaagatagattcggttttgaggcaggttgtgaattcggatgtggtgctggatacggtgttcttcaattgtataatcaatgcgtatggtgaggctggtgatctggccacgatgaaggagttgtacatacagatggaagagaggaaatgtaagcctgataagattacttttgcgactatggtcaagacttatgctgctcatgggatatttgatgcggttcgtgaacttgagaaacagatgatttccacttgcgagagttcaggcaagaagaggctcatggggtgatgtggtgatttggaagctgttcacagtaagaggatcactcacaagcctgtaacttaagttctggaatcggcatggttatcaagattactagaccatcatggccatcacttaatagaatatcagcattgtggataattcttggtctttgttagtaaataagggacaacctttgttctgttgtgtaaagggtctgattgagtcactagttagattgtgtgttacgtcttattattatttttaaaatgtgtgtttgaatgtattatctgcttaacctcaagttggaatcaaggtctgttcatatccatcgggcccaggcttagacagttatatcttacattgtctgagatgccaggcaccaggg

SEQ ID NO: 48 - DNA, 2995 bp, Phaseolus vulgaris
acccttcatttcatttgctaaattgagatattctcatttcttctcttttgtttcttttcctcacttgtctcattccattttctctgttcattcctctgggtgttgccatttcacattcaagtgaagtcttgtccctgaagatggcacatcatcctttgacccactctcactctttccgggagaggattgatgaaactctctctggtaacaggaatgaaattttggcccttctgtcaaggcttgaaggcaagggcaagggaatcctgcaacaccaccagatcattgcagagcttgaagaaatccctgaggagcacaggaagaagctacaagatggggcctttggagaagttttgagatctacacaggaagccatagtgctgccaccttttgttgctctggctgttcgaccaaggcctggtgtttgggagtatctgcgtgtgaatgcgcacgtgcttgctgttgatgagctacgtcctgctgagtatctgcgtttcaaggaggagcttgttgagggaagttctaatggcaactttgtgcttgagttggacttcgaaccatttaatgcgtctttccctcgtccaactctgaacaagtccattgggaatggcgtggagttcctcaaccgccatctttcagccaaactcttccatgacaaggagagcatgcagccactgcttgaattcctcaggcttcacagttataagggcacgactatgatgctgaatgacaaagttcagaacctgaattctctccaacatgttttgagaaaagcagaagagtatctaacttctgttgctcctgcaacgccctactcagaatttgaaaacagattccgggagattggtttggagagggggtggggtgacaccgccgagcgtgtcctcgagatgatccagcttctcttggatcttctggaggcacctgaccctttcacccttgagacattccttggaagagtccctatggtcttcaatgttgttatcctttctccccatggttactttgcccaagataatgtcttgggataccctgacactggtggacaggttgtttacatcttggatcaagttcgtgccttggagaatgagatgctcaaccgcatcaagaaacaaggcttggatatcactcctcgtattctcattatcactcgtcttctccctgatgcagtaggaactacctgtggcctacgtctagagagggtatatgatactgaatattgtgacattctccgaattcctttcagaacagaggagggaattgttcgcaaatggatctcaagattcgaagtctggccatacctagagacttatgctgaggatgttgctgttgaacttggtaaggagttgcaagccaagccagatcttattgttggaaactacagtgatggaaacattgttgcctctttgttagcacataaattaggagtaactcagtgtaccattgctcatgctctagaaaagaccaaataccctgagtctgacatttactggaaaaagtttgaagagaaatatcacttttcatgccaatttactgctgatctttttgcaatgaaccacacagactttatcatcactagcaccttccaagagattgctgggagcaaggatactgttggacagtacgagagtcacactgccttcacccttcctggtctttaccgagttgttcatggtattgatgtctttgatccaaagttcaacattgtctctccaggagctgatatgggcatatacttcccatacaccgaaactgagcgtaggttaacaaatttccacgctgagattgaagagcttctttacagctcagtggagaatgaggaacacatatgtgtcttgaaggaccgcaacaagccaatcatcttcaccatggcaagacttgaccgtgtgaagaacatcacaggacttgttgaatggtacggcaagaacgctcgcctccgcgagttggtgaaccttgttgttgttgctggagacaggaggaaggagtccaaggacttggaagagaaggctgagatgaagaagatgtatggcctgattgagacctacaagttgaatggccaattcagatggatctcctctcagatgaacagagttagaaatggagagctctaccgtgtgatttgtgacacaaagggtgcctttgtgcagcctgcagtttatgaagcttttgggttgactgtggttgaagccatgacttgtggattgccaacatttgccacattcaatggtggtcctgctgagatcattgtggatggaaaatctggataccacattgacccctaccatggcgaccgtgctgctgagatccttgttgacttctttgagaagagcaaagcagatccatctcactgggacaaaatctcccagggtggactcaagcgtattcaggagaagtacacatggcagatctactctgacagactcctgacactcacgggtgtctatggcttctggaagcatgtgaccaaccttgaacgccgtgagagcaaacgttacctggagatgttctatgctctcaagtaccgcaaattggctgagtctgttccccttgccattgaagagtaaagccattgttgaagagaaaatcgaagaagaaaccggcttttggtctcatgcagctttcacaaataaggccattgattttgattgtgatcaacttttggatttaaagagtctaaaaagagtgtctttgtttttatgtcttgcttaggttttggctcagaaaaaaagataaaagaaaagatgtcatttttattctttattgtctttgcaatatcgaatatgattgaaatatttgaattttgggtgttcaaccccatcaatcaacttaaagatgtcccttctgcaattcaatttcactgcttattgatctacagttcccccctcaacatcacttcatcattttcttgttctggttttttgaagagtctcaccattcttgaactttaacatgtaagatgtttgaatggaaactaaataaaaaattaatgtacttgttc

SEQ ID NO: 49 - DNA, 2284 bp, Zea mays
ccttcccctgcttcgtcctcgtttctcctcgaacccacccagcagcgccttcttccttcttcccgcccaacctcggccatgcccgtagcggcgctccgtcctcccccggtcgctgtcggcgcgggacgccgcagcgcccgactccaggcgcggttcgccctccgcgcgagctccctcgaggcgtcggcggcagtgacggtgacagtgaacgggtctgcagaggccgcggtggagaggaaggagaaggtgcaggaggataaggacaacgagggactgccggtgaaggaggagcaggagagggggctggaggtcctctacgacgacggcttcggctccgtgaccgtcaaggactacttcgcggcggccaaggtcctgtgccgggacgacggtgggccgccgcgctggttctctcccgtcgagtgcggccacccggccgtggaccaagcgccgctgctgctcttcttgccaggaatggatggcgtcggcacgggactcatcctgcaccacaagtctttgggcaaagtgttcgaggttcggtgcttgcatataccagtcaatgatcgtacaccatttgaaggactagtacaaatcgttgaaaatttgatcaagcacgagcatgatttatccccggacagaccgatatatcttgtcggagattcatttggcggatccctggcactggcagtggcagctcgtaatccgcagattgatttggttctcatactagtaaacccagctacatcatttgcaaagactccattgcagccagtattgcctctactggaatcagtgccaagcgagtttcatgctacagtgccgtatcttctcagttttgtcatgggtgacccactgaagatggctgcagttagcattgaaaacaacctatctcctccagaaactctgcagaaattgtcagacagtctcacatcaatgcttcctttgctttcagaactgtctgatattataccaagggatactcttctatggaagctcaaacttctcaaggcaggagcagcctatgcaaattctcgtctccatgccgtgcaagccgaggttctacttcttgccagtggtaaggacaatcttctaccaagcggagaagaagcggatcgactcttcaaggcactgaaaaactgcagagttcgatacttcaaggacaatggccatacactactgctggaggatggcgtcaacctgttaactgtcataaaaggagcgaacatgtatcggcgtggaaggcaaagggattctgtaaccgattatctcccgcctactctaagtgaattcaggcaaacatttgatgtggatcacaggctgttccaccttgcactgagcccagtcatgatgtccaccctgaaggatgggaaaatcgtccgcgggcttgccggtgtccctgacaaaggcccagtcttgttcgtgggctaccacgcgctcatgggcattgagctgagtcctctgtacgaggagttcctgagggagaagaggacagtcgtccgcggcatggcgcacccgttcctgtttgggaaaaagttcgagtcgtcgcgccaggagacgtcccgtttcgacactgtttctatgtacggtggactgccggtgaccccgatcaatatgtacaggttgttccagaggaaccaatttgttctgctctaccccggcggcgttcgggaagctctgcacaggaagggtgaagagtataagttgttctggccagatcagccagaattcgtaaggatggcggcgcgctttggtgtaactatcataccctttgggtgtgttggagaagacgacgttctcgagttggttctggactacaacgatcagaagaacattcccgggctccgggaatggatacagtcgatcaacaaagaagccgagagagtgagggacagcgtaaaaggagaggatgggaaccaggacatgtacctgccagctcttctcccaaaagtgcctggccgattctactacctgttcgggcagccgattgagatgaaagggatgggcaaccttgtcagagataggaagagcgcgaacgaggtgtatctacgcatcaaatcgcaggtggaggagatcatgtcgtatctcaagaggaagagggaggaagacccttacaggagcctaccgcagcgtgcactgtaccaggcaacatggggcgcctccgctcaggtccccacttttgagccatgaagattgggagtagggaagggcgtctgcgagcggactgcaattctttgacaagatgcaatgcgttctcatttctgaggagatctccctccctcatacgctg

SEQ ID NO: 50 - DNA, 1205 bp, Zea mays
gcgaagaaagaagtatgaataaaacaaaatttgaagacgcctaacagcccgactgcttcgtttccacgcgcacgaaaccctagactagataaaaagttcccatttccctcaattccccaacttccctcgccgcaatctctcgccgcctccagtccagagccaccgtgagatctgcccgattccgccgcccggacccggggactccctcccctcctcgatccgttcgggcggccggccggcctagcttcaagtgcggggatggtgttctacttcaaggcgcggcccgaggccggcgactacaccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagcttgtcaaagctaattccattcaaggtaataaagtcaataacattgatgtagtttatactccatggtacaatttgaagaagaccccttcaatggatgtaggccaagttggttttcacaaccctaaattggttcgcactattaaagtggaaaagaggatcaatgagattgtgaaccgcttgaataagacaaaggtggaacggaaacctgatttaaaggctgaaagagaggctattagtgctgctgaaaaggcagaaagaaaggcacagcttagagacaagaaacgtagggaagagatggagaggcttgagaaagagaagcaggctgatatcaggagctacaagggtctaatggtccaagagaagatgacttccaacaagcaaatcgcttctggcagcaagaccctgcaggaacttgaagaagactttatgtgagaggcggacattataaatgccatgctgaagatttccttgaactgcttctgtcgaagacagaaggggtaccacaggcttgtgagatactggatgactcatgggcaggccatggtctgttattatctcctcttgctgttgtggtctatgtaaaccttgtttacttgctgaaaaaacaacggtgcatgctctaactgtggttgatgtaatggtctgttgcccatcaagttgaaatggtaatggaattatggtttcctggatttttttcaaacaataaagacatggcagcagataacttacat

SEQ ID NO: 51 - DNA, 821 bp, Zea mays
aaagtcgtggatctagaatggtctatgcagttgcgacggaacggatggaggaaaaaatgaaccacgatttctcttcagttctttccttgcgtgcacggctgctcgtcaattcggctgccgaaattatcccgttgccttctggttcccacgacaaaagcggcattaccccggtcgctttataaattggactttcttactttcggcacggccaccggacagctccccacaaaaccgtcagttctcttttcccctgtaaatcgcaaattcgtcttccctgcccatctatcgcttggacacctctgcaagggagcacatggctctcgagaaggccaaggagatcatcgcgtcctccccggtcgacctagctctccgaaaggccaaggagaccgtcgcctcccaccccgtcgtcgtcttcagcaaaacttactgtcctttctgcacccgagtgaaacaattgctagcaaagttgggggcaagttacaaggctattgagttggatgtggaaagtgatggcgctgagctgcagtcagctctcgctgaatggactggccagagaactgttcccaatgtcttcgtgaaaggggagcggattggtggctgtgacgcaaccatggcgatgcacgacggtgggaagctggtgcctctgctcaccgaggctggagcaattgtcactgccagggctactgcaactactaccactccgtctttgtagacatgttttacagcgctgttccgctcgcttcgtggctatatgcaagtgttgtacggagtactaaactcatacgtggtaaaagatgaataaagacttaaacatttctttc

SEQ ID NO: 52 - DNA, 1604 bp, Zea mays
cactttgtcagtttgccgtcgctgtcggcgccgccgcctgtcctaatctcctctgagtccagcggccacctcctccaccgggagctccccgtaccataaccgcagtccgcagccattggaatttccgcttcatgcgtggatcctcgtagaccccgacccgcgtgcactcaatccctaggcggcggcctccggcgcgaggctagcgggcggcacccatggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaaggtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggtgaattcccatcagggcatacagctgatgttcaaagtgtgtccatcaactcatcaaatacaaatatgtttgtctctggctcatgtgatacaactgtgaggctgtgggatatcagaattgcaagtcgagctgttcgaacctaccatggacatgaggatgatgttaacagtgtgaagtttttccctgatggccataggtttggtactggctcagatgatggcacatgtagattatttgatatgagaacagggcatcaacttcaggtgtacagtagggagcctgatagaaatagtaatgaactacctactgttacatctattgcattttcaatatcaggaaggctactttttgctggttactccaatggtgactgttatgtgtgggacacacttctcgccgaggtggtacttaatttgggaaacctgcaaaactcccatgatggccgtataagttgcctcgggatgtcatctgatgggagtgcattgtgtacaggaagctgggacaaaaatttgaagatttgggccttcagtggacaccggaagatagtttgaaggccaacttttctcccccatgttgtatgttccttgttgccccttaacaacggacagtggtgattggtgaccaactcgacttgttcctgggaatccctttgttgttttgtaagctctgttcgcgctatgtttaatggaaaaatgtgcaatttgtcagtgtcacggcgctacatcttgttgagttggtaactgtttatactgttattacgagaatatcagtaacgtgtgatctgcccttttctttgt

SEQ ID NO: 53 - DNA, 1680 bp, Oryza sativa
caggaactaaacacacccctgctagcatgagtttccaaaatataaatatcaggagaatcctatttccaacaaagatattacgtacactctaggagggttggacgagccctcctattttcggaaaaagatacagtagtacacagtaccgtggataggtgggacgaatcgcttccacaaaactacaaaagtgccccgtctcaacgagaaacccgcgcgcgccccgacaaaaattcgcggtggcctaccagcgatttcgcttcactgcagtccgtctaccgaatggccgcggcggcgcggcccgtcgacgtcgtccgccacttcccgtgctcctcctcggtcgccgcctcctcctccttgctgctgtcgcgctccaagtccaggctcgcgtctcctgcggcggcggcggcgagctccatgcggcgaaggcttgtgctcggcgtgggcgccgccgccgccccggccgtggcggcgctcgcggcctcggcgacgcccgcggcgctgcgggactgcgccgccacgctgctcatcaccgcgggcgcgtactccctggtgcgcgccttcgacgggctcacggcgcggcggctcatcgaacagaacctgagcagaaaaattgtgcatgtgctctccggagtcctgttcatgtcttcctggccactattcagtaattcgacagaagcacggttcttcgcggcaattgtcccgttgctgaactgcataaggcttctgacctacgggctccgcctttccactgatgaagctctagtaaaatcggtgacccgtgaaggaaaaccagaggaattgctgagaggtcctctgtactatgtcattgtgctgctggtcagtgttttggtcttctggcgccagtctcctattgggattgtttcgttgtcgatgatgagtggtggtgatggctttgctgacattgttgggagaaggtatggctccgcgaagctgccattcaatgagaacaagagctggataggaagcatctcaatgttcatttctggcttccttctatctgcactgatgctgttctacttctcttgccttggttacttcactgtctgctgggatctggcacttggtaaactggctcttgttgcattagcagctactgtagtggagtgtattcctgtcaatgatgttgtggatgacaatatctccgttcctttggccaccatgttggcagcctatctgttatttggctacagttcatgttgttgagactataaaatttctcccttttgcttttcatgtcctgaatttggtactgccaaacatcatagattggatctctttctgttgaatcaaaaggtattttgctcatgatcatgcatgcattttgggtgaacgctagccaaatcatttagaagcaacaaatataagggactacgtactgtctcaagcttctctctgagtaatatggaaaattgtctgccgaatgggcagattcatatatgaattctcatggcagtgaaccaacaaacctcacacatggagcaatgcggggaatcactccagacgaaatacaattgacaacaagagcataaacctactgttgaaatttctctcatatttgcactacaaacaatccataaattggcagggaatgctaactaactcctcccatgggggattgattgctaatactaacaatcatgtctcgcgagtcatgtacaa

SEQ ID NO: 54 - DNA, 1089 bp, Oryza sativa
gccgccgcctcctcctcccaaaccccacaagcgaatcctagggtttctcgcctcgccgccgcatcgccgccgggaagtctccgccgccgccgcgatgttggagctgaggcttgtgcaggggagcctgctgaagaaggtgctggaggcgatccgggagctggtgacggacgccaacttcgactgctcggggacggggttctcgctgcaggccatggattccagccacgtcgccctcgtcgcgctgctcctccgctccgaggggttcgagcactaccgctgcgaccgcaacctctccatggggatgaacctcaacaacatggccaagatgctccgctgcgcgggcaacgacgacatcatcaccatcaaggccgacgatggctccgacaccgtcaccttcatgttcgagtcgcccaaccaagataagattgcggatttcgagatgaagctgatggacatcgacagcgagcacctcggcatccctgactccgagtaccaggccatcgtccgcatgccgtcctctgagttttccaggatctgcaaggatctgagcagcatcggagacactgttatcatctcggtgaccaaggagggtgttaagttctcgaccgctggagatattggaactgccaacattgtctgcaggcagaacaagactgttgacaagccagaagatgctacaatcatagagatgcaggaaccggtgtcactaacctttgccctgaggtacatgaactccttcaccaaggcaagcccgctctctgaacaagttacaatcagcctttcatctgagctgccagtggtggttgagtataagattgcagagatgggctacattagattttatctggcgccaaagattgaagaagatgaggaaatgaagtcgtgattgtcgcataaggatatgacaaaataccccctagtcttcagaccatcatcctttgcttaacaattgtttgtaagcaaaatgatgttatgcttatcatcgcttacgacggaatgctttttacctttgtatctgtgacttctgtaaatccttggatttacagtgatgaatgttaggtttagtagatttgtgagtttatgactgca

SEQ ID NO: 55 - DNA, 1366 bp, Glycine max
aatgaagaaatattaggtggaagagaaggaagcgaacgaaatggtgggcattgtcactgccactttgatttgattcgtgtgcacatataaggtggggcatggcctacaccctttccaacactctcccactctcactcgccttcttcccagaccgcaccctccttcatccaccctccacacacctcttcctctctcgccccctcagattcaaaagtctttgcgtcgtcaatctcaagagacctgttcccccgctaaaagcatcgatggcggagaccaacaacaacgttgccgtcgaggtcttcgaaaaagaggatcttgccgtgtccctggccaaatacgtcgccgatctctccaacaaattcacttccgaaagaggggctttcactgtctgcttgtctggcggctctttgatcaattatctccggaaacttctggaacctccttatgttgatacccttgaatggtccaaatggcacgtgttttgggtggatgagagagtcgtgcctaagactcacgaagatagcaactacaagcttgctttagatggacttctctccaaggtgccaattcccccgggcaatgtttatgcaatcaatgatgcgctttcagccgagggagcggcagatgattatgagacgtgtctcagacacttggtcaagaacaatgtgatagcttcatcaccagccaatgaatttccaaaatttgatctcatgctgctgggcatgggccctgatggccacatagcttctctgttcccaggccatcctcttgtggaggagaaacaaagatgggttaccttcattaaggactccccaaaaccaccaccagagagaataactttcaccttaccagtgattaatacttctgcttacgcagcgcttgtggtgactggcaagggtaaagcagatgcagttcactctgtgttaggccaatctcaaaattctgttaagcttcctgttggattggtttcacctgaaggggagttgaaatggttcttagacaaaggtgcagcctcaaagctgtagatctagcagctaagccatgatcctatatgttgtgcctgtgtatttaactgttaacctttttgcaataattaagtgtgtatgagaagtagagacatctagtcctgaatcttcttatctcagtgatagttttgcgctgaagagggtcctttgtcatttgtgacaataaagggaatatgaaggtagtgttttgcttcaacatttctaatttcttccccccagatttccaattaatgtgcaccaaccccacccttttcaacggacgtgttcattctatttaaatgtcattgttccgtcattgtcattgaaatgaatcaaataatcacttcatgttaattgccttt

SEQ ID NO: 56 - DNA, 798 bp, Glycine max
gggtgttgagtgggacatttgtgtatttgagcttaggaatagaagtagagggaactagtgaagagataaagaagacggaggcggtttggagtatgacttcttgcacctcttttgcatcctttctcatttcttcttcttcatttccttcattgtgcttcgcgcaaacccactcaatcacatgtaaacaacgcttcccatttccttctgtaaagggaagaagaaagttctcaactttaccattttcatccaccaaaaggctcgttacaagagccgctgagtacaaattcccagaccctattcccgaatttgcagatgccgagactcaaaaattcaaaagccaccttctcaaaaagctttcaaagaaagatatgtatggagaatcaattgaggaagttgtaggaatttgcactgagattttcagcactttcttacactccgagtatggaggtcctggtacactcttggtccttcctttcgttgacatggccgatgccctaaatgaacaaggattgcctggtgggccacaagctgcacgtgctgcgatcaagtgggctcaagatcatgttgacaaagactggaaagaatggactaatggtgataacaacaaaaaatagggtacctcttgtatgttatttagtcgttataactggtgcttatgttgtaagagacctaaatgatcggttttgatatctatttcttaagtgcccgttcggtttagtatttggatagagttggatagaattgattttgaaagagttaagagaaattatattggaacgtgtatttttttattgaaaa

SEQ ID NO: 57 - DNA, 2893 bp, Zea mays
ggagggtgctgtggtataagcttgctttaggattggagggctctggttggttgcctagacaccggcgatggcgtcgccggccggcggcgagtctccggcgaagcccgtcctcctgcacggcgacctcgacctctggatcctcgaggcgcgcctgctgcccaacatggacatgttctccgagcacgtgcgccgctgcttcgccgcatgccgcccgccctcctcctgcgggaccaagcacccgccgcccgccgccgctggccgccgccaccaccaccaccaccggaacatcatcaccagcgatccctacgtcacgctgtccgtgtccggcgccgtcgtggcgcgcaccgccgtcatccccaactcccaggaccccgtctgggaggagcgcttcgccgtgccgctcgcgcaccgcgccgccgacctcgagttccaggtcaaggacaacgacaccttcggcgcgcagctcatcggcaccgtcgccgtccccgccgaccgcgttgtctcgggcgacgaggtcgaggactggttccccgtcataggcaccaacggcaagccgtacaagcccgacaccgcgctgcgcctccgcttcaagttccagcccatcgccgacaacccggcctaccgccacggcatcgccggcgaccccgaccacaggggcatccaggactcctacttcccgctccgccacggcggccaactcacgctgtaccaggacgcgcacgtcagggaaggggacctgccagagattgagctcgacaacggcaagacgttccagcacaacgcgtgctgggaggacatctgccacgccatcctagaggcgcaccacatgatatatatcgtcggctggtcggtgtacgacaaggtgcgcctcgtgcgcgaaccatctccgtcgcggccattgcccgagggtggagaccttacgcttggggacctgctcaagttcaagtcgcaggagggtgtcagagtgtgcctgcttgtgtgggatgataagacttcacatgacaagttcttcatcaagacgggtggggttatggcaactcatgatgaagaaactcggaagtttttcaaacattcctcagtcatctgtgttctctctcctcgatatgctagcaataagctcagcattttcaaacagcaggcaagttttgggcagaaatttatggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcggcaggtgcaaagggtcccaggcaaccatggcatgatttacattgcaggattgatggccctgctgcctatgatgtcttgacaaattttgagcaaaggtggcgaaaggcaacaaaatggcgtgaccggtttagaagagtatctcattggaaagacgatgctttaattaaactggagcgtatctcatggattttaagcccttcacccaatgttccaaataatcatcctagtttgtgggtttcaaaagaagaggatcatgaaaattggcacgttcaggtattcaggtcaattgactctggttccctaaaaggatttcctagtgattgcaaagcagcttcaaagctgaatcttgtgtgccgaaagaacctggtaattgataagagcatccacactgcatatgtccgagcaatcagatctgcacaacatttcatttatattgagaaccagtactttcttggttcttcatatgcttggccatcctatgtgaattcaggtgctgataatctggtaccaatagaattggccctcaaaattgcaagtaagattaaagcgggagaacgctttgcagtgtatgtagtgataccaatgtggccggaaggagtccctactgcagcatctgtgcaagaaatccttttctttcaggcccagacaatggagatgatgtataaaataattgcagatgagctcaaggcaacggacaataaggatatgcaccctgaagattacttgaacttcttttgtcttggaaatcgggaagaaccaccatctaatggtagtccagaatcagagaaatctacagataaaagtgcagcggccttagcttcgaaatatcgacggttcatgatctatgttcacgcaaaagggatgattgtggatgatgaatatgtcattctgggttcagcaaacatcaaccagagatccctggctggttctagagatactgagatcgcaatgggtgcataccagcctcattatgcatggtctacaaagaatggacatcctcacggccaggtatatgggtacagaacgtctctgtgggcagagcaccttggaacggttgatgatcgcttcaaggatccttcgagtttggagtgtgtaaggtttgtgaatcaaatagctgtagagaactggcaaaggtttacagcagaagaaatgagtacgttacaagggcacctcctcaagtacccagttaaggtggaggctgatggtaagatcagcccactgtcagaccaggagtgctttcctgatgttgggggcaagattctgggagctccaacttcacttcctgattcactgactatgtagtgttattacataaaaaaacttctttcagagttgaactttgtaattgtctaaaattggcgggtttatcgcagaacttgtactatatctgtaatcatcgatagttggcgcagggaaagttcaagatgttagtggtgctaagttttcccagcgtttgtaaatgaaccatatgataggatcctagacaatgcttccatttccattatgattatacaacagttttcaacatttttgctc

SEQ ID NO: 58 - DNA, 1759 bp, Glycine max
actagagattgtaaagtgtaaaccctgcttctccctcatctcattgagagtagaagacagcaagggctagttagtgatttggtcttccctctgaaccagatggagttgttatgcactgccaacgcgattctcccctcacgcagcctctctattcccacaccctattcgctacccctcaaaacctcccttccgttcccgcgcttcaacttccccaaaatcgagagattacgagggttgcagccctgtgtgagtgtgagtgaaggcagttccgctgaggctgaggtgttggaggagagccgaattcgtcgagtttgcgacaagctgattggggtgttcatggtggacaagcccaccccaacccattggagaaggttgttggctttcagcagagaatggagcaacctcagaccgcacttttttgcccgatgtctcgaaagagccgatgccgctgaagaggatcccgccatgaaggagaagctgcttcgccttgcgaggaagctcaaacagattgatgaggatgtgcaaagacacaatgatcttcttgaggtggtaagacgggatccttcaggaattagtgagattgtctccaagcgtcgtaaagattttacagaagaattctttgttcactttcatacagtggctgaatcctactatgagaacaaagaagagcaaaatgaattggcaaagcttgggaatgcatgcttggcagctgtacaagcctatgatgctgcaactgaaagcgttgaaaagctgcaagctgcagagttgaaatttcaagatattatcaattctccttcgcttgatgctgcctgcaggaagatagacaatttggctgaaaaaaaagaacttgattcaacattggtattgatgatcaccaaagcttggtcagcttccaaggagtcgaacatgatgaaagatgaggtaaaagatatcctctatcatttatacaagactgcagtgggaaatcttcagagactcgtgccaaaagagattagaatagtcaagtatcttatacgaattgaggatcctgaggagcaactatctgccctcaaagatgcatttactcctggagaagaacttgaaggaacggatgtggataacttgtacacgactccagagaagcttcacacatggataaagagtgtgttggatgcttatcatttgagtggagaaggtaccctcattagggaagcaagagatctgttgaatccagaggtcatccaaaaattggaggtgctcaagaaggttgtggaaaaaaactttatgtgaataggagcttaagaaacatgctaaggtggttttcccactctgagatgccagaagaatacttcatgagattcttgatgtccatcaactacaggccctgatttacagtatcattgctgcaaggaaatatctaaattctggctagtgtttaaggacgtagaattctctttagcaatagaagaagcattttttggggtaaataatagaatgagcaattttgttggtgagtagggaaatgtgttctatgcacgtaggagatggaactattacatggtagaccgctagataaatacaagatttgaggaactgaaccctcgcagagggtgacagttcaaccaaaagtctaggcccttggttaagtcacttgaagatacaatgtatgcccgtgtttaattcctatacttgtattaactttttgttttagtctttgccatgagtcgggattcgttaattgcttacgtgaccgttaatcagagacgctgatatacgacat

SEQ ID NO: 59 - DNA, 1920 bp, Zea mays
gaaggtccggtggtggccctggccgccaatttacaaaaccaaacaaaacgcacccgcaatgggctaaaatacaaaaaaattcggccaagccgtgaggtggacgaggcgcgccacctgctaagccgaatcgagcagcagtagccaccttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcggcgggccgcggggtgcggtgccgcgcaagcctgatcgagcccgacggcgggcagctggtggacctagtggcgcccgaggagggcgggcggcgcgcggcgctccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatccaggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggagattatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaacttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctcttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactgtaaaacactaggcttgattcggatgttaatgtgtgctttgtacccggtgtaccttctctgctggcagtgttgcacatgcactggagcacatcaaacgtttggtgttaataaggacaggctatgtatcctctgccagattgtacatatatacattgtggtgatatataattataaagctgacctctgccgtccgggctcgtag

SEQ ID NO: 60 - DNA, 996 bp, Hordeum vulgare
gtatacacggatctaggcctgttccaggcttcgctccccacgaatgtcgcgtgcggccaccaaaattttcctgacgccatcgctgctcccactcccacttccccagtggcttcgtaggcggcggccaagcatctcctcagcgaggagagccttcgcgatggcggcgtctggattcggaggcggcgaggcgttcccgctgtcgtctgcggcgggggccggtgcgctgaagctgcacaagggcgacatcaccctctggtccgtcgacggcgccaccgacgccatcgtcaatgctgctaatgaacgaatgcttggagggggaggtgttgatggagctatacatcaagctgctgggccacaacttgtagaagcatgtcgtaaagttccagaggttaaacctggagtccgttgccctactggagaagctagaattactccagcttttgagcttcccgtgtcccgtgtgatccatacagttgggcccatatatgatatggacaggaagcctgaggtgtcattaaagaatgcatacgaaaatagcttaaagctggctaaagagaatggcattcagtacattgcattccctgctatatcttgtggtatttttcgttaccctccaaaggaagcatcaaacatagctatttcagctgctcaacaattttcaggcgatattaaagaggtgcattttgttctgttctcggatgatctgtacagcatttggcgtgagactgcccaggagatgctgatgcaatttgagaaatgagtaactatgatatcagtgtagtatgcacaagttatccagcatgtaatacgaccactggagtctattgaccatgatcgcatgtatggcgcagtttgaatgtgtttatctgaacgagagttggatggatatgcaggataagtgccctgaatgatattataccgttctttatgcttcattttcatacgtataagatggctgtcaagtgatattgctagcagtgacttaggccacctttg

SEQ ID NO: 61 - DNA, 6187 bp, Phaseolus vulgaris
actcaccttttacgcttttccttagcttggaagcaccttagcttcttcactcactcactctctgtgctagggtttcgtttcatcttccattcccattcagaatccgaatctcagcttcctttctctctcgctcgtgtcgtcggaatgtcctcctccagaggaggcgcggggccgtcctccgaggcgccgcagccgaggcggatcattcggacgcagactgccggaaacttgggagagtcggtcattgacagtgaggtcgtgccttcctctctcgtcgaaattgcaccaattcttcgtgtcgctaacgaagttgagaagactcatcccagggttgcttatctctgtcgcttctacgcttttgagaaagctcacaggctggatcccaactcaagcggtcgtggtgttcgccaattcaaaaccgcacttcttcaacgccttgaaagagaaaatgacccaactctgaaaggaagggttaagaaaagcgatgctcgtgagatgcagagtttttatcagcattattacaaaaaatatatccaagctttacaaaatgctgccgataaagctgaccgtgcgcagctcaccaaggcatataacacagctaatgttctttttgaggttttgaaggccgttaacatgacacaatctatggaagttgatcgtgagattttggagacccaagataaagttgctgagaaaactgagatcttagttccttacaatattcttcctcttgatcccgatagtgctaaccaggctataatgaaatttcctgagatccaagctgctgtatatgctcttcgtaacactaggggtcttccatggcctaaggactacaagaaaaaaaaggatgaagacattttggattggcttgggtcaatgtttggatttcagaaacacaatgtagcgaatcagagagagcatttgatcttactgcttgctaatgttcacataagacaatttccaaagcctgatcagcaaccaaagttggatgaacgtgccctgacagaagtgatgaagaaacttttcaagaattacaaaaaatggtgcaagtatttgggtcggaaaagtagcctttggttacctaccatacagcaagaagtacagcagcgcaaactactatatatgggtctgtatcttttaatatggggtgaagctgccaacctacgattcatgccagaatgcctttgttatatatatcaccatatggcttttgaattgtatggtgtgcttgccggtaatgtcagtccgatgactggagagaatgtgaagccagcttatggaggtgaagaagaagcatttttaaggaaagttgtcactcctatctacaacgtgattgctaaggaagctgcacgcagcaaaaaaggaaggtcaaagcattcacagtggaggaactatgatgatttaaatgaatatttctggtctggtgattgttttcggttaggttggccaatgcgtgctgatgctgatttcttttgcctgccttccgaaaactcattttttgataaatctaatgatgacaaaccacctagcagagacagatgggttgggaaagtgaattttgttgagataagatcattttggcacattttcagaagttttgaccgaatgtggatttttttcattctgtgtttacaggctatgattattgttgcttggaatggatctggtgatccaagtgtgatctttaatggtgccgtgttcaagaaggtgttgagtgtgtttataacagcagctatattgaagtttgggcaagctgtccttgatgtgatcctgagttggaaagcacaatggagtatgtcgctgtatgtgaagttaagatacattctaaaagttgtttcagctgcagcatgggtgattgttctgtcagttacttatgcttatacttgggataatcctcctggatttgctcaaaccattaaaagttggtttggaaatggtggttcaagtgctccttcattgtttattttggctgttgtggtttacctgtcgccgaatatgcttgctgcaatattctttctgattccttttattcggcgtcatcttgagaggtcaaactatagggttgtgatgctaatgttatggtggtcacagcctcgtttgtatgttggtaggggaatgcatgagagcacattttcccttttcaagtacacaatgttttgggtgcttctcataattacaaagttggctttcagttactatattgagataaaacctcttgtgggacctacaaaagctataatgagtgtaaaaatcacaactttccagtggcacgaattctttcctcatgcaaggaacaatattggtgttgtaattgcactttggtctccgattatcctggtatacttcatggatacccaaatttggtatgccatattctcaacattatttggtggtatttatggtgccttccgtcggcttggggagatacggacactaggaatgctaaggtctcgttttgaatcattgcctggtgccttcaatgccagtttgattcctgaagaagcaagtgagccaaagaaaaaaggattaaaagccactttgtcccgcagatttcccaatatctcatctaacaaggggaaggaggctgcaaggtttgcacaactgtggaaccaaataattactagtttcagggatgaagatcttattagtgatagggaaatggaccttttgcttgtaccatattgggctgatactcagttggaccttatacaatggcccccctttctacttgctagcaagatcccaattgcactagatatggctaaggacagcaatggaaaggatcgagagctaaagaaaagaattgggcttgatacttacatgtcttgtgctgtccgtgagtgctatgcttcatttaagagcattattaagcatttggttcaaggggaacgggagacaaaggttatagagtacatgtttgatgaagtggataaacatatagaatcagataaactgattgttgaattcagaatgagtgcacttcctaacctctgtaaacagtttgttcagctaatagagtatttgttggcaaatgatccaaaagatagggacctagttgtgattctattccaggacatgctggaggttgtgacaagagatataatgatggaggaccaggatcaaatattcagtttggtggattcaacccatggtggtaccgggcatgaggggatgcttcaccttgagcctgagccccatcaccaattgtttgcatctgaaggagctatcaagtttccaattgaaccatttactgcagcttggacagagaagattaaacgacttttcttgctgcttacgacaaaagaatctgccatggatgtaccatctaacttagaagcaagaaggcgtatatctttcttctcaaattcattgtttatggacatgcctttggccccaaaagttcgcaacatgctttcattctcggttttgacaccatactatacagaagaagtactattctccttacaagacttagattcacctaatgaagatggtgtttcaatactgttctacttgcaaaagatttttccagatgagtggaacaattttattcagcgtgtgaagtctactgaggaggatattaaagggtgtgaatctgatgagttagtggaagaacttcggctttgggcatcatatagagggcaaacattgaccagaactgtaagaggtatgatgtattacagaaaagctctggaactgcaggcgtttcttgatatggccaaagatgaagatttgatggaaggttataaagccgtagaaaactcagatgacaattcaaggggggaaaggtcattgtggacgcaatgtcaagcggtagctgatatgaaattcacatatgtggtatcatgtcaacaatatggcattgacaagcggtctggttctcgccttgcacaggacatattaaggcttatgacaagatatccgtctcttcgagttgcctatattgatgaggtagaggaacctgtcaaagacagtaagaaaaagatcaacaaggtttactactcttgcttggtgaaggctatgccaaaatcaaatagtgcttcagagcctgagcagaatctggatcagattatatataaaataaagcttcctggaccagcaattttgggtgagggtaagcctgaaaatcagaatcatgccataattttcacacgtggagagggcttgcaaacaatagatatgaaccaggataattacatggaagaagctttgaaaatgagaaatttgttgcaagagtttcttaaaaagcatgatggtgttcggttccctagtatccttggacttagggagcatatatttactggaagtgtttcttccctcgcatggttcatgtcaaatcaggagacaagttttgtgacaattggtcagagattgttggctaatcctttgaaggttcgtttccattatggtcaccccgatgtctttgatagactttttcacctcacaagagggggtgtgagtaaagcctccaaggttatcaatctaagtgaagatatttttgctggctttaactctacactacgtgaagggaatgttactcaccatgagtacatacaagtagggaagggaagagatgtgggtctcaatcagatatctatgtttgaagcaaaaatagctaatggcaatggggagcaaacacttagtcgagatgtataccgacttgggcatcgttttgacttcttcagaatgttgtcttgttatttcaccacagttggattttatttcagcactcttataactgttctcactgtatatatattcctctatggtcgcctttatcttgttctcagtggcctcgaagaaggtctgagcactcaaaaagccattcgagataataagcctcttcaagtagctcttgcatctcagtcgtttgttcaaattggggttttgatggccctgcctatgttgatggaaatcggtttggagaggggcttccgaactgctctcagtgagttcatattaatgcaactgcagctggccccagtattctttacattttcacttgggacaaaaactcattattttggaagaacattgctgcatggaggtgctaaatatagaccaactggtcgaggatttgtggttttccatgctaaatttgctgacaactacagactttactctcgtagccactttgtgaagggtattgagctcatgatactgcttattgtgtatcaaattttcggtcattcttacagaagtgctgttgcatatatcttgattactgcatcaatgtggtttatggtgggtacctggctgtttgctcctttcttgttcaatccttctgggtttgaatggcaaaaaattgttgatgattggactgattggaataaatggattagtaatcgagggggtataggtgttctacctgaaaaaagttgggaatcttggtgggaagaggaacaagagcatctccaatattcaggactgcggggaatcatagtggagatactgttatcattgcgattttttatctaccagtatggtctggtatatcacttgaatattacgaaaaaaggccaaaaaagttttctggtctatggcatttcatggttggtgatatttgtagtattgtttgtaatgaagacggtatctgttgggaggcgtaaattcagtgcaaattttcaacttgtcttccgtctaatcaagggaatgatattcctcacttttgtctcaattctagtcattttgatagcccttccgcacatgacagtgcaggacatagttgtttgcattcttgctttcatgccaactggttggggaatgctgcagattgctcaagcattaaaacctttagtacggcgggctgggttttggggatcagtgaaaactcttgctcgaggttatgagattgtgatgggtttgcttctgttcactccggttgcttttctggcttggtttccttttgtttcagagtttcaaacccgtatgctgttcaaccaagcattcagcagaggtttgcaaatttctcgtattcttggtggccaaaggaaggagcgatcgtctcgcaacaaggaatagttttccaactatgatggcttagtattcggatgtaccaattgtaagtagttgtaacttgtaacttgtatctatgaatgacagattctacacttcgctttcattacaacgttaaattatcattatcaaatattcaagttatcaagtctttcacctacaaaaaccaaaa

SEQ ID NO: 62 - DNA, 2385 bp, Phaseolus vulgaris
caaaacatttggagtgaacacttgaagatatctgttatcaggaggaagtaaggtgaagaaaatgtggaggctgaagataggagatggaggaaagaatccatacatatttagcacaaacaattttgtaggaagacaaatatgggagtttgattctgaagcaggaactgatgaagaacgagcccaggtggaagctgctcgtcaacatttctatcaaaatcgctttaagctcaaggcttgtggtgatcgactatggcgatttcagattttgagggaaaagaaattcaaacaaaaaacaaggaaagtgaagatagaagatgatgaagaaataacatgggagaaggctactctcaccctaaagagaacctctcattacctgtcggcactgcaaactagtgatggccattggcctgctcatctcgggggttcccactttttcattcctatcatggtcatttctatctacagcacgggacatcttgattctgtacttccgaaagaatatcgtaaagaaattctccgttacttatataatcatcagaacgatgatggagggtggggattacacatagagggtcctagcacgatgtatggtaccacactaaattatataagtatgagacttctcggagaaggagctaatggaggtcataacaatgcttgtgttaaggctagaaaatggattcatgatcatggcagcgtaacacatgtgccttcctggggaaaattttggctttcggtacttggtatagttgattggagtggatgcaacccattgccgcctgaattttggatacttcccactattctccccatgcatcctgctaaaatgtggtattattgccgacatgtatatatgcctatgtcatatatatatggaaaaagatttgtgtgtccaatcacaccattgattagagaattaagagaagaactctttattcaaccgtatgatgaaagtatttggaagaaagcacgtcacaaatgtgctaaggaagatctctattatccccatcattggatacaagatctaatatgggatagtgcttatttagttactgagccacttcttacacgctggcctttcaataagttgattagagaaaaagcacttcaagtagcaatgaagcttattcactatgaagatgaaaatactcgatatatagatggtggttgtgtgaacaaggctctgtctatgcttgcatgttgggtagaagatccaaatggagatgcttttaaaaagcacgttgcaagggttccagattatttatggctttcagaagatggaatgtgtatacatgcacttagtacgcaatcatgggatgctggttttattgttcaagctcttcttgctactaatctaattgatgatcttggtcccacacttgcaaaagcacatgattttatcaagaaatctcaagtagtagaaaatcgttcaggagattttaagagtatgtttcatcacatttctaaagggtcttggacccttgctgatagagaccatgcattacaactttctgatggcactgcagaatgtatgaagtgttgtttacttttatccatgttaccagaagagattgtgggagaaaaattggaacctgaaaggttatatgattcagtcaattttttattgtcacttcagagtaaaaatggaggtgtaactgtgtgggagccagcaatagctcaaaagtggttggaacatctgaatcccgcggaatttctggctgacatagtaattgagcacgagtatcttgagtgtactggatcaacaattcaggctttagtgttgttcaaaaaactatacccaaatcatagaagggaagagatagataatttcattgtcaaagcagcacaattcatcgaagatgaacaattaccaaacggaaattggcatgggaactggggagtttgcttcacttacggtgcctggtttgcagttggaggtttagctgctgctggaaagtcttacagtaattgtgttgccattcgtaaagctgtgaagtttctactctcaatacaaaatgaggatggtggttggggagaaagttatctttcatgtccaatgaagacgtacgtgcctcttgaagggaatcgatcaaatgttggtcaaacagcttgggctctactagctttgattcttagtggtcaggctgagagagatccaactcctcttcaccgtgctgcaaagttactcattaattctcagttagaagatggtgattggccccaacaagaagcattgggggtgtacaagagaagttgtttgcttcattacccattctatagaactgtttttccgttgcaggctttgtctgaatatcgtaacaatgttttagtgccatctacttgagaaactgtaagctcaaaacaacaatgtcaaacccataaaaa

SEQ ID NO: 63 - DNA, 1114 bp, Zea mays
tatctcctatctccagcagctcctccagacctccacctctctatggcgcgcctgctcctcttcccatcccaagcgtgcgtcgatcctggccgccacctcctcctccacccgccggtctccaggccccgtgctgtccggtctgggcctcctcccgccgcgccacgccgcaccggggtcgtctctcttcccggccgttgcccaccgcccctttgctggaaccaccatccatttcttccttgcagatcatcaaagagaggatgggtcgtttttgcttcagaaaacgtacaagaaatttcttctcaccttcctcgcaaggatgaaaggagaagtgggaatttgcttctgcgattcagtgcactcccatattgcactatggcttggttgagcactgctcaattagcacaatctagtgttggggaaaagctaaatatggtttatgaggtcggggagctgtttgagctgggaattcagctgtcttatctgctcatacttattggactgcttggagctggtacattttttgttatccgtcaggttcttgttcgtagggagcttgatctttctgccaaagagttgcaagaacaagtgagaagcggtgatgcaagtgctactgagtattttgagcttggagcagtcatgctacggagaaaattttatccagctgctatcaaatatctgcagcaagcaattgacaaatgggacagagacgagcaagatcttgcgcaggtctacaatgccctgggggtcagctacaagcgagagaacaaacttgacaaggcgattcagcagtttcagaaggccgtggagctccagccaggctatgtgacagcttggaacaacctgggtgacgcatatgagcagcagaaggacctgaaatcggctctcaaggccttcgaggaggtcctcctctttgatcccaacaacaaggttgcaaggccacgcgtcgatgacctcaggccgcgcgtgagcatgtacaagggtgtgcctgtaaaatccgaaaagcgatagctattcttttttggtggtaaatcatgcatctgtctagtccccagaatagcggttgtttatttttgaacggtagcatttgtaaacatgatgagatgtgtagtagcat

SEQ ID NO: 64 - DNA, 3371 bp, Zea mays
attcccactaccgcggcaggcagctaccccctccctctcgtctcctccgccacctcttctcgcgtctagggtgcgcccgcctcgctggcgtagggtcgggacggttctgccggtgcgagctccacgacccctctgcgggagacgaaacaaaggcgtgggcttggtagatacaggtctgggattgccttttcctagttcaacatggagggcgctcttgttcagtctgctattgttccagccgtttacagaagcagctcaggtcggttccgtgtgcgtgcaagggccagaacaaatgctacaatggtgcggaatacgccaacaaggactcttactcttggtggcttccaagggctgcgtcagacaaactttttggatacgaggtctgtaattaagcgtgactttggatcaatcgtggcaagccagattgcaaggccacgcgggtcagcctcaagaggggtggtccgtgccatgtttgagcgcttcactgagaaagcaatcaaggtgattatgcttgcacaggaagaggcaaggcgcctgggacacaacttcgttgggacagaacagattttgctggggcttattggtgagggcacaggaattgcagcgaaggttatgaagtctatgggaatcaatcttaaggatgcccgagtggaagtcgaaaagataattggacgtggcagtgggtttgtggctgttgaaatcccattcacacctcgagcaaaacgtgtattggaattgtcccttgaagaagctcgtcagcttgggcataattatataggatctgaacacttactccttgggctacttcgtgagggtgaaggtgttgctgctcgtgtgcttgaaagccttggtgctgatccaaacaacatccgtacccaggtcataagaatggttggggaaagcacagaagctgttggggctggagttggtggaggaagcagtggccagaagatgcccacacttgaagaatacggtactaatttgacgaaattagcggaagagggcaaattggacccagttgttggtagacaggatcagattgagcgcgttacccagattttaggcaggaggacaaagaacaacccctgcttaattggagagcctggtgttggaaagactgctattgctgaggggcttgctcaacgtatttccaatggtgatgttcccgaaacaattgaaggaaagaaggttattactcttgacatgggcctccttgttgctggaaccaaataccgtggagagtttgaagagagattaaagaaacttatggaggaaattaagcaaaatgaagatattattctctttattgatgaagtgcacacactgattggagcaggtgcagcagaaggtgcgattgatgctgctaatattttgaagccagctcttgcaagaggtgaactgcagtgcattggtgccacaacactggatgagtataggaagcatatagagaaagatcctgccttggaaagaaggtttcaaccagttaaggttcctgagcctactgttgatgaaacaatacagatcttaagagggctccgtgagagatatgaactccatcacaaactgcgatacacagatgatgctttaattgctgctgcacagctgtcttatcagtatatcagtgatcgtttcctgcctgacaaggccattgacttgattgatgaagctggatcccgtgttaggctgaggcatgcccagctccctgatgaagccaaagagctggacaaagagctgcgacagataaccaagcagaaaaacgaggctgtacgcggccaggattttgagaaggctggtgaattaagggaccgagaaatggaactgaaggctcaaattacggccattattgacaagagcaaggaaatgattaaagcagagactgaatctggtgatgtcggtcctcttgttactgaggcagatattcaacatattgtctcctcttggactggaattcctgtggagaaagtgtcgtctgatgagtctgaccgtctcctaaagatggaagagacactgcatacacgtatcattggccaggacgaggctgtcaaagctattagccgtgctatccgccgtgctcgtgttggcctgaagaatccaaataggccaattgccagcttcatattctctggaccaactggagttggcaaatcagagctagcaaaggctctggcagcctactactttggctcagaggaggctatgattaggcttgacatgagtgagttcatggagagacatactgtctccaagcttattggatcacctccaggttatgttgggtacactgagggaggccaactaactgaagcagtccgtcgccgcccatacacagttgttctctttgatgagattgagaaggcacatcctgatgttttcaacatgatgcttcagatattagaagatgggcgattaactgatagcaaggggcgcacagttgacttcaaaaacacactattgatcatgacatctaatgtgggaagcagtgtcattgagaaaggaggccgcaagatcgggtttgaccttgactatgatgagaaagacaccagctataacaggatcaagagcctggtgaccgaggagttgaagcagtatttccggccagagttcttgaacagattggatgagatgattgtattccggcagctgactaaattggaggtgaaggagattgctgacattatgctgaaagaagtgtttgacaggctgaaggccaaggagattaatctccaggtcacggagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtgatagtcctgaatggtggtagcggtgttgctgagccactggaacctgctctcagtacctaaccgaggtcaaaatcatcattggtccgaaatatggccttctttacaagtcagctgggtttctcgtgatggtaaaaactagactgacattacttggccgcccattagttgctttatctttcgtttattttcttttttgttggaagtgaggcagtagggttgctatggaaatgaatagatggagaagcatttagcagacatataatatatgctagacttttgagttgccttgttttgggaagaaacttggaattttcagtttgatgcacttgtattattattaggccttggtagcaacaagatacggatgtcgtctctacgtttgctgttgtacttcagtgtaacttgcctcccgaatgtatgagtattatttatcaagtcccaaataacagtgacggattgctaca

SEQ ID NO: 65 - DNA, 2296 bp, Zea mays
cactttcccttctgtctggctccgcatcccagtcccagacccggcaagcgccggccatcgccatttcggatccgggcccgctcagcgcgcgggttcccgaacccggccggccggccgcgctcctcgccaccgccgccgccggccatgaagcgcgcgcgcagctccgaggtattcatcggcgtaggccggctgcgcgcacgcaggggcctggcgccgcttctcgcagcggcggctttcgcctacctactgttcgtgtccgtcaagctcacttacctcggcagcgctgggcccgcgcctgccgtcggccgcctggccaccaccggcgcgggcgagccagctgcgcgcgcgcgctcgagcggcggcggggccgtgtccgggtacggccgcatcaccggcgagatcctccggcggcacgaagccttcgaggagcggcggaagcggtgggggcagctggggaacttcacggagctcgagcgcgtggcggccgaagcgtgggcgctcggggccgccgcgtgggaggaggcctctgcgttcgacggcgacgtcgactacatcgcctcccgcgacgtcgccggggagggcacggccaagtgcccaggctcgctcgcgctcggcgccggggagaccacggcgttcctgccgtgcgggctggccgccgggtcggcagttaccgtggttgggacagcgcggacggcgcggccggagtacgtcgaggcgctggagcggagcggcacgggcaacgggacggtgctggtggcgcagttcgcggtggagctgcgcggcctgcgcgctaccgacggcgaggagccgcctaggatactgcacctcaacccgcgcctgcgcggcgactggagcagccgccccgtgctagagatgaacacctgcttccgaatgcagtggggcagggcacagcgctgcgacagtaccccttccggagacgatgacctggtcgatggactaagaaaatgtgagaaatgggactggcaggacgtagttgaatcgaaagaaacaaagacaagctcatggttcaacagattcatcgggcgagcaaagaaaccagaaatgagatggccattcccattttcagaggggaagatgtttgttctcactatccaagctggagtcgaaggataccatatcaatgtgggaggccgccacgttgcctcatttcctcataggatgggattcgccctcgaagacgcaacaggtttagccgtgacagggggcatagatgttcactctgtgtacgcaacagcgcttccaaaggcacatcctagcttttctctccagcaagtcttggaaatgtctgaaaggtggaaggctcgccctgtgccagaggaaccaatccatcttttcatcggcatcctctccgccacaaaccatttcgccgagcgcatggctattaggaaaacttggatgcagtttccggctatccaatcggggaatgcggttgctcggttctttgttgcgctgagccacagaaaggagataaatgcagcactgaagaaggaagcagagtattttggagacatagtcattctgccgttcatcgaccggtatgagctagtggttctgaaaacggttgcgatatgtcaatacggggtgcacaatgtcactgcagattacatcatgaagtgcgacgatgacacctttgtgcggctggatatagtactgcaccaaatcagtacctacaacaaaacctcacctctgtatctgggcaacctgaatctcttgcacaggcctctaagaaggggcaaatgggccgtcacctacgaggaatggccagaagcggtgtatcccccgtacgccaatggacctgggtacgttatctcggccggcattgcgagagacgtagcatcccggcatacaaaccactccctacggctgttcaagatggaggacgtgagcatgggcatgtgggtggaggactacaacgccagcgcccccgtgcagtatgtccacagctggaggttctgccagttcggctgcgtggacaactacttcacggcgcactaccagtcccccaggcagatgctgtgcctctgggagaagctgtcagcggggagagcgcactgctgtaactacagataacatgaggcccccagcccccaggggggaaatggtgacctagccgcctaggtgcatcaaggctcatgaccttcgttccattcgcctggcttcggtagttcggttccatacgaccatctgctcagatgactaatgccagaaaccatgatctcgacaccgcatgttctttggttcttagattgaaggtatacgggataagggtgttacc

SEQ ID NO: 66 - DNA, 3829 bp, Zea mays
aaacgtctgaaataggcgagggatcacggccgcgcccgcgcaagcggcaaggcaaacccttgtgttggtccagccgcccctcgccccgccgcaccaatcccccaccccatcccaacgctatccgctgccctcgccgcgcccccctcctcttccacctcgtccgccaccctccccaatccatcacatcccaccctaccccaccggccctgccgccgccgaggaggaggtgtccccacccccgtccgcagaggcagcagggatctctaccgggcatggagctggcgctcgcctccgcgaagccctcgcctcgggcggcgggggccttcccgccacttatcttctcgccgcttaaaccattcccgctcctccgcttcccgccgcggaggaccgcagcggcggcgctgcggctccggctccggctccgcgcggctgccgctgacgcgggcgagacttcccctggcgaggaggtgttcggcgcgcggcgggagctaacgggcatccagccgctggtggaggcgctgccgcccgcagcgcggacggcggcggaactggccgtcgccgcggcagccgtggcggcgggatacggcatcgggctccgcgcgggtggcgggtcgcgcgccgtggcggtggcgggggcggcagtgctctgcgcggccagcgtggcgggagcagctgcggtgaactccgtggtcccagaggtcgccgccgtggggctgcacaattacgtcgcgggccacgacgaccccaccaacctggacaacggcgaggtggaggcaatcgcgaagaaatatggagttagcacacaggatgacgccttcaaagcagagctctgtgacttgtatgccaggtatctttactcagtacttcctccaggagatgaagatctcaaaggtacagaggttcaggcaattataaaatttaaaagtgctcttgggcttgatgatgtagatgctgctaacatgcacatggagattggtagacgcatatacagagagaggttggaaacgagtgatcgtgatgctgacatggaacaaagacgggcaagtgcatttcagaagttaatttatgtgtccaatcttgtctttggagatgcatctgtattcctacttccttggaaacgtctgtttggggtgactgattctcagattgacattgctatgagggaaaatgccaagaatttatactcggtgcagctcaagtctattggaagaggtcttgacataggcacactcattgaagtaaggagagcacaacttgcatataaactttctgatgagattgctgctgagatgttccgtgagcacgcgaagcagctagttcaagaaaacatttcatcagcattagacatcttgaagtcacgtattccggatagtctaactcaggctgtggaagaagtgaatattgtaattaaatttaatagtttgcttacaacattaagcaaacaccctgaagctgataattttgctcgtggtcttggccctatttcattagctggagaggatgatcacgataggagagctgatgatttcaagatactctataaggcctatgctacagaagtactttcagatggaattgtggatgataagaagctttcccctctgaatgaactgagaaacatatttggactggggaagcgggaagcagaaggaatcttatctgatgccaaagctcacatatacagaaggacacttgctaaatcatttaacactgaattagcttcagtccatagcaaagcagcatttctccaaactctttgcgaaaagttacagtttgatcctgaactggctagtaagatgcatgaagaaatttacagacagaagcttcagcagtttgtaactgatggagagctgagcaaggaggaagtggaagctctgatggcattccaagtgcgtctctgcatccctcaagaaactgtggacgctgcacatactgagatttgtgggcaactgttcgaaaaggttgtcaaagaagccattgcatctgttgacggatataatgctgatagacgtgaggctgttaggaaggcagcacaaagtctaaacctgaaaacggaggctgtcatgacgatctttagtaaagcagtacggaagttattcttgagctacattcagagagcaaaagaagctggaaaccgcattgaaactgcaaaagaactgaagaagttaatttccttcaacatagttgttgttaccgagcttttagctgacattaaaggagaactatctccagttgctgaaactgaagcatcaagtgcagcttcagaatctgaaggagaggatggtgaacatgaatgggaatcattggatacactgaggaagactagacctgataaagagctcaaagaaaagctgagaaagtcaagccagaaagagataactctcaaggatgacattccattgagggatagggctgagctgtatgaaacgtacctgatgttctgcatcactggggagacgactaatgtatcatttggaacagctatctctacaaagaaagatgattcagagtttttaatgctaaagcaattgggtgacatacttggtttaactcgcaaagaagctcaagatgttcacattaagtttgcagagaaagcttttgtgcaacaggcggaagtaattcttgctgatgggaaattaacagaggctaaggctgaccagcttgctaagattcaaaagcaggtcggtttgcctactgaacatgcacagaaaatcattaagggtattacaacgacaaagttatcttctgcaattgaagcctctgttgctcggggtcagatcggtatacagcaggtccgaggattgaaggaagcaaacttccaactagatagcttgattgcggagccgcagcgagaaagcatttataggaaaactgttgaagagctcttttcttcaggtacaggggatttcgatgaagaggaaatgtatgtgaagattccagctgatctcataataagttctgagaaggccaagtcaattgtacaggatattgcaaaggttaggttggagaactcccttgtccaggctattgcgttgcttcggcagaagaagagagatgatgtgctttcatctctgaatgacatgctcgcatgtgatgctgcggtccctgcatcacgacccttgtcatggcccacaccaggagagctagatgatctatttgccatctacctgaagagcattcctaagcctgagaagctatcaaggttgcagtacctgctcggcattagcaacgagaaggctaacgagatgcagtacgcagcctcggagggatcgctgccggttgcagctgaagagaaagaggagttggcgttctaggaagggagacagttttgttagggtagccaccggagttgaggtcccttgccaaggaacgaacgaacttggtgcctgtggcggacagctgctattgtagctaggcgcatacatgtttttggaaaaggaaatcgacgtgtaacactgacatatttattgcatgtctatctgtatagacaagtcaataacaccgacgctgttaggctgttgcattccaccaggccacactggaagcgttttgttttctggttcattgtttctcttttggtttaagaatgtattacagctatgactgccacccttgcttataacctggatttgttgttaacctacctggagtgcttaagggcccgttcggttctacccggattgtttgtgtaacttataagttttgatcgctggaacgttccgggatggaatccggaagaaacgaacacggctaaggggcagtttggagccttctgttgcttaccatcagcaacctctttgcaaaatgtgaaatctctctgttttactcc

SEQ ID NO: 67 - DNA, 1780 bp, Zea mays
gctaggtctttctaaggtccactgacaaaaccctggctcgttccccgctctacgggcctaaacctcacctcgccggcggccaaaaatcgaagcaccgaaccagcggctgcggcggcggcggtgcggcaagtgttgaccatggcggagctaaagcggttgtcggagagccgtgacctgacgcggattgagcgcatcggcgcgcactcccacatccgggggctagggttggactcgtccatggaggcgcgcgatacctcggagggcatggtcgggcagctccacgcgcgccgcgcctcggggctcatactccagctcatccgccagggcaagatcgccggccgcgctgtgctccttgcgggccagcccggcactggcaagaccgcgctcgccatgggtatcgccaagtcgcttggtgcggagacgcccttcgcctccgtcgctgcctcggagctcttctcgctcgacctctccaagacggaggcgctgacgcaggccttccgccgcgccataggcgtccgcatcaaggaggaggccgagatcattgagggcgaggtcgtggagatctcaatcgaccgccctttgtcggcctctggcgttggcggcagctcagttgctccttctggtgcaactgccgctggtaagtcagggcggctcacgctgaagaccacggacatggagactgtgtacgagctcgggggaaagatgattgaggctcttgtgaaggagaaggtgcagagtggagatgtaattgcgcttgacatggcctccgggaaggtcaccaagcttggccgctccattgggaggtcgcgggattatgatgccgtaggtccacacaccaagtttgtcaagtgtcctgatggtgagctccagaagcgcaaggaggtcgtgcactgtgttaccttacatgagattgatgtcatcaatagcaggacacagggttttcttgcactgttcactggtgacactggtgaaattcgtgcagaggttcgggagcagattgacacaaaagttgcagagtggagagaggaaggaaaagctgatattgtccctggtgttctgttcatcgatgaagtccacatgctagacatcgagtgcttctccttcctgaaccgcgcgttggaaaacgacatggcgccgatcttagtaatcgcaacgaaccgagggatcacgtctatccgcgggacaaactaccgctcgccgcatgggatcccgccagacttccttgaccggctactgattatcacgacgcatccctacacggaggatgagatccggaagatcctggatatccggtgcgacgaggaagacgtggagatgtccgcggacgccaaggttctgctcaccaagatcggtgtggagacctctctgcggtatgccatcaaccttatcacatctgccgcgctagcctgccagaggcgcaaggggaaggtggtcgagatggaggacattagccgggtgtaccagctgttcctggacgtgaagcgatcgacgcagtacctgatggagtaccagagccagtacatgttcaacgaagtgccggggcaagcagatggagaggacgccatgcaatcgtagatgaactttcctttacatggtgtgtgtgggttatagtatgtaccgcgtggcgtatatttatgatgcgtctttcttgttcaggttgctgttaccctgacccaaggcgcggtgtgtgcggtggactgtttgttagcttgatgtaggtgactatgcaactcaatctatcttattaaattcaccccggttggaaaccgtggtttgttta

SEQ ID NO: 68 - DNA, 1605 bp, Zea mays
gttagttattttccgctctgttcctcagccgcaacggccgccgcccgccggtcgtcgtcggccacgtcgcgcggtctccggcatccccagcccgcagcctcacaacctgatcgatgctcccctaccacccagtcaaccacacacacgcacacatacacttctcaaaaaaatccctcccgctcccaccgccgtctcctcctcccaatcacattccgtttccattcgcgcggcccgcgccgcctccctcctcgaggccactcgcttcctctccaccccgcacccacgctcgcgctcgcgcccgctccctttcccgcccggcagcggcctacacccccacctcctcaggacccctcgcctctccactctccgcgtccacctccaccgtcccgctcctctcggcgcgcaggagccggcgaggcctggcgcgctcctggccgtagacgcgctcaggaggtccgtgctcgactccctcgcggcgctcaagcggcccgcgctcgcgctcctcctggccggtgtgctgctcgccgcggcatcggcgggcgggccgcacgcggcggcgctggccgcctcgggcgggcgcgtcggcgggtcggccttctcctcgcgctcctcctcgcctcgatcctacgggtacagcgcgccggctcccaggggcgggtacacggccgctcccttctactctccttcgcccttcgtatccgtcggcccagccctcggcatcggcttcgggggatcggggttcctcgtgaccctcatgggtttcgcggctttcctctacctggccgggttcctgtccgactcgtccggcgctaccagtgtgctcacagagacggagaagaccaccgtcctcaagctacaggttggcttgctgggcatggcacgatcatttcagaaggagcttgatcaaatagctgagaaagcagatacatctaccccagctgggttgagctatgtgttgacagagacaacattggcattacttcggcatccggactgttgtatctcagcttactcatcggtggatgtgaaacgaagcattgataatggtgagaaacgtttcaatcagctttcaattgaggagaggggcaagtttgatgaagagacacttgtgaatgtgaacagcatcaagaggaataaaggaggcagccaaagatcaagtggttttagcaacgagtacattgtgataaccatattggttgctgctgagggagtacataaggtgccggttataaatagcagcaatgacttaaagacagctctacaaaagatgggtgccataccatcgcgcaaaatactggcagtcgaggtcctatggactccacaaaatgagaatgacactttgtcagagcgagagctccttgaagattacccgctcttaaggcctctgtagaaagaagctgctgtagattcagttttggcggttttcttattaactatagcgcagatcttgtgtttgtataaaagtgtataatttgttattgacgtcactgttagccttcatatcagaacatttagcgcatcgcagtacaagtctgcgattgtctgccggtagtcttggtcgctgttcctgacacaataacacaaaattgtaaatagattgttctg

SEQ ID NO: 69 - DNA, 5985 bp, Zea mays
aaaagctgaagcaaacaaacgcaaacggctcatcccattcccatcacatgattcccaactcagcgccgcatcgcgtcaccgcaatctcgcagtcatccccccaaattcccatgtactgctcttgctcctgataatggcttgatttctcagtccgcactcgtcactgaggctgggcgctgacgccttccccgtttttgcagctccgcgaccgctagccgtgaggatgagcctcctccgcaaccgccgcgccgccgccgccgcggctgcagcggcggcggcggcgggaggaggggggtacccggagccgccggcttacaacatcatcccgatccacgacgtggtgatgcacggggagcacccgtcgctgcggttcccggaggtgcgcgcggccgtggaggcgctggcgcacgcggcggacctgccgccgcctccgctagcccgcgcctgggacgccttccgtgccgacctcttcgactggctcggcgccaccttcggcttccagctcgacaacgtccgcaaccagcgggagcacctcgtgctcctcctcgccaacgcgcagctccgcgcaggcggcaccctccccaccgaccaccccgccgacgtgctgcaccactccatcgcgcgggacatccggaggaagctcctcaagaactacaagacctggtgctcctacctcggcaagaggccgcacgtccatgtgcccagcggcggacgccgtgtcgctcagggggtcggccctgacacacgccgcgacctactgtacaccgccctctacctcctcatctggggcgaggcggccaatttgaggttcatgccggagtgcctctgctacatcttccactacatggcactcgatctcaaccatgtcatcgaccagtcgattgatatcgagactgggcgaccatcagttcctgcggtgcacggtgtggatgctttccttgacaaggttgtgaagccgatatatgacgtgctcgaggctgaggtgaagttcagccggaatgggaccaagccacactcggcctggaggaactatgatgatgtgaatgagtacttctggagccgcagagttttcaggcggctccagtggcccctgtcaccagcgaggagcttctttataaagccaggaaaccccgggcgtattggcaagactggttttgttgagcagaggtcgttctggaatgtgtaccgcagctttgatcgggtatgggtgatgctcattctgttctttcaagcagcaatgatcgttgcatgggatggccacactccgtggtttagcctacgctaccgtgacatccagatccgggtgctgtctgtgttcatcacctgggctgcgctgcgcattgtgcaggcagtgcttgatgcaggcacacaatacagcctcgtgaggacggatactatatttctcgcagtacggatggtgctcaaggtgcttgttgctgttgggtggactatcacattcattgtgctctatgttcgaatgtggaatcagaggtggcatgaccgcaggtggtctttttctgccaattccagggtgttaaactaccttgaggcagctgctgtgtttctcatcccacaggtgcttgcacttgtgctcttcatcgtcccatggattcggaattttctggagaaaaccaattggcgaattctatatgtgctcacctggtggttccagacccgtacatttgttggacgtggtgtgagggagggccttattgataacattaagtataccacattctgggtgtgccttctcactgctaaatttagctttagttactttctccagattaggccgatggtgaagccaacaaagactattctcagcctccatgacattcggcgtaactggtttgagttcatgcctcacacagagcgaattgctgtaatctttctgtgggctccagttgttcttatttatctcatggatattcagatatggtatgcgatcttctcatcacttactggggcacttatcgggctgttctcacatctgggggagattcgcagtgttgagcaactgcgcttgagattccagttctttgcaagtgcaatgcagttcaatttgatgccagaggaacacctggatgctgtgcacggtggcctccgaagcaagctgtatgatgctatcaatcggctgaagctgagatatggctttggtcggccgtataggaagattgaagctaacgaggtggaagctaagaggtttgcgctgatatggaatgagattattcagacatttagagaagaggacatcattagtgacaatgaagttgagcttcttgagctaccaccagttgtgtggaaaattcgtgtggtgcggtggccatgcttcctgctaaataatgagctgcttcttgctcttagtcaggcaaaagagctagtagctgatgacaggacacactggtcaaggatacgtaacaatgagtacaggcgttgtgctgtcattgaagcttatgacagcatacgtcacttactgctggagatcattgaggatggaactgttgagcacataattttcagtcagctgttctttgcatttgatgctgcaatggagaatgggaaattttgcgaagaatataaaatagaactgttgcctgaaatccattcatctgtaatcgccttagtggaacttctactgaaagagaagaaggatcagaccaagatagtaaataccttgcagactctttatgtctttgcaattcatgattttccaaagaacaaaaaggatatggaacaactgaggcgagagaggctagcaccatcaacactagaggattcccgtctcctctttgaggatgtcataaaatgcccaggcaatgatgatgttagcttctacaaacaggtgaggcgcctccatacaattctcacctccagggattctatgaacaatgtcccaaagaatcctgaggctcgacggcggataactttcttcagcaactctctattcatgaatatgcctcgcgctccaacagttgagaagatgatggcattcagtgttttaaccccatactacaatgaagatgtgatgtacaacaaggaccaacttcgccgtgagaatgaagatggtgtctcaattttgttttatcttcaaaagatatatgaagatgattggggaaactttttagaacgtatgcagagggatggaatgactgatgacagtgaaatttgggctgggaaatatcaggaactccgactctgggcctcgtatagaggacagaccttagcacggactgttaggggaatgatgtactaccacagagctctcaagatgcttgcttttcttgataccgcctccgaggtagacatcacagagggtactaaacatcttgcatcctttggttcagttaggcatgagaatgatgtgtatcccatgaatggtggtttccggcggcaaccacaaaggaggttagacagaggaaccagtactgtaagccaactgtttaaaggtcaggaagatggtgctgctctcatgaagtacacctacgttgtcacttgccagatatatggaaagcagaaaattgctaaagatcaacgcgcagaagatattttaactctaatgaagaaaaatgaggcacttcgtgttgcttatgttgacgaggtccatcaacgaggctatactgaatactattctgtcctggtaaagtttgaccagagcttacagagggaggttgagatataccggattaggttaccaggtgaactgaagcttggggaaggaaaacctgaaaaccagaaccatgccatcatattcacaagaggtgatgcagttcagacgattgacatgaaccaggataatttttttgaagaggccctcaaaatgcgtaacctgttagagcagtacaactattatcatgggagcagaaaaccaacacttctgggagttagggaacatgttttcactggatcggtctcttcgcttgcttggttcatgtctgcacaggagacaagctttgttacccttggtcagcgagtcctagctaatccgttgaaggttcggatgcattatgggcatcctgatgtatttgatcgcctctggtttttgactcggggtggtttaagtaaggcatcaagagtgatcaatatcagtgaggacatctttgctggtttcaactgtaccttacgtggtggcaatgttagtcaccatgagtatattcaggttggtaagggccgtgatgttggcctcaatcagatatcaatgtttgaagcaaaggtttctagtggcaacggtgagcagacccttagtagggatgtctacaggcttggtcatagactggatttctttcggatgctctctgtgttttatacaacagtagggttctacttcaacacaatgctggtggtcttgacagtttatacatttgtttggggacgcctgtatctagctctcagtggtcttgaggctggtatccagggcagtgctaattcaaccaacaacaaagccttgggtactgttcttaatcagcagttcatcatacagcttggcttcttcactgcattgccaatgattatagagaactctcttgaacaaggtttcctacctgctatctgggatttcttcacaatgcaaatgaatttttcatctgtgttctacacattttccatgggaactaagagccattactatggccggacaatccttcatggtggtgcaaaataccgtgctactggccgtggttttgttgtgcagcacaagagttttgctgaaaattacaggctgtatgctaggagccacttcataaaggcaatagagcttggaataatattgactgtgtatgctgcacacagtgttattgccaagaatacacttgtttacataattatgaatatatctagctggtttctggtggtatcatggattatggctccatttgcttttaatccgtctggttttgattggttgaaaacagtgtacgattttgatgatttcatgaactggatatggtatcctggtggtctcttttctaagcctgagcagagctgggaagtgtggtggtatgaagagcaagatcatctacggaccactggtctttggggaaagattttggagatactgttagatctcaggtacttctttttccagtatggggttgtataccagctgaagatagcaaacaatagcagaagtattgctgtctatctgctttcctggatatgtgtggctgtgatttttggtctgttcgtgctaatgtcctatgctcgagacaagtatgccgcaaagcagcacctttactaccgggttgttcaaactgctgtcatcactcttgtagtgctagtgctggttttgtttctgaagttcacggaatttcaaatcattgacatcttcactagtcttttggcatttattcctactggttggggcttgatttcgatcgctcaagtaattcggccattcatcgaatccactgtggtctgggacagtattatttctgtggctcgtttgtatgagatactgcttggagtgttcattatggcaccagttgcattgctgtcctggttgccgggatttcaagaaatgcagacaagggtacttttcaatgaaggtttcagcaggggcctccagatatcccgtattcttactgggaaaagaacaaatacagtttgaggttctgacccagattgttgcggcggtgaaggtgaagcagcggtgctctatctcctatgtacagcttagcaattcagtgtggaagggctttgtgcttactgatatagcttagatccatattgaactcttccagtagcttttatagctatctagtttaggagtccagatttgtgattttggcaatttaggtattcagttcttttgtacattggttgagctagttgtgtgtagctgattctattgcagcaccaccggtgagctctagtgacctatttgttgacctctgctggaagttgcatcttttgtgctagcaactgtgtcgtgactcgtgagtgctattgctctgctgaaggtataaaagttgctggaaaggatgttcctgg

SEQ ID NO: 70 - DNA, 1555 bp, Zea mays
gggcgtgtgagtgatggacgatcccccaatcctgcgtccaccactcatcactctccccccactcatctctcctgccccgccaccccaccagcgatggccctgtgcgccgccgctgcctccacggccaccgcctccgcgtcggcccatctatcggcctccaccgctcgcccgcggggcccctcctcgacgtcgctgccgtcgtccttcgtcggcgcgttcccgtgcgcggtcgctgcgaggacgaggaggaggcgcgcggcggcggcggcggcccgcgccaccgtcacggtgcgcgcggaggccaggaagagcgtgctgatcgtgaacaccaacggcggcgggcacgccgtcatcgggttctacttcgccaaggagctgctcgccgccgggcacgccgtcaccgtgctcaccgtcggcgacgaggcctccgacaagatgaagaaacccccgttctcccgcttctcggagctgacgagcgccggcgggaggacggtgtggggtgacccggctgacgtcggcgcggccgtgggaggcgcgtcgttcgacgtcgtcctcgacaacaacggcaaggacctcgacgccgtcaagccggtggcggactgggccaagacggccggcgtggggcagttcctgttcatcagcagcgcgggcatctataagccgacggaggagccgccgcacgtggagggggacgccgtgaaggagagcgccggccacgtgggcgtggagaagtacatcgcggagcagttcggcagctgctgggcgtcgttccggccgcagtacatgatcggctccggcaacaacaaggactgcgaggagtggttcttcgacaggatcgtgcggaaccggccggtgccgatcccggggaacgggatgcagctgaccaacgtggcgcacgtccgggacctgtccagcatgctgtcgctggccgtggagaagcccggcgcggcggccggcagggtcttcaactgcgtgtcggaccgcgccgtgacgctggccggcatggccaagctgtgcgcggcggccgcgggcgccgacgccgtggatatcgtgctctacgaccccgccgccgtcggcgtcgacgccaagaaggccttcccgttccgcaacatgcatttctactcggagccccgggcggcgaaggaggcgctggggtggacgagcaccaccaacctgccggaggacctcaaggagaggtacgccgagtacgccgccagcggccgcggcgacaagcccatggccttcgacctcgacgacgtgatcctcgctgccgtcggcaaggcgccggcgagcgtcgccgtatagtatagtataataacacccggccggcaccgacagcgccgcaccacaccatcgtctatactctatactcccggtggcgtccggtttagagatttctctcgtaaaaactaactacgtacgcccgacatgcacgacgtcgcaaacgaacgttacaaaatacgacaaacatttttttttgttttttcgctttggtttttgtacaaggatgaagagaggaaaacatgtttgtccacgactgatcgactgtttgttt

SEQ ID NO: 71 - DNA, 858 bp, Zea mays
gccgcctcttgtttctcttcctcttcctactcggcaatcaccacacgagagaagagaagctagcgttcaacagaggaagaagcgagagagctgacaagaatcgactgccatcaatggctctggcgccggcgcctctccagtgcttcctcacgagcagcagaccggccgtatgcacggcgacgccgcccaataagcgcgcgaggaggccgtcgaggatctcgtgcagggcgtccggcgatgacaaggacaaggtcccgtcgtcgggagggagcgatcttggggtcaagcagctcgggaagctggccatggtcgcgctggccgccggcgtgctggtgctcggccccgtcgacggtgccgtggcggccaagtccggcggcagggtcggcgggcaggcgttccggtccgcgccccggtcgtccggccctcggatcaacaactccaggaccaacatctacatcaacccgccggtggcgccgccgctgggcggatacgggtacgggagcccgttcttcggcggctacggctacggctggtcgccgttcagcttcttcgcccccgggccgagcgtcgccgtcggggtcggcggcggcttcgacacgctcgtcctcttcttggtgctgggcgccgtcgtcggagctgtcaggcggttcctcaacaggaacaacgacgattacgacgactactgattatcagtgccaggctcctgctacgtacttcaccttcgtgtgtaatatatatatgacgaaatttttcccgtgcggaattctaggaacggagtgtactgacgatgcatcaggagatgtatgtaataattttgtccacagtgaaatgtaatgagcatagcgtctatagttaggg

SEQ ID NO: 72 - DNA, 1854 bp, Zea mays
agcgggcccggcagtcccacaagatcacagcacatacgcttcctccattccactcggccgcgaccgcgaccgcgacggcgagcgaggggccgaggtgggacgccgcgccgcttctgcagaaagaaaaaggccaggactcttgatttgctcctcgcgggggttcggtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattggacctaggaggaacgaatttccgcgtcttgaaagtgcaactaggtgggaatgcgaagcatgtcgttgaccgtgactccagagaagtcggcattccgccacatctgatgtcagggagctcctcggagctttttggtttcattgcttctgaattggccaagtttgttgacgatgatgagaagtgcgctaacatttcgaatggcaagaagcgagaaatagggttcacgttttcgttcccagtgaagcagcgttctgtagcttccggtacgcttgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactacgacaaagatgttgtcgctggtgtaatatttggcactggcacaaacgcagcatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggactccacatatttcagcaatgcaccatgacgaaacatctgatctgaagattgtggccgaaaattttgaagaaaacctagagattacaggcacatccttggaggctcgtaagctggtcgttgaaatctgtgacattgtggcgacaagagcagcccggctggctgctgcggggcttgcagggatcctcatgaagatcgggagagatcacagcgtcgaggaccaacggtcagtcatcgccatcgacggaggactgttcgagcactacaccaaattccgccggtgcttggagaccacactgggtgagctgctaggagacgaggcgtccaaggcggtggccatcaagcatgccgatgacggctcaggaataggtgctgccctgattgcagcttcacagtctcagtacaaaaacgacttagtggccgtcaagcatgcagatgacggttcaggagtcaagtatgcagaagacaagcgtgcagatgacggatcagaaataggtgctgccctgattgctgcctcgcaatctcagtagagagatgtccgagtggtatagaggtagcaagtagctatgatttgtttccaacgtcttaactgtccagcgtctgcagtttagcatgctagagctggatgcgatctgtaaccaaaaccaggcttggccaactggctgttcataattccaataacagcagggttgcagatgtctcc

SEQ ID NO: 73 - DNA, 5339 bp, Medicago truncatula
aaattattcacatataaagagagtgaagaaagaaaaaaaatattaaaaataaaaaatctataaaaagaacgaaaaaaaagaatagagagaagggttatctttcaaaccttattagcaacaaggagaggctagaattgctcttgaaatcttgaaaaagtgccaaaagggttttgtaagagaaaaaaaatggccccaaaatcagggaaaggaaaaacaaataaagctaagacagagaagaagaaaaaggaggagaaagctgtggcaccttctcttgttgacattattgtggtaactccttatgattctcaaattgtattgaagggtatctcaactgataagatacttgatgtgaggaagctattggctgtgaaggtggagacatgccattttacaaactattctttatctcatgaggttaaaggtcagagattaaatgacagagttgaagttgttaccctaaagccatgtctactaagaatggttgaagaggattacattgaagaatctcaagcaactacacacgtgcgaagactattggacataatagcctgcacaacaaaattcggaaagcccaaacgcaacataccaggcccagactcatcaaagcccaagaaaaacggaaaagcccataatcaaaataagaacggtttgagcccaccggcaacaccgaatggagaaactcgggtcgggtcaccgacgtcggagccggcatcaccgatatcggagaatgtgggaatggtggcgattcatccgacgccgaagttgtcggatttttatgagttcttttcgttttcgaatctcacccctccgattttgcatttgaagaaatgtgaactgaaggaagaagatgatagaggcaaaggaggttactttcagcttcaggttaaaatcagcaatgggaaagtaattgaagtggttgcttcagagaaaggcttttacagtgttggaaagctgtctctgcagagtcacacattggttgatcttctgcaacagctcagcagaggttttgctaatgcttatggatcattgatgaaagcttttgcggaacgtaacaagtttggcaatcttccttacggactccgatcaaatacgtggctagttgctccatccgttggtgaatctctttcaaactttccacctctacctgctgaggatgaaaactggggtggcaatggtggtggccagggaagaaatggagaatacgaacgtcgaccatgggcaacagattttgaaatcttggcttctcttccttcgaaaaccgaggaggagagggtgatcagagaccgaaaagcttttctacttcacaatcagtttgttgatacatcgatatttaaggctgttgcagctatacaggatgtgatggagtccaagtctagtatgaattcttctccgggttctgttatgcatcaagatcaagtgggagacttatccattgtagttgaacgtggtggaaatggaaagtttgattctacactgaatgaatcgagtaagcaaagtgacgatgttcagaagaatttaatcaaagggttgtctgctgatgaaagtgtcacggttaatgacacttcttccttggctgttgttgttgttcatcactgtggatatacagctacagttaaggccattggtaaagcgaacacaaggaaacctaaagttcaggatatcgaaatagatgatcaacctgaaggaggcgcaaatgctcttaacatcaatagtttgagggcactgcttcacaaatctggagttgattcatcagaagggactttgacttccttgtcaaattttgatgatttggatgcttctaaatatcttgttaggaaggtggttgaggaatccatcgaaaagataaaggaagagccaagtgtatcaaaacggtcgattcgatgggaacttggttcttcatggatgcagcatctgcaaaaacaggaaaattcaaccgatggcagttccaataacaacaaggatggaagtgatgttgagccagccgtgaaaggtcttggaaagcaatttaaattattgaagaagagggaaaagaaaccaagtgacttaaatggtgcagattctgtggagcaaaataacgatgagccaaataatgatgaaccaagcagtttgaatgaattagagacactactttctccagaagcctttttgcgtctcaaagaatccggatctggtcttcatctgaagtcagtggatgagcttataaacatggcacacaagttttatgatgaagttgccttgccaaagctggttacggactttggatcacttgaactttctcctgttgatggtcgtacacttactgatttcatgcatttaagaggattaaagatgggatctttgggtgaagtggttaaactttcagagaatcttccacacatacaatcactttgtattcatgagatgattactcgagcattcaagcatttatttaaagcagtcattgcttctgtagacaatgcagcagatttaccttcagtcattgcgttgaccctgaattttttacttggagggtgtcaaactgaagatacagaccaaactttgggtgatgatcatcatctcaaaattcattggttacgtatgtttttgtcaaaaagatttggatggacattaaaagatgaatttcaacatttgagaaagttatctattctcagagggctctgtcacaaggttggattagaattgttccctagagattatgacatggagtcccctaagccctttggaaagtttgatattattagccttgttcccgtttgcaagcatgtgggatgctcctcaatagacgggcgcaatttgttggaatcatcgaaaattgctcttgataaaggaaagcttgaggatgctgttagttatggaacaaaggcattagcaaagatgatgactgtttgtggtccatatcatcgaaatactgcaagtgcgtatagtcttcttgctgtggttctctaccacacaggagattttaaccaggccaccatttatcagcaaaaggcgttggatataaatgagagagagcttggacttgaccatcctgacacaatgaaaagctatggagatctttctgttttctattaccgtctgcaacatattgagctggctctgaagtacgttaatcgcgctctcttcctcctacatttcacatgcggtctgtctcatccaaatacagctgctacatatataaatgttgctatgatggaagaaggcatgggaaatgttcatgtggcacttcggtacttgcatgaagctcttaaatgcaacaaaagattgttgggagcagatcatatacagactgctgcaagctatcacgccatagccatagcactttcattgatggaagcatattctctgagtgtgcaacatgagcaaactacacttaagatacttcaggcgaagcttggcgcagaagatcttcgaactcaggacgcggctgcatggctagaatattttgaatcaaaagctatagagcagcaagaagcagcaaaaaatggaactccaaagacagacacatccattgcaagtaaaggtcaccttagtgtgtcagatctcctggattttattagtcctgacaacgattcaaagggaaatgatgctcaaaggaaacaaaggcgtccaaagatacttccaataagcgataacaattctcaagaacacgatgacactccaatagttgatgatatcgttattgttgacaatgcaaaagatgctgcaaaagcagtagaaggcaaaatagaagaaccaaaagccaaacatggaacagaagaacccaaaaaaattgttgatctcagcatgcacaagccagtggtgacagttgaagctgtgtatgagacatcatctgatgaaggttggcaagaagccaattcaaaagggcgttcaggtaacgctgctaatcgcaagtctggacgcagacaacggcctgttctatcaaagctcactgttaaaggttctgataatcacatgtacaaggaagccagttacaggaatgacactaccctgcaccaaaaagcagctccaaaagtagcttcagctatgttatctccatctagaaaatcaaaaaccccaaaagctttgtcatctaaaatttcatcaactccagcatcattgagttctttggcctcaaaatctatatcttacaaagaagtcgctgctgcaccaccaggtacagttttaaagccactgttggaaaaaaccgagacagaaaaggtaaatgatgaaaacgagatgccgaaaaatgaaggttctgttgaaacatctaatgctgatacagttccacaaaaagatgaaaaagaaccttctgatgctgatacagatccacaacaagatgaatctgaacaagataactcttcatcagaacttgagaaggtttccccttcatctgatcaagcaaaatcttctgaaacaaatggaagcaagctttctgctgcagccaaacctttcagtccaggaacgttgtctgcatctcgccatttaaatccagttcctcctgcgagcatatacgatgcaaatgtgagtccaggcattcttgtagagcccgttcttcctcctgctgctgccagggtcccttgcggccctagatcaccgttgtattacagaaccaattatactttccggatgaaacacagttcgaccaagataagggaaataagtggatcaggtggtccaaaaattatgaatccacatgctcccgagtttgttccaagaagtgcttctcaaatagaaactagtgaaaagaacagtacttcaaaaaacagtctttctgaatccgaaaagtcagagatagcaaggcagatattgctgagttttctagtgaagtctgttcatcaaaatgctgatgccgtggatgagcctaaagttagtgaaggaaaagttgagagctttgaaaactcttctgatgaagtagctaaagacagtgctgtcataaaaataatgtacggtactgaggaaaagaataagacagtggttaattccagtgacgacagtgaagagcaggacaatttagatggtgaaggatttgtagttgtcacaaacaggagaaaaagcaggcaaaaaaccacaaatggagtcgctgaattgtacaaccagccgtcaatttgtgcttcggttcgttgattatagtcatgaaattaatcaccaatgatccaaatttgtttgctttgtatggacaaagctcttgacatcattttgttaatagtatgtgacctctttccatagaattttggtcatcaaattcattttgtttttgtttatataataagttaattagggttttgtttttgctctctatataataagatacttgcaaattttgttttgccaataaaaagctgattggtaatttcacttaa

SEQ ID NO: 74 - DNA, 1116 bp, Medicago truncatula
gccccaatatcatagccttgaaattcttcacatcacattcattcatcttctacttcactttcctaccacacttccaataacccttctcttctgttgtcctaaattgacaatagaacattgtagtatactctctgaactaaatggcaaccaattctcttcactcaattcaacatcattctctcagcaaacgccactactacccttctgaaactgctcctccatccacactttcatcctcacttttcctcaaaccaaccaccatcaaccccaccaacataaccctctcccactcttcctcttccaactcctctatcacattttctatctcccaaacaacatcctccacaccatcatcaacctctcaaaccagctcctttgaactcctccagcagcatctctcagccaaaaacttccgagaagccgacgaagagacaagacgtcttctcatcgttttagcaggcgaagcagctcagaagcgcggctatgttttcttctcagaggttcagttcatctcagaagaagacctcaaaacaattgaccagctgtggagagatcatagtgacaacaaatttggatacagtgtccaaaagaaactatttggtaaggctaaaaaagacttcaccaagttcttcatcaaggttggttggatgaagaagcttgacactgaaatggagcaatataactataggtcttttcctacagagtttatatgggagctcaatgatgacactccagagggtcatttacctctgacaaatgcactcagaggaacacagttgctaagctatatttttaaccatccagcttttgattcagtcccagacgaagttgaagtttcatttggcagcactgagggaaatggagcactcaaagggttaaaagattcatctaaaccattggctaccaagatcttcaaaacagactatagtttctgatgagttcagaaaacttcacaataaacttgctgagtgcgtagagaatgtaacttaatttgtgttttaatttttacgtatatacatagtaattgttcattcatcatcaatagatgaaggtagttacttgaattgtattttttctctttacttaataatgatatttgcattttagaaactcatt

SEQ ID NO: 75 - DNA, 1426 bp, Medicago truncatula
gtgtctgaaagctagcatcgtgtttatctctgaaaatccagaaatggcagcaacattgcaaactccgctctatgcagctatctcctcttctcctgcatcatcatcatcatcatcatcttccattcgaacaacaacatcattctccttcttccgttctacaccgccaccaactctcctcttcaactccaaaaactccttctctttaattcgcgcttcctccactgacactgttatcactgaattggatgctgtttccgctttcagtgagatcgttccagataccgttattttcgatgatttccaaaagtttcctccaactgctgctactgttagttcatcactgattttggggatatgtggtcttccggatactatttttaggaaggctgtggaaatggctttggctgattctgaatgttatggacttcaagatcctaatgcaagattatcttgtttcgccaccaaggctttagtgaatgttggtagtgacatgacaaagcttgtccctggccgtgtttcaactgaagtggatgcgcgtcttgcttatgacacacatggcattatcaggaaggtgcacgacctgttgaagttgtacaatgatagtaatgtccctcatgaacgtctgctatttaaaattccttcaacatggcaaggaatagaggctgcaagattgctggaatcagagggcatacaaacacatttgactttcgtttacagctttgcccaagctgctgctgccgctcaagctggtgcttctgttattcaaatttttgttggccgcgtcagggactgggcgcgtaatcattctggtgataaagagatagaatctgccaagctaaatggagaggatcccgggctggcattggtcacaaaggcttacaattatattcaccaatatggacataagtcaaagttgatggcagcagcagttcgtaacaagcaggacctatttagtcttctgggggttgactacatcatagctccattgaaggtgttgcagtctctcaaagaatccgttgcttctggtgatgagaagtactctttcgctaggaggttatcaccgcagtctgctgaccgctacatgtttagtgatgaagagcttgttaaatgggaccaaatgagccttacaaatgccatggggccagcagcagtgcagcttctgacttctgggctggatggttatgctgatcaagcaaagcgggtggaagatttattcgggaaaatttggccaccaccaaatgtataattttacctcttacgatgtttaggctgatggaataaacagaacatacagcagatggagggaatcttctgtttgctttgtcatttctctcatgaactctggaacattttcagtttttttccatgtaaagcacccagttccttaaaagcaaaatttattatctttaagacaatttgctattgt

SEQ ID NO: 76 - DNA, 1969 bp, Oryza sativa
ctcaaatccggcccagtctaccgccttgcgtgctcgtttactcctccgtcgatttccactttcgccaaacctcgcggccgtcgagctccgccgccggagaaaaagatggccgacgacagcgcctccccgtcgccgtcctcggcctcgccgctccagcaccaccgcgaagccctcaagtcgtcagtgcgcaacacggcagctagccggaggcgggaacaagctattgcgattgggaaggaaagacgggaagccttgatccgtgcaaagcgtgtgtgtcgagctccaatttctggcagtgatgaagctgaaatggaagagggtgatatggtggtcgatgaggagaaagcatgtcttgaggcaaagactgctcatgctgttgaagaattgaaatctgctttgtcaatccaggggaaaggcgttcagaagaagaagatagaggcgcttcgtgatttgagacgcttgttgtcacagcctgaagtacctctagttgatactgcaattaaagctggagcagtccctcttttagtgcaatatctatcctttggatcatcagatgagcagttgctagaggcagcttggtgccttacaaacatagcagctggggaaccagaagaaacaaaatccttgctgcctgctctaccattgcttattgctcaccttggtgaaaagagctccacacttgttgccgagcaatgtgcatgggccattggtaatgttgctggtgaaggagcagagctgagaagcacattacttgcacaaggtgctttgcggcctcttacccgtttaatgttctccagtaaaggttctacagcaagaactgctgcttgggctatgtcaaatctcatcaaggggcctgatccaaaggctgcaaatgagcttattaccattgatggcgtgctaaatgcaattatagcgagcttggaaaaggaggacgaagagttagcaactgaggtggcatgggttgtggtctatctttcagcactttcagacagaggtattagcttaatagtaagaagttctgtgcctcagctgctgataggacgactgttctcatctgagaacttgcagttgctgatcccagtgcttcgtggtttgggaaatcttattgccgctgatgactacatggttgattcagtcctaactgttggacacaatatcattgatcaagcattgtcaggtcttataaaatgtttgaagagtgataacagggttctcagaaaggagtcatcatgggcattgtcaaatatagcagcaggcagttttgagcacaagaaactgatttttgccagtgaggccacgcctgtgctgatacgccttgtcaccagcatgcaatttgatattcgcagggaagcagcatacaccctaggaaatctgtgtgttgtccctactggaaattgcgaactcccaaagataatcgtggaacatctagtcgctatcgtagatggtggagcccttccaggatttatacacttggtcaggtctgctgatgtagataccgcagggcttggtcttcagttcctagaactggtgatgagggggtatcccaataagcaaggcccaaagcttgtggaaatggaggacggcattgaggccatggagaggtttcaattccacgagaacgagcagatgaggaacatggccaatggtttggtcgacgaatacttcggtgaggattatggcctcgacgagtgactcaactaattaccattcgtacatcaggttaaattgtaatggcagcagctgttcatgtgttcgtactgtaaaaatgcattctcagtttctaacagcactggaactttagaatgagaaaatcatttgcttgttactgttcgtcttactgccacttgttgacgtaatttggaaagaaaaaaaaggttgcattagcatcttgttatgtataattagattgtaacacaatgctagacatatttgctggttacagtagcagaacactttactttctttgcaa

SEQ ID NO: 77 - DNA, 918 bp, Oryza sativa
gaaaagagagagcagcagcgagagacgaacaaaaaacagaatccatcgccataatcgaaggttcgctcttgcttccaccccgcaatccacatggagaacgaattccaggatggtaagacggaggtgatagaagcatggtacatggatgatagcgaagaggaccagaggcttcctcatcaccgcgaacccaaagaattcattcatgttgataagcttacagaactaggagtaatcagctggcgcctaaatcctgataactgggagaattgcgagaacctgaagagaatccgcgaagccagaggttactcttatgtggacatttgtgatgtgtgcccagagaagctgccaaattatgaaactaagatcaagagtttctttgaagaacacctgcataccgatgaagaaatacgctattgtcttgaagggagtggatactttgatgtgagagaccaaaatgatcagtggattcgtatagcactgaagaaaggaggcatgattgttctgcctgcagggatgtaccaccgctttacgttggacaccgacaactatatcaaggcaatgcgactgtttgttggcgatcctgtttggacaccctacaaccgtccccatgaccatcttcctgcaagaaaggagtttttggctaaacttctcaagtcagaaggtgaaaatcaagcagttgaaggcttctgagggttttgttgggctcctgcactgcggttctatattcaacctgaataagatgtgctatagcaatgtaaatttagcacagtggctatggtcgccactcaccaacttgaagtgaaagatttaatgatttttgttaattcttatgtatcaatcggcatatagcatttccgaaatgtgttttcaataaacagaaagtaagagtcatgaagctgaaaatgaacaaaatttctc

SEQ ID NO: 78 - DNA, 2007 bp, Oryza sativa
gtaaatttatacacctccaagcctccaacttgaatcaccctatctgcatagcatactgaaagccgaagcagggggaaggagagcgatcggcaaagtcggtcaaagggagagtgacagagtgacagtgtataagtagtggctggttggttggttgcagcactggttcggtgtgagcgagcgagcgagatagccatatcttcgctgtgcgtcgtcgtcgtcgctgcgtggtgaattcttggggaggaggaggacgagatggcgggaggcggcgtggcggcgctgggggtgaagaaggagcgggcggcggagtacaagggccgcatgacgctcgccgtcggcatggcctgcctcgtcgccgccgtcggcggcgccatcttcggctacgacatcggcatctccgggggagtgacgtccatggatccgttcctcaagaagttcttcccggtggtgttccggaagaagaacgacgacggccagaacaactactgcaagtacgacaaccagggcctctcggcgttcacctcctccctctacctcgccggcctcgtctcctcccttgccgcctcgccggtgacgaggaactacggccgccgcgccagcatcgtctgcggcggcctcagcttcctcgccggcgccacgctcaacgccgccgccgttaacctcgtcatgctcatcctcggccgcatcctgctcggcgtcggcatcggcttcggcaaccaggccgtgccgctgtacctgtcggaaatggcgccggcgcacctccgcggcgcgctgaacatgatgttccagctggcgacgacgctgggcatcttcacggcgaacatgatcaactacgggacgcagcacatcaggccgtgggggtggcggctctcgctggggctcgcggcggcgccggcgctgctgatgaccgtcggcgggctgctcctgccggagacgcccaacagcctgatcgagcgcgggcgcgtcgaggagggccgccgcgtgctggagcgcatccggggcaccgccgacgtggacgccgagttcacggacatggcggaggcgagcgagctcgccaactccatcgagcacccgttccgcaacatcctggagccgcgcaaccggccgcagctggtgatggcggtgtgcatgccggcgttccagatcctgacgggcatcaactccatcctcttctacgcgcccgtgctgttccagagcatgggcttcggcggcagcgcgtcgctctactcctcagtcctcaccggcgccgtcctcttctcctccaccatcatctccatctccaccgtcgaccgcctcggccgccgcaagctcctcatcagcggcggcatccaaatgatcatctgccaggtgatagtggcggtgatcttgggggtgaagttcgggacggacaaggagctgacgaggagctactcgatcgcggtggtggtggtgatctgcctgttcgtgctggcgttcgggtggtcgtgggggccgctggggtggacggtgccgagcgagatcttcccgctggagacgaggtcggcggggcagagcatcacggtggcggtgaacctcttcttcaccttcgtcatcgcgcaggcgttcctgtccctgctctgcgcgctcaagttcggcatcttcctcttcttcgccgggtggatcaccgtcatgaccgtcttcgtccacgtcttcctgccggagaccaagggcgtgcccatcgaggagatggtgctcctatggaggaagcactggttctggaagaaggtcatgcccgacctgccgctcgaggacggcgacagtcatcacaagtgaaagaaatgtactctgagatagtatatgggggttacagtagatgagacatgacatgtaggatgaggagattaagattgatcatgtgcggtaatgcattctgtgtgtatgttaattgaagttcatggatcatgatgtctgtttgtcgtggcagagaagagaaatattggaaacacaaaattttatactactcgattattaattgtctgaatcctcgtg

SEQ ID NO: 79 - DNA, 2647 bp, Sorghum bicolor
cacgccccgtcggcccgtcccaagttattaacctttttttttctgtgacttgtcccaagttattaacctctcgggctcgggcacttcccttccccgttggtccgctcgaccgcctccgccgctgccttgctccctccgcgcccaccacggagcgcacgcgcgggcgcagcctccctcgcgcgccgcgcctccccttcccactgctctgttctcccgcccgcgcgcgctcctcctcctcctccacctcctagggttagggcacgcgtcgcggggggccgcggcgcctggcccaatgcggaggtcgtcggggcccggcacgccgtgccgccgccgcgcgatccaggtgctcgtggcggtctccctcgcctacgcgctcgccgtgctgctcctcgagtcgccgctcgtgtccacgtccctgcccggggcgggggcgtccgccgcggcgtcgcggaagctccacctcgacggcgcgtgggagggcgtggggcgaaccgcgccggcgcgccccgggaagcacccgcacagggagaccctctcggcggacgcgtggtggggacgggcacgccggttggcggggatcgtctctggcctcgagctccgccacctcaactccacccgctccggctcgctccgcaaggtcgccgccgaggccgccgagtcaggggcccgcgtgttctccggcctggaggctctagcgacgaccctggcgtcctcgcgtgattcctcaggggaggaagagaagagcaagtgcccgcactcgatcgtcctcagcggtgacgagttccgggagagggggcggacggtggagctgccgtgcgggctcacgctgggttcgtatatcacggtcgccgcgacgccgcaccaggcgcaccctgagcgggatcctaagatcacgatgctcagggagggggaagagccgatcatggtgtcgcagttcatgatggagctgcaggggctcaagacggtggacggcgaggatccgcccaggattctccatttcaacccccgcctccgcggcgactggagcggcaagccggtgatcgagcagaacacctgctaccgcatgcagtggggcactccgcttcgctgcgagggctggaggtcccgtgccgacgaagagactgtggatgggttggtcaagtgtgagaagtggattcgggatgatgaaggacggtcggaggagtcaaaaacgtcatggtggctgaaccggctcattggccgcacaaagaccgtctccgttgattggccatacccattcgtggaggaccgcctgtttgttctaactctcactgctggattggagggttaccatgtgaatgttgatggacggcatgtgacatcatttccataccgcactggatttgttcttgaggatgctactggcttatcattgaatggggacctagatgttcaatcagtgtttgcggggactctgcccaccacacatcctagcttttctccacagaaacacctagagatgttgcccagttggcaggcccctccccttccagacgaaccagttgagattttcatcggtatcctgtcagcaggcaaccattttgctgaacgtatggctgcgagaaagacatggatgtctgctgcccagaagtcatcgaatgttgtggcccggttttttgttgccctgcatggcagaaatgaagttaatgtggagctgaaaaaggaggctgagtttttcggcgacattgttattgtgccattcatggatagctatgatttggttgttcttaagacaattgccatatgcgagtatggggtccatgttgtatctgctagatacataatgaagtgcgatgatgatacttttgttagacttgattcagtaatggctgaagtgaagaaaatccagaacggtataagtctctatatagggaacatgaattatcaccacaagccattgcgcgatgggaaatgggctgttacttatgaggaatggccagaagaggattatcccatctatgcaaatggtcctggatatgttatatcctctgacatcgcagattctattctatcagactttctaaaccataaattaaggcttttcaaaatggaggatgtgagcatgggcatgtgggttgagcggttcaacaacaccagatttgttaaatacgtccacagcgtcaaattttgtcaattcggatgcatagatgattattacactgcacattaccaatcaccgaggcagatgttgtgtttgtgggacaagctacaggctggaaaagcccaatgttgcaatatgagatagcgacaatggaggtggtggtactggtaggcccatccttattcacgaagaagttgagaacctagaagcctcgagactaacttaaagaatgttggctgaaaataaattaagccctcgagatgactaacgaatggccatttaaaggatttcttttggtatagctgaccaggcggtgtttcagctggaaatggaaacaaggggaatggacagcagcctgtaacccctttcctgattgagcatgcggcgcacttcttttctcaacgtatagatggagttctgtgagcagtatgagacctgcttggggacttgatttgtaaatgggacgggtagaaagcttagttaaatatctgttacttttggcatgattggctgtggttgcagtcatag

SEQ ID NO: 80 - DNA, 1132 bp, Sorghum bicolor
caccagtcgcccgccctcctccccaggcaaagctgcactagcgcactaaaaactcgaagagttcggtggtgaccacggcaccgtgcaccgacgggtgacacctgctaagtgctgaaccaaccgtgagccagccagcgaccgacgacactagctagcataggaaccagcaatggctccgcgtgatctccttctcctcctgctcgccgccgtgctgctcccatcgtcgtccacggcggcggacccggacgcggtgcaggactactgcgtgccagaaacgggcgcgggggcgcgggatcgtgccgtgccggtggatctgtccctcctcccgtcctacccgtgccggagccccgcgaacctgacggcggccgacttcgcctccgcggccgtgcgcgccgcgggcaacttctccgccgacaccgggttcgcgggggtgtcggtcacccccgcgacgttcccggcgctgcacaccctgggcatgtccttcgcgcgcgccgacctgtcggcggcgggcggcgtgaacccgccgcactaccacccgcgcgccacggagacggcgctcgtcctgagcggccgcgtctacgcgggcttcgtcgacacgggcgggcgcgtcttcgccaaggtgctcgagaagggggaggtcatggtgttcccgcgcgccatggtgcatttccagatgaacgtcggcgacgagccggccacggtgtacgggagcttcaacagcgagaaccccggcatcgtgcgcatcccggccaccgtgttcgggtccgggatcaaggagggtgtgctcgagagggcgttcgggctctcgccggaggagcttcgccggctcgagaagaggttcgggcctcccaagaccaagacggcggagatggatgattaatctgtagatcaggcatgatttaattaattatactaagagcagaagactttgtgatctggaatgtatgtcttttcatttgttaatgtctgtatgtatggatggattatttggcggtggacggtggttattatggatcgataatgctggtacagatgggatgggtagttacgtgtcacattcaagtgtctatgagatgtttattatgggctatatatattgttaataaagcagggcgactttgttggttgtgga

SEQ ID NO: 81 - DNA, 1741 bp, Glycine max
actctctgcttctaactttaaaaaactcgaacactctgtctttctttgcatggacattaacaataacaaatgagttccacaactatgttgttgttggtcgtgttcatgattctatgtatttcatgcccctcatttcaaatggtactctttgcctctaacacacactctttcccaaacccaattcaacaacacccaccacctcctcaaatctacctcaaccctttccgccaaacggttccgccgccaactctccctcccactctccccgggcagcgactacactctctccttcaacctgggcccacgggcccaagcccagcccataacactctacatggacaccggcagcgacttagtctggttcccctgcgccccttttaaatgcattctctgcgagggaaagcccaatgcctctccccccgtcaacaccacccgaagcgtcgccgtttcatgcaagtccccggcatgctccgcagcgcacaacttagcctctccctccgatctctgcgccgccgctcgttgtcctctcgaatcaatcgaaacctccgattgcgcaaatttcaagtgtccaccgttttactacgcatacggtgatggaagcttaatcgcgcgtctctatcgtgacacgctttctctctcttctttgtttctcagaaatttcacgttcggttgcgcttacactaccctcgccgaaccaaccggagtcgccggattcggtcgcggtttgctctctctcccggcgcagctggccacgctatctcctcaactcggaaaccggttttcgtattgtttggtttctcactcgttcgactcggagcgagtgagaaaaccgagtccactcattctcggacgttacgaggaggaggaggaggaggagaaggttggtggtggagtggcggagtttgtgtacacgcctatgcttgaaaaccctaagcatccttatttttataccgttggcttaatcggaatctccgtcgggaaaaggattgttccggcgccggagatgctgcggcgggtgaacaatcgaggcgacggcggcgtggttgtggattccggcacgacgttcacgatgttgccggcggggttttataactcggtggttgacgagtttgaccgcggagtcgggcgagtcaacgagcgcgcgcgtaagattgaagaaaaaacgggactcgcgccgtgttattatttgaactccgtggcggaggtgccggttctaacgctgcgttttgctggggggaattcgagtgtggtgctgcctaggaagaactatttctacgagtttttggacggtagggatgcagcgaagggaaagaggagggtggggtgtttgatgctgatgaacggtggagatgaggcggagctgagcggtgggcccggggccacactcgggaattaccagcagcaggggtttgaggttgagtatgacctggaagagaagcgcgtggggttcgctagaaggcagtgcgcgtcgctttgggagagactcaatcgcgacaaaaactagcgtatgatatggtgcactgcacacactggatttccctcccctgctttctgtcacgggtcgggtctttctgtaaattgaaataaggcgtgctttggggccatgcgcttgtgtgtctacttaataggaaaagttgtacactattcttttaaaaagcctgaattgtattgtaaaaattgtaagtaaacataaatcgtttaagaatagtatttttaagtgctcgaattgatgtagtacttt

SEQ ID NO: 82 - DNA, 2092 bp, Glycine max
tttttttttttttttcttatccctaccacaacacaagccaaaacccaaaccttcaccttcgctcgccactccacacgccattgcaagccccgtgctttctcgctccttcacgttccacactcaaaactcgaaaccccacttacccaactctcttaaagttcacaaatttcccaaaattttcgacccccttttgcttccaaaatccactaccagtcctcctatcaccactgatttcaaccgttgttccatagcttggaaggcagaagaagatggagaagcttaacttggcactcgtttcttccccaaagcctttgatgttgggacatgttcctgcaagagacgttttcagaagaaaacacttctcttttgggagggtcttaattgctcctcaccgctgcagattccgtgtttctgcactctcttcctcccatcataaccccaaatctgtgcaggagaagctgatagtaaagcattttgctagtatttcttcttcaaatactcaagaaacaacatcaattggagttaagccacaattatcaccatctccatcttcaactatagggtcacctctcttctggattggtgttggtgttgggctttctgcactgttttcagtggtagcttcaagactgaagaaatatgcaatgcaacaagctttcaagaccatgatgggtcagatgaattctcaaaataaccaatttggcaatgctgccttttctccgggatcaccttttccctttccaatgcctacagcagcagggcccactgcacctgctagttctgcaactactcaatctcgagcaccttcagcatctagtgcatctcaatccactatcacagtagatttacctgcagcaaaagtagaagctgctccaactactaatgttaaagatgaagtcgaactaaagaatgaacccaaaaaaattgcttttgtagatgtttctccagaagaaactgtgcgggagagtccttttgaaagttttaaagatgatgaatcaagttccgtcaaggaagcttgggttccagatgaagtttctcaaaatggagctccctctaacctaggttttggtgattttcctggttctcaatctacaaaaaaatcagccttgtcagtggatgctttggagaaaatgatggaggacccaacagtgcagaagatggtttatccctatttacctgaggagatgaggaaccctactaccttcaaatggatgctgcagaatccacagtaccgtcaacaacttgaagaaatgctaaacaacatgggtggaagcactgaatgggacaatcgaatgatggataccttgaagaattttgaccttaatagtcctgaagtgaagcagcaatttgatcaaattgggctttctcccgaagaagtcatttcaaagattatggccaatcctgaagttgcaatggcatttcaaaatcctagagttcaagcagctatcatggattgttcgcagaatccaatgaatattactaaataccaaaacgataaggaggtaatggatgtcttcaacaaaatatcagaactcttccctggagtaggttcaccttgatgcatttgtgtgttgttgctgttttctgggtcaagttatgcatccttttcctgatgacctaagacattattagctccggcctaaccacacggaacaatgcaaaactcttgtgtgctcatatactgcaggctcgcagttacagctccggatagtaactgtcttccctgggctaaaataatgccaaagttggattttttgtttcactaaaaatagttgagattgtgtatattgatgttttatgttttcattaaatattttgtttgaggcattgtatttgcagtttggtttttgagtattcaggtgccataaaaatgtgaatgcttcacataattgtaatactgcatgagattaaactaaacatgtaagcgaccaaataggtggcaacggtcaaatagtcatagtgaaccgtgtaatcaaagggatattcgttgtagtagttaatgtcagtgtttttgatgattttagtaatttgaagtttgactgtactttcaagcgttcttgtacctgtcgcagttgactggttggtagatgca

SEQ ID NO: 83 - DNA, 1204 bp, Glycine max
gagacaaattgagaagaaaagtcttcaattgtgactcctcaacccacttgattcaccccaactcaataattttagccaccagtgtgtagataacttaagccaaaacaaccaaccaattcttttggataccaccttccatatattgatactgcaaaatatagttaaatttcattccgaaacaatgatcaacaaagtagcagttctattagttgttttgcttttcatcattgctgctttggcttctgatcctgatccagtaatggacttttgcatagccaaatcaccagacaatagcttcagttgcaagaactcatctacagcaacagtggaagatttcacctattctggcataaagtctcctgggaacttcaagcaaactggattctcttctatggcagtgaattcaaatgtctttccgggtttgaacactcttggtgtgtcatttgtgcgagcagattttggtgttggcggcgtcaatgtgccacacttccatccaagagcaacagaggttgcttttgtgctggaaggaaaaatttattcaggatttgtggacaccaacaacaaggtttttgccaaagtgttggagaaaggagaggtcatggtgttcccaagaggcctagtgcactttcagatgaatgttggagataggcctgctaccattttgggcagttttgacagccaaaatcctggcctgatgaggattcctaatgcagtttttggttctgacataaaggaggagcttttggagaaggcttttggactgagttctaaggagctttccaagttgaagaagaggttttctcctagttaaaatgcattttctgtttatggagacagtggaaaatttaacatgatacctattattgcagaatattgctgatgattagttgaaaatacacccatcaatagaaagctattggattgatttgtagttaataattttttttaataattcagcctttcttacttaaagggctgattttagagctagagttatttagtatagaagttattccattttaaaatttcacttcccttcagttaaggaaggagcttaagaggagtttgaactgattagaactttatttccaacttcttgcttttgtcttctgaacatattctaaagtcaatgcagtcattgacatttggttcaatcatacacgtttggcacaaaagctaaaaatcaaaggagtggttgtgggca

SEQ ID NO: 84 - DNA, 3216 bp, Solanum lycopersicum
aatattcgcattaacccttctctctttcttagcctgaaagctcccttcctctttctccctctcctataacacatccgccactctattttactctataaatactctatctttcaattttaaccacatttcaaatttcagaatctaatccttcatcgctcctcttcaatttcagactagcagaaacactttccgcacggtgtttcagaatctaaacaatcatcgatctctgctttaatttcagggacatcataactctattaaattcatcataggtggtcttgttctagacagatgccagggaacaagtataccggcaaccaagcggttgctagcactcgattggagaggctattgagagaaagagagcttaggaaaagtagcaaagtttctcactttccaaatgaatctactgataacaataggggaaacgagctctctgaccatgattttcgccaaggagaagctgataatggaggagtttcatatgtcgaacagtacctcgaaggagctgcactagcatataatgaaggatgggagcggcctgatggaaagcccaccagacaacgactcttggttgtggcaaacaggttacctgtctctgcagtaaggagaggcgaggaatcctggtctctagagataagtggtggaggtcttgttagtgctcttcttggtgtgaaggagtttgaggctagatggattggttgggcaggtgtgaatgtgccagatgaggctgggcagagggcacttactaaggcactggcagaaaagaggtgtatccctgtattcctggatgaagaaattgttcatcagtattacaacggttactgcaacaatatattgtggcctcttttccattatcttggacttccgcaagaagaccgccttgcgactaccagaagtttccagtctcagtttgctgcttataagaaagcaaatcaaatgtttgctgatgttgtgaatgaacattacgaagaaggtgatgtggtatggtgtcatgactaccatctcatgttcctgccaaaatgtctcaaggattacaacagccaaatgaaagtcggttggtttctacacacaccctttccatcctcggaaatacacaggacactgccgtctagatcagagctgctccgagcagttcttgctgctgacttggttggttttcatacctatgactatgcaaggcattttgttagtgcatgtactcgtatcctgggacttgaaggaacacctgaaggagtagaagatcaaggtagactgacccgcgttgctgcgtttcctattggtatagattcagaacgatttattcgagcacttgaagttactcaagttcaggaacacataaaagaactaaaagagagatttgctgggagaaaggttatgctaggagttgatcgccttgatatgattaaaggaattccccaaaagatcctggcatttgagaagttccttgaagaaaatccgtactggcgtgataaagtggttttgcttcaaattgctgtgccaacaagaacagatgttcctgaataccaaaaacttaccagtcaagttcatgagattgttggacgcatcaatggtcggtttggaactttgactgcagtgcctattcatcatctggaccgttctcttgactttcatgcattatgtgcactgtatgctgtaactgatgtagcgttggttacctctttaagagatggcatgaacctcgtcagctatgaatttgtagcctgccaagagttgaaaaaaggggtccttattctcagcgaatttgctggtgctgcacaatcgttaggtgctggagcaattctggtgaatccatggaatataacagaggttgctgcttcgattgggcaagctttaaatatgtcagctgaagaaagagaaaaacgccacaggcataactttctgcatgtgactacgcatactgctcaagaatgggctgagacttttgtgagtgaactaaatgatactgttattgaagctcaacagaggataagaaaagttccgccccggcttaacatcagtgatgcaattgagcgctattcgttttccaataatcgactactaatattgggtttcaattctacactgacagaatcggtggatacccctggaagaagaggtggagatcaaatcaaagaaatggaactgaaattgcatcctgagttgaaagaatcattgctcgcgatttgtaacgacccaaagacaacagtcgttgtcctcagtggaagtgatagaaacgtcttagatgataacttcagcgagtacaacatgtggttagcagcagaaaatggaatgtttttacgatctacaaacggtgtatggatgacaactatgccagaacacctaaacatggactgggttgatagtgttaagcacgttttcgagtacttcactgaaaggacaccgagatctcactttgaacaacgtgaaacttcacttgtttggaattacaagtatgcagatgttgaatttggaagattgcaagctagagacatgcttcagcatctctggacaggtccaatatcaaatgcatctgttgatgttgtacaaggactccgctccgttgaggttcgagcagttggtgttacaaagggagcagcaatagatcgtatactgggggagatcgtacacagtaaagccatcgcaacaccaattgattacgttttatgcatagggcattttctggggaaggatgaggatgtatatacattttttgagccagagcttccttctgactgcatcggtatgccaagaagtaaggtcagtgatgcaccaaaggtgcccggggaaaggcgatcagttccaaaactcccttctagtcgaactagctcaaagtcatctcagaataggaacagaccagtttcaaactcggataagaagacttccaatgggcgacggccctcacctgaaaatgtgtcatggaatgtgctggatctgaagaaggagaattacttctcttgtgcagttggaaggactcgtacaaacgctcggtatctgctcagtacgccagacgacgttgttgcttttctaagggaactagctgaagcacctatttcaaatgggacatcatgaaaaagaaggatagatgatgcctggttgcatcaagtgatgaatgatcagtaccaagttcttggttgagggagatttgtatgggatgatattgaataaacgttttatacctttactttggatatagatgtttgcattcaaaagttt

SEQ ID NO: 85 - DNA, 2337 bp, Triticum aestivum
cggcccctcgacccagccaagcgccccgcagcaacaaaaaatccactctacatcactcacgctcgccgcccgcgtctctttaggctcctccggcgatgtcggcggccgtgggcggcgccgagttccacggcttcggcggggcggcgcagctcccgcggtcccggatgctcggcaggcccgtcagggtggcgccgccaggggcgacgccggctggcggcggcgggccctcggcggccagcattcgcgccgtctccacgcctctgaagaaggatgcaaaagaagttaagcgaagcaaggtggagataatcaaggagaagagcaatttccttcggtacccgctgaacgaggagctggtctcagaggctcccaatgtcaacgagactgctgtccagctgatcaagttccacggaagctaccagcagagcgaccgagaagttcgtgggcagaagaactactcgttcatgctccggacaaagaatccttccggaaaagttccaaaccagacttacttggccatggatacactggccgatgagttcgggatcggaacgctccgtctgacaaccaggcaaacatttcagctgcacggcgttcttaagaagaacttgaagcatgtcatcagcactgtgataaagaatatgggatcaaccttaggtgcctgtggagacctcaacaggaatgtgcttgcgcctgcagcgccgtatgtgagaaaggatatcctttttgctcaagaaactgcagagaatattgcggcacttcttgcgccacagtcgggggcttattatgacctgtgggtggatggagagaagataatgtcagcggaagagcctcctgaggtcaccaaagcccggaatgacaactcacatggaacaaacttccctgattcccctgaaccaatctacgggacccagtatctgcccaggaagttcaagattgcggtcacagttgctggtgataactctgttgatattctgaccaatgacatcggtgttgttgttgtttcagatagtgcaggggagcctgttggctttaacctctatgttggaggtggcatgggaaggacacaccgaatagaaaccacattccctcgtctggctgatccacttggttatgttcctaaggaggatatattatatgctataaaggcaatcgttgtcactcagagggagaatggaagaagagatgaccgcaggtatagcagaatgaagtatctgcttgacagctggggtattgacaagttccgggctgaggttgaaaaatactatggaaagaagtttgaagattttcatccattgccagaatggcaattcaacagctaccttggctggcaggaacagggtgatggtaaattattctatggagtgcatgttgataatggtcgtcttggggggcaagcaaagaaaactctgcgagagataattgagaagtatagcttggatgttagtattactccaaaccaaaaccttatcttatgtggggttgatcaggcatggagagaacccataactgcagctcttgctcaagctggcctgttggaaccaaaggatgttgatctcctgaacataacctccatggcatgccctgccttacctctgtgccctctagcacaaacagaagctgagcgagggatcctaccgatacttaaacgaattagagcagttttcgacaaggttggcatcaaggatgaggagtctgtagtggtgaggataactggctgccccaatggatgcgccagaccatatatggcagaggttggctttgttggtgatggcccaaacagttaccagatttggcttggaggaacaccaaaccagaccaccttggcagaaacgtttatgaacaaagtgaagcttcaagatatcgagaaggttttggaaccactgttttcctactggaatagcacgcgccaggaaggcgaatcttttgggagcttcacaaaccgaatgggatttgagcaactgaaggaggtggtgaacaagtgggaggggtcagcgtcagccgcatgagagctgtctttgctggacaagtcccagcaccatttttgctggggtgagaatctggtggcgaccaagtactctacggattatttttatataaaaactaggagaggaggaggaaacctgtcaattccgttgacaggcggaggacgaaggaagagccgggtctgaagaagttgctcctcttgtgtttgttgtgaggtttttttttttgtgtgtacttgtatggataactccgttggcccctttgtttagcctgagaataaattccttgcaaaaaaagaaatactgcttgataataaatttgtccaaggcaggggtgcttttggtattgttcggc

SEQ ID NO: 86 - DNA, 6285 bp, Glycine max
caaccttctcttatgaacatttcacttcattctgctccctcctccctctgaaacctctttctctgcctcatttttatacctatctatttcataatacatctttgggttatatacccaacaatgcattaagggtcttttttttcttcttttctctcttatccaatcatccaagtcctataaaaagcatctatatatatatatatattgatattgctttggagtggaaaatggcaccaagaaacagtcgcggaaagcccaagggagagaagaaaaagaaggaagaaaaggttcttccggttgtcatagatatcactgtgaagctcctcgatgaaactcatgttctgaagggaatatcaacggacagaattatagatgttcgtcgtcttctatcggtgaatacggagacgtgttatatcacaaatttttccctgtcgcatgaggtaagagggccacgtctgaaggacacggtggacgtgtccgcactgaagccctgcctcctcactttagttgaagaggattacgatgaagaccgagcagtggcgcacgtgcgaagactcctcgacatcgtcgcctgcaccacgagcttcggtccgtcgtctctgccgccgccgaagaatgattctggcaccgtcccgaagtccggcaagcctgaggcgccgccggcgaagcaatctgcgaaagatgcggaggcggcggcggctacggtggacattgaaggcgagataagccactcgtgccctaagctggagaacttctacgagtttttctctctctcacacctcactgcaccaatccaatatgtgaagagaggttcgaggaggcgcgtggaggagattttggaggaggattatctgttctcgctggatgtgaaggtgtgtaacgggaaagtggtgcacgttgaggcatgcagaaagggattttacagcgttgggaagcagcggatactgtgccataatctggttgatctcttgagacagcttagcagagcttttgataatgctttcgatgatctcttgaaggcattttcagaacgtaacaagtttgggaatctcccatatggcttcagagccaacacgtggcttgttcctcctgttgctgcacaatcaccctcatattttcctcctcttcccgtggaggatgaaatgtggggagggaatgggggtggtcttggaagagacggaaagtatgatttggttccttgggctaatgagttttcatttattgcatccatgccttgcaagacagcggaagaaagacaagttcgtgatagaaaagcatttcttctgcacagcctgtttgtcgatgttgccattttcagagcaataaaggccattaaacatgttatggaagagccgaattttagctgctcagttgtagaaaataatattatttacactgagagagtgggtgacttgaatatcaacgtcttgaaagatggttctgttgcaagctgtaagattgatactaaaattgacggagttgaagctactggagtgaatcaaaaggatctactagaacgaaatctaatgaaaggaatcactgctgatgaaaatactgctgcccatgatattaccactttaggtgtaattaatgtaagatattgtggttatgtggtcgttgtgaaagttgagggaggagttaatgaaaatgttgactctccatctcaacaaaatattgaattgtttgatcagccagagggtggtgccaacgcactcaatattaacagtctgagattacttcttcacaacacaacttcaccagaaaacaataaaccagtgtctcagatacaaacgtttgagagtgaagagcttggtgcttctcatgcttttgtggagaagctgattaaagaaaatcttgctaagcttgaggaagaagaaccaggtattgactattttgtaagatgggaacttggagcttgctgggtacaacatttgcaagaccaaaataatacagaaaaagataagaaaccatcatcggagaaggctaagaatgaaatgaaggttgagggtcttgggaaaccccttaaagccctaaagaattataaaaagaaatctgattcaagcaataataattctgcaactgaatattcaaagtttaatcgtgaggctgaaagctctccattgccctctattgaatcccaacatgaaactacagaagctgagaatgagcttgttctgaaagggatgctatctgatgaagcttttacccgattaaaagaatcgggaactggacttcactgcaagtctatgcatgatttgattgagttatctcgaaaatattacacagacgttgctctcccaaaattggtagccgattttggctcattggaactctcaccagttgatggacgcactctaactgattttatgcatactcggggtctacgaatgcattctcttggacatgttgtcaagctttcagaaaagctttcacatgtccaatcactttgtattcatgagatgatagttcgagcttttaagcacatcctgcgggcagtaatttctgctgttgacaaggagaaaatggcttcatcaattgctggtgcattgaatttgctgcttggtgttcctgaaaatagagaatcagataaatcacgtgaagttcacccattggtgtggaaatggctagagttgtttttgaagaagcgatttgattgggatcttaacaagttgaattacaaggacgtgaaaaaatttgcaattttacgtggcttgtgtcacaaggtgggaattgagcttgttccaagggattttgatatggattccccaattccctttcaaaaatctgatattgtcagcttggtccctgttcacaagcaagcagcatgctcatctgcagatggaaggcagctcctagagtcatccaaaactgctttagacaagggaaagcttgaggatgcagttacctatggcacaaaggctcttgctaagctggtagcagtttgtggtccctatcatcggatgacagcgggagcctacagcctccttgctgtagttttatatcatactggagacttcaatcaggctaccatttatcaacaaaaagctttggatatcaacgagagggagttaggtctggatcatcctgataccatgaagagctatggggatcttgctgttttctattacagacttcaacacacagagctggctctgaagtatgtgaagcgtgctttatatcttctgcatctaacatgtggcccatctcatccaaacactgctgctacttacattaatgtggctatgatggaagaaggtctgggaaatgtacatgttgctctccgatatcttcacaaagctttaaagtgcaaccaaagattacttggtgcagatcatattcagacagctgcaagttatcatgcaatagcaatagcactctcattgatggaagcatatccattgagtgtccagcatgagcaaacaactttgcaaattctgcgggcaaaacttggctccgatgacttgcgcacacaggatgctgcggcttggcttgagtattttgaatccaaggcttttgaacagcaagaagctgctcgaaatggtactcgaaaacctgatgcatcaatagccagcaaaggccatcttagtgtgtcagatttgcttgactacattaatcctaatactaaagggagagatgcagcagcaaagagaagaagccagataacaaaggtgagagcaacatcttaccagaatactggcatgtcaagttctgatgaatcttcaaaagaaattccaaaagaggcttcagatgaagaggtacaaatatccgaaccagtaggtagtgcagattctgagcaggagagcaactctggacctgatttggaacaagctattttaaagcaaatatcggatgaaaagctacaaatttatgatgaaatcttctctgaagcacatgctgaaggagaggatggatggcaatcagttcaaagaccaagatcagctggctcatatggccggagactgaagcagagacgggcagcacttggcaaagtttatagttatcacaagaatgtggaagttggcacagaatctccttttgtaaggagtcctaatccgaatagtaggtattatttcttgaagaaacgaacaatttcccatgggagttatacagatgatcatactacaaacatcacccaaggcaataaatttggaaggaaagtagtcaaagctgttacatacagggtcaagtccatgccctcaacttcaaagccttgtgcaaatgagacattagaaaatggggataagctgctcagttctcttccagaacctgatccaattgatgctaatccagttaagaattctaaagttagtctcggaaagtctccttcatacaaggaagtggccttagctcctcctgggacaatctccaagtttcaggtctataatcctcaaagtgagatttctgttagcagtgaacatgatagtggaaaacacgaagaggaagttgaagctaatagaaatgttgatgttgatccaaccctgatagaggtaaatgatacagttaaagagaagaataatgattctttatcagattctgtagatgattcactggatgatactggagtggctattgaggggaaagaagaaactgagttgattgttgctgtgcaagataattgtatgagtgctgaggggcaatcgggagatgttaaggctcaaggagcagttgatagcagcatattgattcatgcagtagatgatcatgtggattcttacaagcaagaacttgatacaagtaattcatctggcagtttagaacctagtgccaatacaaatcccatttctcagggtggtgaggatttaagggtcaatgtatcaccatcaagtcagattcgtaccgggggcatcccatataagaaattgtctgcatctgcagctccattcaacccatcacctgccattgcacgtgctgcaccaattgccatgaatatgactcttccttctggtcctagagcagttcctgcaattggcccctggccagtaaacatgaatgttcatcctggacctactactgtgctacccgcagttgccccaatgtgctcctctccacaccatgcatatccatcacctccaacaacaccaaacatgatgcaaccactgccatttatgtatcctccttttactcaacctcaatcagtatcgcctagcaactttccagtcactaacagtgcctttcatgccaatcacttcacatatttgaaccccacaatatctaagtttggtcccagtgctgtttggcctggttgtcatcctgtagaatttcctcttccagtacctattgttgaaccaatccctgatcccatttcagagtcacaagctctgtgtcatggtttggaaagtccaagttcggcttcagttcttcctgaggacattgataatattggggattccaatcaagtggtaaaaactttatcatcagagataagtgaagatgaagcagtgagatctggttcagaaagtataaaagaaaatggtaatatgaattttcacgggtctgaaaatgctgggaacaagcaacatcaaaacattgcttcaaatggcaactctagcagtagtggaactaacatggatggtgagaaaacctttagcattttgtttcggggaagaagaaatcgaaagcagactctgagaatgccaataagtttgcttactcgacctaatggctcacagtcatttaaggttatttataaccgtgtggttagaggaagtcatgctcccaagtctatgaatttgtcttcaagtaaggattgtacagctacttcataatccacagttctttgttgttactaatgaaaagtagcagaattattgtgggtaaagaagatctcataattttgaacaagagagatgtggtatttcgatcatttctggaattgaattacaaaatgccctgttgtatcagctcaagttttatagctgcactatcttttgggaggtttctgatatatgtctctatttaagatggaggattggaggtttttattcatcaatataagtctgcaggttcatcgcagtcagtttcggggtttctgaggtaccttcaaggtgaaaatttggttctctacgtagttagacaattttgatatgaattacgggactgatggatagttctaattattattttttttgtaacaacattatcaatggctttgataattaattttgtttaattgtatatactttcttactttcttaatatgttgttagttaggtaatagtggtttttttttttgttgttgattgagttgatatttaattgttaaaatcgaaataatgtgaacgagcg

SEQ ID NO: 87 - DNA, 60 bp, Zea mays
caagccaccaccaagtcaccaacccgagtccgatgtatacgcgcggcaacaataatatcc

SEQ ID NO: 88 - DNA, 949 bp, Arabidopsis thaliana
gttagatctcactggttcaatgtgtgagccgggctttaaaaacattttgatttaacccatacacacatctctctgttccacgattctcttcctcagcctccacgtcgtctctaaactcagcaaaaaccaatgtcgacggtgagaaaaatcactcttaagagttcggatggcgaaaacttcgaaattgacgaagcggtggcgctagagtcacaaaccatcaaacatatgattgaagatgactgtaccgataatggtatccctctccctaatgtcacaagcaagatcctttcgaaggtgattgagtactgtaagagacatgtcgaagctgctgagaaatccgaaaccacggccgatgctgctgctgctactactaccaccaccgtcgcgtcgggttctagtgatgaagatctcaagacttgggattctgagtttatcaaagttgatcagggcactctcttcgatcttatcctggctgctaactacttgaatatcaagggactgttggacttgacttgccagacagtggctgatatgattaaaggaaaaaccccagaagaaatccgtaagacgttcaatatcaagaacgacttcacgccagaggaagaagaagaggttcgccgtgagaatcagtgggcgtttgaatgaagaaaaatgaagacctaggttgctgtcatgtcctcgacccatttgtgtctccctgtcttatcttctttctttgactatatatccattctcttctacgtgatggtccagctaagacagtgggtcggatgttaatgttatgttatgtatgtcaaattaaagacttaactacgaaacatattgaagttgttgctcaaaagagagtgttggtcttctattgtttcgtcaatcatttagataggttgtgaacacaagtgataagatttgtctgcatgttcttagaaagagaaaagatcttattacttgt

SEQ ID NO: 89 - DNA, 60 bp, Lotus japonicus
agatgtgaagtcactaccggcctttctacacatttgaacatggcttcttcttcttttgtc

SEQ ID NO: 90 - DNA, 60 bp, Medicago truncatula
cgttcctcttttttcttctcccagccaaagcaaaaccaccgaacaacatccaccaccaca

SEQ ID NO: 91 - DNA, 60 bp, Medicago truncatula
attcttagcgagagtgtgagagaaaagagaaaatggttccaaaaatgttgaagttctctc

SEQ ID NO: 92 - DNA, 60 bp, Oryza sativa
agtacacacactccacctaatcttcttctcctcacacattcacacacacacaccccgcag

SEQ ID NO: 93 - DNA, 60 bp, Glycine max
ctctctgtctctctctctcgctttctctctccccgcgatggagaaagccgagagctccgc

SEQ ID NO: 94 - DNA, 60 bp, Glycine max
gaattaatagagatacagataacgtgaaactgaaaggaaaatggcactctcagtctcctc

SEQ ID NO: 95 - DNA, 60 bp, Glycine max
gttataaccgaaccacaaaagggtggttgaagttgaagcagagataagtgtctcaacaag

SEQ ID NO: 96 - DNA, 60 bp, Glycine max
gaagcctttccagtgtgcagctgcagctggttcaatgattcaaaattgttaagttctttg

SEQ ID NO: 97 - DNA, 60 bp, Glycine max
gtcgaatccaattctctctctctctctttcttttcttgattatttttggtgtctcaatta

SEQ ID NO: 98 - DNA, 60 bp, Solanum lycopersicum
tgaatcatcggatatcgtagcagtaacaaagttcatcctggatttgttgttctcgggagt

SEQ ID NO: 99 - DNA, 60 bp, Solanum lycopersicum
ggaatctcttccatttttttcctcctgaaaatcactttttcttcattcaccatggaaggc

SEQ ID NO: 100 - DNA, 634 bp, Brassica juncea
gcgggggatccttggctaaattttaaatacaaaataagaagaaagaactgcgaaaatcaaatcagaaacaggttgcactagaaattaaaagtttatctttcacgtaagactcgaagaaaatggcgagcactgtgatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcaacagctggacttaagctagaggcacgtgactcgggtctacaaacgggtgacccagccgggttcactctcgccgacactttggcttgtggtaccgttggtcacatcatcggagttggagttgtccttggtctcaaaaacattggtgctatttaaacttgtagatttttaaaacaaaattctcaagaacctgaggggagatctagtcaatgtttcaagtttttatgtttataatgtttgactcgtattatatttttcattaaaacaattagaacgac

SEQ ID NO: 101 - DNA, 2164 bp, Brassica juncea
aacaagcccaccaatctcttctctgctccatatcttcttcttctctcactaagaaccaaacaatgctcaaaccgttgcttcttctccaatcgttcttgttctgtctcttcaatgttgctttcgtcggaggacggctaatcggcggcggttactcggcgcaggagaatccattcactcccaaagcatctcttgtccgttactggaacaaagagatccgcagcgacaaatcatccatcagatcggagtttctcatctccaaggcttcaccgcttaacgccgtcgagtccgccactttcgccaaactcgccgcccagaactcgctcccgactcgtctcccggacttctgctccgccgcgaacctcttctgcttcccggatttatccccgagcctcgagcagcacaacgccgacgtcaagttctccgtctacgaccagaagaacttcaccaactacggcaatgccgccgccggcggcaccgactcgttcaaaacctactccaaagacggcaacgtcgtcaccgattcgttccggagatacagccgcaacgccgccggtcacgacgataagttcaccgtctacggcgacagcagcaacgtcgtggaggaaaacttcaactcctacggaaccttcggaaccggcggcaccggagaattcaccaactaccaaaacggcgtcaacaacccgacgagccgattcacggcgtactccgacggcggcaacggaaaggctcagtcgttcaaaacctacactcacgaggccaacgccgggaacggccagtcgttcacgagctacggcaagaacgggaacggagtgccgaacgagttcgcatcctacggcgtctccgccaacgtaatcggctccggcttctcgaactacggcgagaaaggaaacgccgccaacgactccttcaccagctacggcagcgacgggaacgtcccgcagaacaacttcaagaactatggcgcctccggtaacgccgcctccgacacgttcgcgaactacagagacaaatccaacgtcggagacgattccttctcctcctacgctaaagactcgaactccggtacggctaaattcactaattacggtcagtcattcaatcccggttcggagacattcaccggttatgggaaaggagccgaaggacacaagatcagcttcaaaacctacacgcccaactctaccttcaaagactacgctaaaaacggcgtcggtttcgcgaagtataacgtttcctccacgtcagcaaccctcggcgatggcaaaaccgtgaataagtggatcgagccgggcaaattcttcagagaagcgtctctcaaagaaggcacagtgattcccatgcctgacattaaggataaaatgcctaaaaggtcgtttttgccccggagcatcatctcgaagctccctttctccacttccaagctcgccgagatcaacaagatcttccacgccggagagaactccacgatggagaagatcatctccgacgcggtgacggaatgcgagaggtcgccgagtgttggagagacgaagcggtgcgttggttccgcggaggatatgattgatttcgctacttcggtgcttggccggagcgtggtgctgcgaacgacggagaatgtggcggggtcgaagcagaaggtggtgatcgggaaagtcaacgggatcaacggcgggaaagtgacgaaagctgtgtcgtgtcaccagagtttgtacccgtatctaatgtattactgccactccgttcctaaggttcgggtctacgaagcggatcttcttgacttgaagagtaagaccaagatcaaccacggaatcgccatctgtcacatggacacgtcatcgtggggtccgaagcatggagctttcttagctctcgggtcgaaaccgggtctgatcgaggtttgtcactggatatttgagaacgacatgaactgggctatcgcggattaaaaccgggtcgggtctggatctatcatgcttttttttcaagtattaaatatgaatattatcttatcgccgagatttgaatagaggaatgttaattttctactattgttatatgctttcctaagctttttcagtaacagtaaagacttgttactgatttgtttgtggcggcacgaataatgtttaagatatttagtgaatgtttgttgacgcaatttatg

SEQ ID NO: 102 - DNA, 1531 bp, Brassica juncea
aaacactaaacgtggtaagatcacgtgatggcacgtgagtaggtttcttcgtcttcttcgttgctccgatcagagaatcgaatcgccgacgacggagaaaaaaaatggcctcctccgtgatttctctctctctgacaacgccattgaaagcgaactcctttagcaagtacaatctcactccgctgccttctctacgtcgcatctcttgctgctcaactcgcgagattactctcaaaccgcgtttggctcttcctgatacgtgtaagcagcggcgaagcgttgagcttttgactcgctgcggcgtttcgtcgaacgacttccccgctgagaaagagaaaaagaggagctttggggggtgggtcgagtttctgggagaggcggtgtcgacggcgtttccggtgtgggtatctcttgggtgcttgctggggctggcgaagccgagtgctttcaattgggtcactcctgatttgaccattataggtcttaccatcacgatgcttgggatggggatgactttgactctcgatgatcttcgcggcgcgttgaagatgcccaaagagctcttcgccggctttgtgttgcagtactcggtcatgccattatcagcatttctagtgagcaaactcttgaacttgccatcacattatgcagccggtctcatattggttggttgctgtccaggcggtacggcaagtaacattgtcacttacattgcacgtgggaatgttgcactatcagtgttgatgacagcagccagtactctctcagctgtgatcatgacgccgcttcttacggccaagcttgccaaacaatatgtcgcagttgatgctcttggattagtaaagtcaacactacaggtggttcttctcccagtgttggctggtgcatttatgaatcaatacttccaaaggttggtgaagtttgtttctcctctgatggctccaattgcggttggaacagttgcgattctgtgcgggactgctattggtcagaacgcatctgccatactcgcttcagggaaacaagtggtcatggcttgtgtccttcttcacctctctggatttctctttggctatctgttttcgagactactcagaattgatgtggcttcgtcaagaactgtctctatcgaagttggcatgcagaactcggtgcttggacttgttctcgcggcagagcattttgggaatccgctcactgcagtaccgtgcgctgtttctagcgtctgtcactccatcatcggtagcgtcttggctggagtctggagacgcagtgccccaaaacaacttgaagactgaagataaatggaagttgggattttcacctgagtcgggaccgtttagttaaagtttgttgaaacaaaaaggttttggtcttgtggagctagttagtcctggtttagtcttgtttaatacaaacctgtttatgtcggttttgttatggtacggtgaagtttatcttttgaactcatgatctcttcaaatgttgtagactttaagtgatgaggtttgaaaaggctattatgtaataa

SEQ ID NO: 103 - DNA, 629 bp, Brassica rapa
aaacgctgcggcttctccgacaggtcgtgtctcttccgttgccgcacgtccttcgcttctcctctcctcctcagattggtctatacacttggagctaaatcaatcaagatgcagaacgaagagggtcagatcacagaactatacgttcctaggaaatgctctgctactaaccggatgatcacatcaaaggatcatgcctctgttcagctcaacattgggcatttagatgctgatggcatctacaccggacagttcactacctttgctctctgcggttttgttcgcgcccagggagatgcagacagtggcgtggacaggctgtggcagaagaagaaggtcgaagccaaacaaatctaaagatgctttattaagctgtcgttctcttttgttatttagttgaaagaaagatcatcgggtttactgaagtaatcatttttgcttgacccttggttataacgctattgcttgtcatacatttttctctagtgtgagatactataaacctttctcattctctagttctcgatttaaccatcgaggaaagatcacctattatcaaagtaaatgtaaaccagaccaaaatgctattatattcttattattatctggttaacccagctcgaggttgc

SEQ ID NO: 104 - DNA, 646 bp, Brassica rapa
gtgcagtaggaaacagagaacatttttcaaaaaagaaaagaaaagttaaaagttagagaggtattaccagagaagcaaagatgggctgcattgatcttatcaatttaacaagtaccaatatttatcggctggtgcttacaagaacatcaaacaaaccctacatcacaagaggatcatcgatggctgctattcgagctgagtcagtggctactgagaaattaggaatctttatcgagaagaatcctcccgagtccaaactcacccaactcggtgttcgtagttggcccaagtggggttgtcctccaagcaagtttccgtggacttatgatgcaaaggagacttgttttctgctagaggggaaagtgaaagtgtaccctgatgggtccgatgaaggcgtggagattgaagcaggcgactttgttgttttccctaaagggatgagttgcacttgggatgtatccgttgctgttgataaacactaccaattcgagtgaatggttatcagtttctgctccgcatatttggtgatatgttcgatataacttcactgtcattgtatgttgacttaattttgtgtgtcatgtatcagtctatgcattgctgggatttatttgcttcgatatctaagtgatttctcgtcatgcaa

SEQ ID NO: 105 - DNA, 1024 bp, Brassica rapa
tttatttacatggatactattatctaataagatatcccaccaaccgtggaaagatatctcaacagttatggtagctttagagttatcattatctgtgtgaaccagagcgtggccttagaccaatcgacatggtttccacaccattccactccatcatctttctcttcctcgccttttccggcggagtcaaaatctccgtcgctgatgagccgaagaccgagcctgttcctgcgccatggccggagcagttccacgcgttgatgttcatgaataaatctggttccattgagattgttgacctatggtacgactggatcaatggccgtaactttaacatcattcagaagcagcttggcaaactaacctacgaccttgaatggaacaatgggacatctttttactatacactcgacgcttccaaaacttgccgcaccgttcatttcgaggttggaatcttgaggccaaactggctggatggagcaaactatttgggtcaacgaaatgtgagtgggtttctctgcaacgtatgggagaaggttgacttcttatggtattatgaagatgttgtcaccaagagacctgttcaatggaccttctatacaggtagagaagctcatgtgatgacatttgaggtcggagctgtcctagaggacgaaaaatggcaggctccagtctattgtttccacaatgaaaacaaaagcagtgagtaattgaagaatttgagactgcgttttcattatatgtagagttttcgaaatctttcaagaaatcaaacgtttcattaagtagtcattttcatcttttatcatgtagtagatacagagttgttttcgtggagcataaataaaagtagatgtcttcttaatacacaggcctttactgggcctcacttttttatgtggataagttataagaagcaagtactttcacatttggtccctaaacgtatctttacttgttaaaagttgtggttaataaaataaagacaaattaaatatagcaattaagaaggggaccaaagtaa

SEQ ID NO: 106 - DNA, 701 bp, Phaseolus vulgaris
acctcgccgcacacagaacattggagtgttgtgactttgctgttgctaaagctaacttcgcgctccacatcgtttgctgccatctcgtctcgccggagcgtcgctgtcagggctaagtttcaagtgttgctgctgatattctgacttgttagtaaagatgagactactaacacataacatgctgtcatcaaacataaagggtgtggtgaatggattcccattgcgcattgaagcagagaaagtggcggaaaagactgtggaaatgaatggggaatttctgaaaaagatgtttgagaaggttgattggaaggctttcgttgatgcatcaaaggccatgggatacactgaactacctgaggaggcggactcttccatgctggactctgatgaatttctgaaccggtttcaccatgctctcttggaactccaccttgaggaaggggctcttgtatgccctgagactgggcgacgctttcctgtcagtaagggcattccaaatatgcttcttcacgaagatgaggtctgagttttgttattattcatcacccttacctgtttagtggcactagttatgaatgctggtaatggaactgcagactttaaaagttgtggatgtcaagtttaccttctttttgttgacccgtgatgtatcctttggctgggctgttctttggatagtttgactattcctgaatgcaggg

SEQ ID NO: 107 - DNA, 2323 bp, Phaseolus vulgaris
cttatttatccactgggtcagtctggttggttctttgctcctagttttggtgtagcagctatttttcgattcatcctctttttccaaggatttcataattggacattaaacccatttcatatgatgggagttgctggtgtattgggcgctgcactactatgcgctattcatggtgcaaccgtagaaaatactttatttgaagatggtgatggtgcaaatacattccgtgcttttaacccaacccaagctgaagaaacttattcaatggttactgctaatcgcttttggtcccaaatctttggggttgctttttccaataaacgttggttacatttctttatgttatttgtaccagtaactggtttatggatgagtgctcttggggtagtcggtttggccctgaacttacgtgcttatgatttcgtttctcaagaaatccgcgcagcggaagatcctgaatttgagactttctacaccaaaaatattctcttaaacgaaggtattcgtgcgtggatggcagctcaagatcagcctcatgaaaaccttatattccctgaggaggttctaccacgtggaaacgctctttaatggaactttagctttaactggtcgtgaccaggaaactaccggtttcgcttggtgggccgggaatgcccgacttatcaatttatccggtaaactattaggggcccatgtagcccatgctggattaatagtattctgggccggagcaatgaacctttttgaagtggctcatttcgtacccgagaagcccatgtatgaacaaggtttaattttgcttccccatctagctactctaggttggggagtaggtcctggaggggaagttatagacacctttccatactttgtgtctggagtacttcacttaatttcctctgcagtattgggctttggcggtatttatcatgcacttctgggacctgagactcttgaagaatcttttcccttcttcggttatgtatggaaagatagaaataaaatgactacaattttgggtattcacttaatcttgttaggtataggtgcttttcttctagtattcaaggctctttattttggaggtatatatgatacatgggctccgggggggggagatgtaagaaaaataaccaatttgacccttagtccaagtattctatttggatatttattaaaatcaccttttgggggcgaaggatggattgttagtgtggacgatttggaagatataattggagggcatgtatggttgggttccatttgtatacttggtggaatctggcatatcttaaccaaaccctttgcatgggctcggcgtgcacttgtatggtctggagaagcttacttatcttatagtttaggtgctttatctgtttttggttttattgcttgttgctttgtctggtttaataataccgcttatcctagtgagttttatgggcccactggtccagaagcttctcaagctcaagcatttacttttctagttagagaccaacgtcttggggctaatgtaggatctgctcaaggacctacaggtttaggtaaatatctaatgcgttccccgactggcgaagttatttttggcggagaaactatgcgtttttgggatttgcgtgctccttggttagaacctctaaggggtcctaatggtttagacttgagtagactgaaaaaagatatacagccttggcaagaacgtcgttctgcggaatatatgactcatgctcctttaggttccttaaattccgtgggtggcgtagctacagagattaatgcagtaaattatgtttctcctagaagttggttagctacttctcattttgttctaggattctttctatttgtaggccatttatggcacgcgggaagagctcgcgcagctgccgcaggatttgaaaaaggaattgatcgcgattttgaacctgttctttccatgactcctcttaattgagacatgagatccaatgaagtagaaatcacttttcttttactataattatttggttgagtggagcgaggcgtaaagacgaatttcttttccttttttctgagtttctatcatcttttttttcgggatgatatagcccagtccgaaaaaaaagattcgatagaaactcagaaaatcaaaaactttatttaccgataaaaaggagagagagggattcgaaccctcgatagttctttctttcaaactataccggttttcaagaccggggctatcaaccactcagccatctctccaaaagctaatatctaatatatatatatttttttattattattccactgaatagaccatgagcatatgaattgatac

SEQ ID NO: 108 - DNA, 843 bp, Phaseolus vulgaris
ccttttgttcactcctaatggctgtgtgccgattcgcttattgttcctctgcatcatcttcttccaccattgttcgtttcccgaaatacccttcacaacacgttaaatcctctttgctgccattctcattcgcaaccatggaagctcctccagaaggttatcgcaggaacgttggtatctgtctcatgaactctcacaaaaagattttcgcggcttcgaggctcgacattcccaatgcttggcaaatgcctcagggtggtattgatgaaggtgaggatccaagaaatgcagctatcagggaattaagagaagagacaggagttaattcggcagaagtgatcacagaggtaccatattggttaacttatgacttcccaccaaaagtgagggagaaattaaatattcagtggggatctgattggaagggtcaggcacagaaatggtttcttttaaagttcactgggcaagatcaagaaatcaatcttttgggtgatggtactgagaaagctgaatttggggaatggtcatgggtatcgcctgaacaaatagttgatctttcagtggatttcaaaaagcctgtctacaagaaagtccttgcagagtttgctccatatttccaataatcttatctctggctgaaattgttatggcttccctatgacaggtgcttttgctgattctgaggctgtttttaggaagaatgcattccaaataactaccaagacatgcgaagagggttatttattgtatgtccgagtgaaatatatattatgatgaaaattgtcatgccaggaattgtatctttccacttattttttcatgaagaaaacgtattttatcgtg

SEQ ID NO: 109 - DNA, 1732 bp, Phaseolus vulgaris
tgtgacgtaactaacaggtaggaattggattagagtgtaagaagaagaggaaaagtgaaagaggaagaacagaagagaaaggttctggaagttccatggcggagttgttagcaaccttaggggatctggagagggactcattcgtgcctcttctctccaagctgattggggaatcgaagtacgtgcagaacaatccgccggagctcattcccgaagaggacagagtggtgaagcacgtgttggacgttctattacccttcagcactaccaccggcggcggtcccttgctcgtcaaccacgtcacctactcgcccggccgggggaacctcatcgtcgagtaccccggcaccgttcccggcaaaatcctctccttcgtcggttgccacatggatgtcgtcaccgccaatcccaacgattgggattttgatccgttttcactgagcattgatggagataaactcgggggtcgtggaactactgattgtttgggccacgtggcacttgtcgcggaactcatgaaaaagctcgggcaaaccaagccgaatttgaaatcaactgttgttgctgtttttatagccaatgaagaggattcttcaattactggtattggtgtggatgggcttgtcaaagatggtctcctcaataagctgaaggatggtcctctgtactggattgacacggcagataaacaaccatgcgtagggactggtggtatgataccttggaaacttcaggtcacggggaaggtctttcatagtggattagctcataaagctataaatgcattggagctaggcatggatgctctaaaggaaatccagttccgattttaccgagacttcccacctcatcctcaggaagaggtttatgggtttgcaactccttcaaccatgaaaccaacccaatggagttatccaggaggggggatcaaccaaattccaggggaatgtactatttcaggagatgtcaggttgactccattctacaatgtaaaggatgtaatgaagaagctggaagaatacgtggacgatattaatgagaatattcagaagctagaaagtagaggtccagtttcaaaatatgtcctacccaatgaaaacataaaaggaagccttactttaacttttaacgaggcgctgtctggagttgcttgtgatcttaattctagaggtttccatgttttatgcaaagcaactgaagaagtagttggccacgtaaagccttactcgattactgggagtttgcctctcattcgggaactacaggatgaaggttttgatgttcaaacttctggctacggcctaatggctacataccatgctcagaacgagtactgccttttctcggatatgtcccaaggatatcgggtcttttcgagaatcatctctcaactggaagattgagaacagcagaggaactaataaaactggtgccccatggagggctgtgaaggtgtttctgacttctcttctgcatgataggggaaactagttcattccccatatacttctcctgccaaagtaccttttttttcatgaaaatttagcgttccttgcgcttacaatggcagcaagtagccacaaggtacacaaatggtttgggtaaattactaaaattccttatcattatctagcctaagtggtttttttaaacatcaaacatatgccaagtaattgtcatactttttattgtgaaattagtattttagtttgtagaatacatataaaagaaa

SEQ ID NO: 110 - DNA, 1249 bp, Phaseolus vulgaris
gtccttttgttgttgttgtttttcttgttcaattcaacatccttccccatttggtttctcttccctgtagttgaagaagcttgaaaaataaaagcggggaaagaaaaaggagagaggtagggttgtttgaggtttcagaaatggcagcagaatcatcagagggcgaagaagaaacaaagttgagcggaggaaaccaattgctgatggttgacgatgacttaacggagatggggaaaaaagccgcttggagcgtcagttcttgcaaacccggtaacggtgtttcctctctccgtgacgataacctcgaaacctattggcaatccgacggagcgcaaccccatttggttaatattcagtttcagaagaaagttagacttcaactaattgtgctgtatgtggatttcaagctggacgagagttacacgcctagcaaagtttccatccgtgccggtgatgggtttcacaacttgaaggagattaagaccgtggaacttgtgaagccaactgggtggatctatctatcgttgtctggagttgatcctagggatacctttgtgaacactttcatgttgcaaattgctgtgttgtcaaaccatctcaatggaagggatactcatgtgcggcaaatcaaagtttatgggcctcgaccgaatcctattccacaccagccatttcaatttacttcaagggagttcatcacctactcttctataagatgatagtttatggaaaaagtaaatgaagccaacctggttttaaatcaaaggatgccgccattaagtgattatatcatctggaatatctgaaaccaaatcactactgaccgaaatgtcaaatatatttcacttcaatattcttaaaaattgtcatcagtaaatgtggccatcagtaattcagtaccctctgtgcctgtcaagtatttacattttgttttacatgtgtttgtgctctatggtagtagctggagattcaaattcaagagttctatatttattgacaaaacaacttgtgcattgtgtgaaatttattccctctttgtcatcatcattgtttcttacttctcaccgaaaaactatgatgaaaattggcactaaggccaagataccattgtctagtattggttcatgtaattccactgctagagaatatattctacaagcaacttctgtgttattctttccaggattctaatgtggttactagctaatagtaacttcaaataaatcaatatctcattccaatgtgcttg

SEQ ID NO: 111 - DNA, 5163 bp, Phaseolus vulgaris
tcttcttcttcgtgtatctctccgataaacccttgacgacgtttggacctgttttgacggcgccgccatggttctcttcaccgagggcgtgacgaattccgttaaggcggtggggttcagtttcttaacgagtgacgagttactaaggagcagtcgcgtgaagataacgaatccgattttgctcaatccgctgcttaaccctgtttctggtggactatacgaccctgctttgggtccgctggatgacaagtctctttgcaagtcatgtggtcaaggttctaaacattgccccggtcattttggtcatattgaacttgtttctcctgtctacaaccctttgatgttcaatattcttagcagtattttacagagaacttgtttctcttgccatcattttcatgctagcaggaaagaggtggaaatgcgtacttctcaatttgagctcataatgaaaggggatattatcagggccaaaagtttggattctattatttcagatgaatccaaccactcaggtgatggtgatgagagccagggtgttgagcaactgggagaaaattggtcctcccttcaatttagtgaggcaatgtctgttctaaggaaatttctgctccgaaaatataagaagtgtcaaaattgtggagtcgtgaatcctagaatcagtaaaccaacctttggatggtttcatatgaatgtcctatctgatgatgaggctagagcaaataccatgagagctctggaaagtgaaacaatcaatgatgatatgtctttaggtggtggggagactacagaagaagaagatataacatctactgggactgcaaaaagagataaaagaaaaaaagggaaattgtcttccaagctagctgcacaaaataaactttctgggtcgttgctaccatcacaggttaaaggtattttagagcttctgtgggaaaacgaggcccgactctgctcttatattagtgatattcaagatcaggggtttggaaagaaagccggtcactcaatgttctttctagagaatatttttgtgcccccaatcaaattccgtcccccaactaaaggaggtgatgatgtgatggaacatcctcaaactgttttgttgactaaggttttacaaggcaacatatccttaggagatgcccatataaataagttagatccttctaaagtactgagccggtggatggatcttcagcaatctgttaatttgttattcgacaataaaacttctggccagggagaagtagctgctggcatttgtcaattgctagagaagaaagaaggcatctttcgccagaaaatgatgggaaagagagttaattttgcgtgccgttctgtcatatcacctgatccttatttggcagtcaatgaaattgggatacccccatattttgctttaaggttatcctatcctgagagagtgactccttggaatgtcacgatgttaagaaatgctatccttaatggccctcaatcccatcctggtgctacacactatactgatcaacaagcaacagtcaagcttccaccaaatgggaagttgctttcttttatatcaagaaaattaccatcgtcaagaggagttattttggatcatgggaagatttctgatcaggaatttgaagggaaaattgtgtatcgccacttgaaggatggtgatgttgtgcttgtcaatcgacagccaacactccataaacctagtataatggctcacgtagttcgtgttctgaagggagagaaaactgtacggatgcactatgcaaactgcagtacatataatgccgattttgatggtgatgaaattaatgtacattttccacaagatgaaatttctcgggctgaagcttacaatattgtaaatgctaacaatcaatatgtgaaacctacaagcggggatccaatcagagctttgattcaggatcatattgtaagtgctgctcttcttaccaaaaaggatactttcataacttatgaagtgttcattcaactactctacagttctggtgtatctatgactgggctaggctcattctctggcaaacacgggcagaaagttttcatgacaaattctgagtttgaaatgtttttgtttcctccagcaatatggaagcctgaacccctatggacaggaaaacaggttatcagtgcattgctatactatatcaccagagattcaccaccatttacagttgagaagaatgcaaaaataccatcaaattttttcaaaactcaggtcagggatggaaaaagacatacacgtgataagtcaaggaacaaggttgagcctgatgatgaggataaattattgatttataaaaatgatttggtgcggggtgtggttgataaggctcaatttggtgactatggtataatacatacagtgcaagaactttatggatccaaggttgctggtaacctactctcagcattaagtcggttgtttactacctttttacagatgcatgggttcacatgtggagtagatgatcttatgataactgaagaaaaggatgttgaaagaatggatcaactcagaagttgtgaggaaattggtgacattgtgcatcgggaattcattggagtaatgaatagtgatattatagatccaataacattgcagttgaatattgagaaaaaaatacgcagtaatggagaagcggccttaacatacttggataggaaaatgacaagcaatcttaactcaagaacaagctcaggaatattaaaggatctactatctgatggaatattgaaaccttcaggaaaaaattgtatttcccttatgactacatctggagctaagggtagtatggtgaatttccagcagatatcttctcatctaggccagcaagagttggaaggaaaacgagtcccacgcatggtttctggaaagaccttgccctgctttgctccctgggattgttcccctagggctggagggttcattattgatcggtttcttacaggccttcatccacaggaatattactttcattgcatggctggtcgtgaagggttagttgatactgcagtcaaaacatctcggagtgggtacctgcaaagatgcctgatgaaaaaccttgagtgtcttaaagtttgttatgatcatactgtccgagatgctgatggttcaattattcagtttcactatggtgaagatggtgttgatgtccatcatactagctttatcaacaaatttgaagcattgtcaactaataaagaattggtttatggcaactgttgccgtcagctagacagatcaagtccatatattaacaaattgcccgatgctctcaaagaaaaagcagagaatttctttcgtgactccttaaaacagagaaatcttggttctctgaaacgagcagaattcttaaagttgatggagcataagtatgtctcttgtcttgctcaaccaggtgaatcagttggtgtattagcttctcaatctgttggcgaaccagctacccaaatgactttgaatactttccaccttgctggtcgaggtgaaatgaatgtgacacttggaattccacgattgcaagaaattgtcatggctgctgcacgtgatatcaaaactccgtttatgacatgccccttgagatcgaataaatctatggaagaagctatttgtcttgctgacaaattgaagaaaatcactgtagctgacataattaagagtatgaaggtttctgttgtaccagtatccgttcttggtggtcaggtttgcagtatatataaacttgtgatgaagctatataaacctaaacagtatccaaaatacagtgatattacccttgaagattgggaggacactttaagaatttcctttgtgagagagttggaggatgccattgaaaatcacatggcactgctttctaaaattagtggcataaaaaaattcaagacagatccacaatcacattcaaacagctcagaagatgctcacggcaatggatcagaatcagagacaaaaggtaaaagtaatgatgatgacgacgatgatgatgttgttgaagacactgaagggtatgaagatctgggatcagatgcacaaaagagaaaacggcaaggtactgatgaggttgattatgaggatggtcctgaagaggaaacacatgatggtgtgctgtcagaggaaattgaaaatgatgaggataatgtggatgataacatgacacttgatgctagtgattctgaaggacttgacgaattatccgagtccaagtctatttttgaaaaagatagtttgaaacgggaaaagaaaaaatctagaccaacaacaagaaaatatgacagggcagtttttgtgaaagctaaagggatgcatttccagatccactttaaatttaccggtgaacctgatattttgttagctgagattgctttgagatcagccaagaaggtttgcattcaaaattctggaagggttggtgaatgtaaagctgttacatgtaaagaaagtggagtaatgtactatggtgaagatagcagaaaaagggatgatattccagcctctgtgaaagaaaaaataccagcactgcagacatcaggggtacattttaaaacattctgggagttgcaagatgatcttgatgttaggtatatttattcaaacaacgtgcatgctatgctaaatgcttatggggtggaagcagccagggagaccatcatcagggaagtgcaaaatgttttcaaatcttatgggatatcggtaaatatccggcacttgacactcattgctgactttatgacgcactctggtggctatcgtcctatgaacagaaacgggagcatagcagactgcacatcccctttcatcaaaatgtgctttgagacagcttccaaatttattgttgaggcagcttatcatgggcaggtggacaacttggagacaccatcttccagaatttgtcttggtttgcctgtgaagatgggaactgggtgccatgacttgatacagaaattggagatatgatgtagccggcatgttcttcagcaccacagctttggcccccgcatgcctggaggtcatgcgaaattttgataccataactgctactaagacaatttccgagtccatttttgtctgtggttcgaaattaaattgtttgaggtagaattagcttagtctgaaatgccattcattctccaatgtac

SEQ ID NO: 112 - DNA, 1846 bp, Phaseolus vulgaris
tttcactgcgccgatgacttttcttctgattgtaaagggatcgtcatccatcgtgtgccattttgcctgcatgaaccggggcaggctttggcgttcttgggatttcttccgccactggacttgacctgaccccaattagggttatacattcactcactctcttctcatttttcctttcaaactcctccttcctcttctcttcctgtccacctctttctctctcttccattgctttggtttgcttcacaaagcgcttaatatttcgctttttcattttcatttcttattatttttgtttttctctggatggcccgaagaaattccactccagggtttcggttccggcccactgacgttgagttgattgagttttttctgaagaggaaggttcggggtaaggtaattcccagcggagtaattgctgagcttgacttgtacaagtatgctccgtgggatcttccagataaatctgccctccagagtggggatttggagtggtacttcttttgtccgaaggggaagaaatattcgactggagggaggtttaatcggtcgacggaggttgggtactggaagactactgggaaggatagagcggttgaacacaagaatcgagttgtggggatggttaaaactctggtttttcacaccggtaaagcccctaagggagatcggactgattgggttatgcatgaattcagagttgatgacaaggagatggttgacgaaggcagttcgcaggactcctatgtaatttgtaggatattccgaaaggaaggtcctggtcccaggaatggtgcacaatacggtaaaccatatgatgagaaagaatgggatacagatgaggaaattgactctgtgcaatctgaacgtgttgcttctatgtcgacacctgttcctatacaacccagtgaaagtcatatttctattgcaaatgacatcaatccctctacaagtggatgtgctggattgacctctgtatcatgtgcatcaaagttgatgccttcctgctcagcatattgtgtgccttctaacaatcaaattgactctgtgtcatgtgtatcagaattgatgccctcttgctcagcactacctttttctccaaactgtgcatttgattctgtatcaggtctatcaaaagtgacaccctcttgttcaacagttcctttaactccaaactatgatgttgactctgtatcatgtgtatcaaaattgatgccctcttgctcagcattttcttctgctccaaacagtgaagttgactctgtatctgtatcaaaaatgccttcttgcttgccacttgcttcagctccaaacaatctagttgacactttatcatctgtatcagaattgatgccctcttgcacggcaccatctccaaaccatcaagatgatgaaaacattttatctttgctagattatttcaaagaagatgacgacacaatggctgtgaatgaaaacaatggaattaagaaggttgaccctgatcaggcgaacaatgctgaatgcgcaccatgtttggatccaaatgtgatttttgagaacctaggagaccttgacagcttggttggattgggtgaaggcagtttttcctctggccagaaaaacggactttctacaagcgatatgttttatacaggtggtgattatatgcttgggtcttgggaaccccaagactttttggagttgacggacctagcggggccacagccctggcagaataagcatggaagttctggcgaatataagtaaaggttagaaaattgatacaactaaagccacaagtaactaatgtggacccgaaaaagctgcgattctcgtttttcatttaaaaactaccatgacc

SEQ ID NO: 113 - DNA, 936 bp, Phaseolus vulgaris
tattccttcgcatattagtctcattccttcactctgccgctgcaaaagcaccactctctgcgccggattccacaccatttcctcacaaatggccgccgaaaagaaactgtcgaatcctatgcgcgaaatcaaagtgcagaaactcgtcctcaacatctccgtcggcgagagcggtgatcgtctcactcgcgcagccaaggtgctcgagcaactcagtggccaaacccctgttttctccaaagcgaggtacactgtgcgttcctttggaattagaagaaacgagaagatcgcgtgctatgtgactgtgagaggtgacaaggcgatgcagcttttggaaagtggcttgaaggtgaaggagtacgagctgctaaggagaaacttcagcgacactggctgcttcggcttcggcattcaggagcacattgatttgggaatcaagtatgatccatctactggtatttatggaatggatttctttgttgttctggagcgccctgggtatcgtgtgggacgccgtcgtcgttgcaagtctcgtgttggaatccagcaccgtgtgacaaaggaggattccatgaagtggttccaagttaaatacgaaggtgtcatcctaaacaagtcccaggcaattgtttagttttatatcagacccttctgttgttcattaccgtttcttgtttcttttcttccattattagtaccggatgttatttttacaggtctctctagctgtttgacattttttttaatattattaaattttgacatccttatttatcataacatgtatttctgccatttatctacttaacatcagggtcaaattgaattgtatgtgtaatattttaatgttttagcttcatttcatcatatgccattttagtttgaaactccctgtaactgtttggcagtggaatcttcacacttagctgctgctat

SEQ ID NO: 114 - DNA, 643 bp, Phaseolus vulgaris
atttacgtctcttctgcgttcacctctgctcatttgccgagcaccatcaaatttcccgcttcgcatcctcagagaaattggacgatctcgcgagtcatgaatgctagacgagacaaccgtaacaatagagtttccctttttgatggtatcgaggagggtggcatcagagcacaatctgtttactcatcttctcatgaaattgatgaacatgataacgagcaggcattggatggactgcaagatagagtcaatctgctgaaaagattatcaggtgatatcaacgaggaagtggatagccataaccgcatgctggatcgaatggggaatgatatggattcatcaagaggagtcctttcgggcactatggacaaatttaaaatggtatttgagactaaatccagccggagaatgttttcgcttgtagcatcctttgttgtgatttttcttataatatactatctcactaagtaatttggtctttcattcaatctttactctagaggaagctatttcctctatcactgtaattaatgctactaccctgtaagatactgttatgtataaaggtttgatgtttcaaacaggtactgaataaaacaggtactgaatgcaaagactaatgtccatatccgatttgaggtat

SEQ ID NO: 115 - DNA, 1156 bp, Phaseolus vulgaris
gtggcggtgaagaataattagaaacatttcgcttccacactccgcgaggtacacgacggtgccggttggtgagcggcgccatacctctcattccatccatcgccgtcgtcaccttcctaaaacgacgtcgcacccatcacccctttcctctccctctcgctcgcagtcataatttcccaaaaaggagggaaaatggcatcttcttcaaactcatggatgaaggaatataatgaagcactgaaacttgctgatgatatcagtggtatgatttctgagcagagttcatttcctgcatctggaccagaaatccagcgtcattcaactgctataaggaggaagattactatattgggtacccggcttgatagcttgcaatctctattgtccaaatttcctggaaagcagcccatatctgagaaggagacaaatcgtcgcaaggacatgctcgcaagtttgagatcaagagtcaatcaaatggcttccacattgaacatgtcaaacttttcaaatagagatagtttgcttggaccagaaggaaaaccagatgcaatggccagaactgttggcatggacaacaatggacttgttggatttcaacggcaactaatgaaagaacaagacgagggccttgagcaattggaagagactatagcaagcacaaaacatattgctttggcagtcaatgaagagctgggtctacacaccagactcattgatggcttggaccagcatgtagacgtcacagattctcgccttaggagagtgcagaagaacttagcagttttaaataagcgaaccaagggtggttgttcctgcctctgcatgcttttatcagtggttggtatagtgcttttagttattgtgatttggctattggtcaaatatttgtgatgccatagtaaataacccaacttctcaagattcttttgtgtttgtttctgacgtgcacaagtatcataacggagtttcctgatttcccttgctacttcctcaatgacatggaatatgtggttgtattgtaattgacatatttaattgtttatatgtagtgtgtttttctcttgtacaatatgaaagattaattgctggaatgttaatgtgcccaactaccgtttcataactcttaataggtgatgatgtgatccttaactttgct

SEQ ID NO: 116 - DNA, 1200 bp, Phaseolus vulgaris
gtagtttagaaaaaaaaaagaacaacacaggcatgtgcacgctcgagtagccctagctctgaacaacgaacacaacacagtcgaaggtattgccttgaccaaagatggtgcagtggcagaggcacattttgcccttccttcgtcacattcacaagcgagtagtggatcaccaccatgccaatccttcagctcctagccttgtaatttctcgcttagcctcttctctttcacaaggtcaggtaggggggagagcgtggacaagaacgacaccaactttgccatgtttctcaagacccatttttctctgtttccaacatcagggaatttcaagcaccactccattgctggcaaattcatctgaggaaacacctgttttgtcacctttagtcccagtttcatctttgggtagttcaaaaggtgaagaccagaagcagaaagctgttactaagccagaaaaagttcaagcaatattaaagggaataaagcagagtccaaagaaggtcaacttagttgctgctctggttcgtggtatgcttgttaaagatgcattgatgcagttggaattgacgataaaacgagcagcaaaaactgtttatcaggttattcattcagcccgagcaaatgcctctcacaatcacgggttagatccagaacgtctcctagtagcggaagcatttgtaggaaagggatatttcaaaaagagacttgcctaccatgccaaaggaagatcaggactcataatgagaccagaatgcaggctaacaattgtagtgagagagataactgcggaagaagaggctgatatagctaggctgagagttcacaacttcaagaaactaactaagcgggagagacgacttgtgcctcatcaacttattgagaccactcctgtttggggccgcaaaagcaaatctagtggtcaaaacttgagtgctgcacctgcatgagcctcactttgtttccaagttttcatgcttcatggcattttgtgtaatagattattcttcttggtcatcacataatatggaacagttgaaattttttttgcccttgttgcaaatgatagaagtttgtgttggatcattttcagtgttattctcatttaatagcttatttttcttccatctaggtacaaaaaaggatatgccctgttcaatcagcagcatgagtttgttgtctattttttcttcatctggtgaa

SEQ ID NO: 117 - DNA, 540 bp, Phaseolus vulgaris
aagcacaaactttgacacctattatctatttttcttcagtggtctctgttatccttatcctgtttgtttgcaatggaagtgatctctccttcatccacctcctccagattgaatcccaacgctccaatgttcgtgccgctcgcctatcggacggtggaggatttctccgacgaatggtggaatttggttcgttcctccgcgtggttccgcgactactggctccgcgagtgcttccaagatccccagtaccagaacgagctttttgatttcgacttcgacttagatctggaagaagaagaagaagagaacgaaggggaagaaggaaaagaggtggtgtctttgggggtgctcaaatggcgaagctctggaggaggttgggccgaagcgcctaggtatgttgaaaaggccccaaagttcgtcaagcccaaagttagtcctcgggctattcaccagcccaggtagatcagctaggcccatcaccgctgttcatgtacatagatcagctaggcccaccaccactgtttatgtacatacataaaa

SEQ ID NO: 118 - DNA, 1179 bp, Phaseolus vulgaris
gcacagcgaaagcttctatattgtattgtattgcatcgcccagcctcatgttggtgttcttcatttgtgtactccttttcttcgtctttttatacaaattcatcgccgcttatggcgatttcactctgatgtctaagaagcaacctaaacgcgaagaaattgaagataaggttgtttggattactggcgctagccgtggaattggggagattttggctaaacagcttgcaagtttaggggccaggcttataatctctgcgaggaatgaagttgagctaaaccgagtaagggcacaactgaaaggtaagcatgcacctgatgaagtcaagattttaccattggatttatcgtctggagaggattctcttaggatagctgttgagaaagcagaatactttttttcggattctggtgttgattacatgatccataatgcagcttttgagcgacctaaaacatcaattttagatgtaactgaggaaggtcttaaggctacatttgatgtcaatgtttttgggacaataactcttacaaagctcttgacacctttcatgttaaagagggggcatggtcattttgtggtgatgagtagtgcagcaggaaagacacctgccccaggtcaggctgtatactctgcttctaaatatgcgctcaatggttacttccataccttgcgttcagagctctgtcagaaaggaatccgagtaactgtggtctgtcctggtccaatagaaacatcaaataatgctggatcaaaggttccatctgagaagcgtgtatcatctgaaaggtgtgcggagctgactatcattgctgcaacccatggcttaaaggaagcttggatatcatatcagcctgtgctcgctgttatgtatcttgttcagtacatgccatctgttggttattggctcatggacaaggttggcaaaaatcgagtagaagctgctgaaaagaagggaaacacatattctttgagcttactgtttggaaaaaagaagggcccttgatgcccatctgtgcatggtttttttcaaagatttgtgtcaaatgtattttagttaaaggttctctgtcaaaatgaataacaccttttcgggcaattgacagaatagagttatatgttattccaaaatgaacaatgaaggtttataaattttcaatgggcgagacattctgtga

SEQ ID NO: 119 - DNA, 678 bp, Phaseolus vulgaris
gaggattgaataatctgaatttgagttgtgttagtttttcttttacatggcatgcaatctgaatcaaaatcagaggcagtagtgaagtgacttaacgagacgaaccatctatttgcactgtcatcgtagatcgcatagatggagacacagaacaacaatccaaaccctaaccctcatcatcggaattcgctaccgtcatcgttgccggtgtggccaacgatcgatgggtcgttggggttgtcggaggaagaatcggtgagctacgcccggaggttttacaagtttggcttcgctcttctccctcttctttgggccgtcaactgcttctacttctggcccgttcttcgccactctcactccttccctcgcattcgcccatatgttgttggatcagcagttgggtttgcagtgtttgcaaccgttctctgttcttgggctctaacatttgccattggaggggaacgcctcctcggacctgtttgggatcaattggttatgtacaatcttgctgataggttaggcctaacaagctggagctagttgtgtggcacctcttatacatgtattttgatcttttattaccacatttatcttcttccatgcctcgtgaatgcacttccatttacatatacatattacaatattctatcgttgaatagataagcaatgttttggaag

SEQ ID NO: 120 - DNA, 3600 bp, Phaseolus vulgaris
gggagagtgagtgtgtgtgattacagtgagattaactatttatcccttacaaaaccactcgttccgatgacatagttgctgtgcaaggtttggcttgcgtaggtcaggtgaaaatgttgcaccgtgactgggtggtgaatttctgaataggcaggagttgttttccactctatgtgttgtcacgagattcagagaactgcagtgaattgggttttgatttcaactgactgatggagtgcaacaaggatgaagctgtgagggctaagcagattgctgaaaataagatgcaagctggtgactatgaaggggggctgaaatttgctacaaaagcccaaaggctgtttcctgatattcagaacattgttcagatccttgcagtttgtgatgttcactgtgctgctcggaagaaactctccgagtttgacatggactggtatggaattcttcagactcaacagtctgctgatgaagcaaccattaagaaacagtatagaaagcttgcactgctacttcatcctgataaaaataaatccgcgggtgcagaggctgctttcaagttgattggtgaagctaacagaatgttaagtgatcaatgcaagcgggctctgtatgactcaaagattggaatttcagtgggaaatacagcagctaaggtcgcacctagtcacccaaatggaaatgcagggaattatcagaacatttttaattcacagccccatgcttggaatccatatcatcagtttgaaaatcagacattctggacatgttgctctcattgtaatactagatatcaatactacaaaactattttaaatcagaccttacgctgtcaacaatgttctaaatcctttacagctcatgatatggggaaccacaatgtgccaccaacatattggtcaccttttaataaccacaaagagtctgcaaaacatgcatcatctaaagaagcatcaaaaagcaatggtggaaagtctcatggtgtagaagaggagggtgtgtccatgtcaaaatgcactgctggagttggtgcctattctaaagttgcaaatagcagaaatggccacgtggctgcaggagtgacaaaggctggtgttaaagtgttcaaagccaaggaatcacaagcctcaactaaggttggttgtaaaagagcaaggcagtcagcatcaaatgataataacaaagctggaaatggtaaaggcatgaaagataccaaggatcaagaaaatacggttgatcctcataggaaaacttcaagaaaaaaacagcatgttctgtacccagaaaccgataaagctggtgattttgggagttcacccagaaggccacgacaccatgaatcatttaccacccctaaagtagaggaaaaagaagtgccagtaactggtgggttgttcagtaaccttaatccagcctatcgtgctacaggtgtgggtggtcagaatggggagacaataaataaagcaagtgaaccacatgaagaaacaattttaaggaataaagccaaagttgagcagacaaatgtgcaaggaagggaggtattaaactcagatctgaatgatagaaagtctaaagccaactattgttctccatcgaagtcaaatttgcctcccaatgcagagatttcctgtcctgatccagatttcagtgattttgagagagataaggcagaggattgttttgctgttaatcaattatgggctatttttgataatgatgatggtatgccaagattctatgctctcgtgaagaaagtgtactcccctttcaggttgcggattacgtggctagaagctgactcagatggcctaggtgagattaggtggcatgaagcaggtttgcccattgcttgtggtaagttcagactcggtgattctcagagaacttcagatcgttttatgttctctcatcagatgcattgcataaaaggaagtgacactagtacatatctgatatatccaaagaagggagaaacttgggcaattttcagacattgggatcttggatggagttcaaatccagaaaaacatttggagtatcaatttgaatatgtggaagttctatcagattttgatgaaaatgttggcattgaagttgcttatcttggcaaactggaagggtttgttagtctctttctgcacactgtgttgaatagtattagcttattttgtatttcacctcatgaaatgtacaggttctctcatcggattccttcatacaagatgacaggtgctgaaaggaaaggtgttccaagtggatcttttgaacttgatcctgctggtctgcctacttgtctttttgaagtcggtgatactggtgttgcgaaaatggatggagtcaattgttctcatcgggaatactcaaactcaaaagttaaacaggcaaagtctagtgatagtattcacaaatcgaagttgcaagagagtattgactctgaaagagcagcacaaatcctcagaaggtctccaaggtcgagccaaaaaagtatggtcaatggccaagcaagcactagacaattcacggtcagaaaggatgacataaacattgagcacaggggctacagtccaccagagggaaacgctgcttcatctcagactaatgcgaggaaggtcaagacacctcagaaacaagagaaaaatagttatgatggagagacattgaaaactcgaaagttgcctagagatctaagcaagaaagatgctctaggagatgcatctgaaaggacaagatgtaagttgactgctaatcaatcaaaaaacagcaaaaatgtgaagagcaccaacattcctcagttggttggagaatcagtttctgactttaaaaaggataaaactgaaaagatgtttcagtgtggtcagatatgggcaatatatggtgatagagatcacatgcccaatacttacgcccaaattaagaagattgaattcactcctagttttagagtgcaggtttccatgcttgaaccctgcccagtaccaagtgttaaaagagcaatatcttgtggaaccttcgaagttaaaaaatccaaattacagattctctctccctctgcattttctcatcagttaaaagttgaacccttggtaaataatcgatatgaaatttaccctagaaaaggtgaggtttggtttctgtacgaggatcagaactatgaactgacttcttcaaagcacggcagaggtaaatgtaatatagtagaagtattagcagatagtgagaagagtatacaggttgttgttctgtcgccacataacaactctcagacaattttcaaagctcccagaattcagagatctaaaactggtgtaattgaagtattaagagaagaggttggcaggttttcacatcagattcctgcttttcagcacagggacaatgtgcatctcatggggtgttgggagcttgatccttcttcagttcctggttcttttgtaccaataaactgaagtatttttataccctcttgtcccctttgttcgttgtagtgaatctatattttgttatatattaattgaccagctattctgtgaagcagccatgtattgaaatgtgttgaaggaaccctcgtttcatgtgtttggtaagttacattagttaaagcag

SEQ ID NO: 121 - DNA, 1351 bp, Phaseolus vulgaris
gtgaagttaaactggtttggataaaaccctaagcatggattgaagggagatgaagaaaatggagagtgtaagaagaaatgcagaggctctggtggagaagacgatgaaagggaacgatgcttcccatgacgcagctcatgtttggagagttcgcgatcttgctctctctcttgctcaagaggaaggcctctcttccgatcctaactccatgcaaatcgttgagcttgctgcactgctccatgacatagctgactacaaatacctaagggacccatctgaggaaaaaatcgttgagaattttcttgaccaagagggagttgaggaggacaagaaatttaaaattttgaagatcatcagaggaatgggtttcaaagaagaggtgactggaaatggaagtagtgattggtttccagaatttggagttgtgcaagatgctgatcgacttgatgccattggtgctataggaattgcacgttgtttcacctttggcgggagtaagaagaggttgctgcatgatcccgctattctgcctcgttctgatttgtccaaggagcaatacatgaacaaagaggaacagactactattaatcattttcatgagaagcttctcaagctcaaagatatgatgaaaaccaaggctgggaaaaggagggctgaaagaaggcacaagttcatggaggagtttgtgaaagagttctatgatgaatggaatggcttaaactgataaacatttttcatagcttcttcccttcaagtataggttcagagcttcttctttcaaatggagctcaagcgagatgctgggaaatgttcaaatcttgttattaacagtccatgacatatgcgtttcattctatcagcatggttttcttctccggatccccatgtcctagttggttatggatgttagactatgttgtgagtttgtttgttggttacaaacattgtgaacttgttatctgttatttcttttcctcatcattagtacaggctacatatagtgactggttgcacaattcttcccagaaccatctgcttaagcacaccagtctgctgataaattacaatccataggatcagtagtgacagtccaacatcctttctactcatgaaaattgttgtgtgattgtgcaatggtattttttgggttgcacttgaagtacactagtggtgatggatttcatgtttagaaacagaaacttgtttattgtggagccccagtaatgaggtgtttgatactagagcaagaatacttctcttgtaagaagtaagaattaagaattaagaatagagagaagagaataaaatttatgaactacgaatcctttttggacgtaattcaaaagaccaa

SEQ ID NO: 122 - DNA, 1035 bp, Phaseolus vulgaris
aagaaatttgattccgcagtcgtcaagcttccattgtctactgttgcgttgctcctgattttgctttccatcggaatggatagtgcaaagacgcatggtgctgttctggcttgcacagatggagcagttctttccgtcaatcaagcgcttgaggcaattagagaacttggcattgaaggggttcagcaatcggatcctctagttattacatctgcctctctcttaaacaagttgccagtggagtcttcctcttttgattctgctattttattttggctgtcaagtgattgtcctggggaccaactgattcaagaaattcttagagtgttaaaagttggtgggataattctcattcgcaagtcatctcagtctattgtgggctcatttgataagataatatctgatcttcagagcaagttattgttggcagggttttcagaagcacaaattttacaatcaattgggatcaaagctaaaaagccttcatggaaagttggttcagcatttgccttaaagaaggtgataaagagttcacctaaaattcaaattgatgttgattcagatctgatagatgaagatagtcttttgactgaagaagatttaaagaaaccccagctaccacctggtgattgtgaaattgggagcactagaaaagcctgcaaaaattgcacctgtgggagggctgaagaagaggacaaagtattgaagttaggattgacaacagaacagattaataatcctcaatcagcttgtggcagttgtgggctcggagatgcattcagatgcagtacctgcccttacaagggactgcctgccttcaaattgggcgagaaggtagcactgtccggtaacttccttgctgctgacatctaaatggacaagattgaagaacgatttgtcatggaaatcatattattataggatttattatgtagtatttgtcagacactagttatgttaatactagcagaaccattcatcccagtaatttgatttgatacgtatgaaataccagagattcatgttttcctgcta

SEQ ID NO: 123 - DNA, 1098 bp, Phaseolus vulgaris
acaaccatggatctacctagctgaagggttgaggaaagagaagaagattttgagcgcggaaccactgcaatggccatggcttccaaccatctccgaaacttgactcgcatctccgtccaccgcattctccatcaccgttttcaatctctcctcaacgctgctaggtttttctccgatgctgcttcttcagtgcctcaaccgcaacctaatcagcaatcttcgcctccctcgtctttgaaggattatgaactcgccaagttcgctgcaattgctgattcctggtgggattctgaaggcccctttaagccattgcatgtgatgaatcctacaagacttgctttcatccgttctgcactatgtcgacattttaagaaggacccttatagtgctaaacctcttgaaggacttaaaattgctgatgttggttgtggaggtggaattctttctgagccactagctcgattgggagctactgtgacgggtgttgatgctgttgagaagaatatcaagattgctcaacttcatgctggtttggatccagtaacttcaactattgaattttgttgcaccacggccgagaaactagttgaagaaggaagaacattcgatgccgttatggccttggaggtgattgagcacgtggcaaatcctgcagatttttgcagatctctttcagcactaacagttcccgatggcgccaccgtgatatccaccattaatcgttctatgagagcctacgcaactgccattgttgctgcagaatacattctccgctggcttccgagaggcactcatcaatggtccagttttctgacgccagaggaacttgtcctcatcctgcaacgcgccggtatcaatgtggaggagatggccggatttgtgtacaacccggtgacaggacggtggtctttatcagacgatatcagcgtaaatttcatcgccttcgccaccaaatcaaacagcaccgaatagcataatagatatatagataaaatacgcattgctattatcactgttatattattataattgaaattgtttttgaatggccaaaaaagataataatcagggagtggagggggagagtttcctgagagt

SEQ ID NO: 124 - DNA, 1459 bp, Phaseolus vulgaris
cagatttggtgtatgcatttaggttgtcatgtttggaaggaatctgaaaaagcggagaatattcggggagtcaagatgagagattgttctcactgatactattatttaacagttcaaaccatattgggcttcaaaatgatgcagtgaggaacacaccatatccacactcatctccatggcgtccttatccagttttgctcctcttgtgtttcttctgcttgttattgggtgcactgcaaggcctttttatcctcttcccagcaaaggtgatgggggaagtaggaagcccctacagactcttcgcccatacaacattgcacatcgcggttcaaatggagagattcctgaagcaactcatcctgcatatacgagagctattgaagaaggggcagacttcattgaaactgatatcttatcatccaaagatggtgttcttatatgttttcatgatgctacccttgataatactactgacattgcaaattacgcagagtttgctaatcgtaaaagaacgtatgaagtccaaggggaaaacatcactgggttctttactgttgatttcacattaaaggagttaaagtcattgagggtgagacagaggtatacatacagggatcaacagtttaatggaaagtttcaaatcatcacttttgaagagttcattaccatagcactgcaggcacccagagttgttggaatatatccagagataaaatatccagtatatatcaatcaacatgttaaatggtcagatggaaaaatatttgaggacaagtttgtggacacacttcagaagtatgggttcaagggttcctacctgtcaaaaaattggctgagacaacctatattcattcagtcatttgctccaacttcacttgtgtatatagcaaataaaacggacttgcccaaaattctgttaatcgacgatattgatattccaacgcaagacaccaatcagtcatactgggagattacatctgatgaatacctaaactacataaagcaatatgttgtaggaattggaccttggaaagacacgttggtacctgtagcaaaaaattatatgcgaactcctactgatcttgtttccagggcacatgctcataatctgcaggtgcatccatatacttaccgaaatgagaattcttttttgcacttcaactttagtcaagatccgtatatggagtatgattactggatcaacaagataggcattgatggtctgtttacggacttcactggtagtcttcatcattttcaggaatggacctctaaacatcaagatgatgatagtgacaacgatgataacactgcatccaaactgttgcataaaattgcaatgttgctcgcctcttataaatgatctcaagaattcaaatattgtattatgtgtttggattaatttattgtgttcaaaaaatcttataataatatttacaagtgagcttttgacaaaaaa

SEQ ID NO: 125 - DNA, 1175 bp, Phaseolus vulgaris
atgtaatgtaatgcatatgcattgtgtgcaagccaattccattggtggattcgtctcttccattcccaaatcatcactttcactctcaccaaccacaaccatggccatgccttctcctaactccctccgagttgcggcggcccagatgacatccgtcagcgacctcgccgccaatttcgccacctgctctgggctcgtcaaagaagcagcttcagctggagccaaattgctttgttttcctgaggctttctcttatgtgggtaccaaggatggggacagtgttagtgttgctcaaccattggatggaccaattatgaaccagtactgctctctggccagagaatccagcatttggttgtcacttggaggcttccaagagaaaggatctgatcctcaacacttgtgtaatactcacgttatagtggatgagactgggaaaattagaagctcttatagaaagatacacctgtttgatgtagatgttcctggtggaagggtatataaagaaagtagttttacagaaccaggcaaggatattgttgcagtagacagtcctattgggcgtcttggtctcagtgtgtgctatgatttgagatttcctgagatgtaccaattgttacgtttccaacatgaagcacaggtactattggtaccttcagcattcactaaagtgacaggtgcagcacactgggagattctccttcgtgctcgtgcaattgagactcaatgttatgtcattgctgctgctcaaactggcaaacatggtgataaaagagaaagctatggtgacacattaattattgatccatgggggacaattgttggccgattaccagatcgtttgtctacaggcattgtagtagctgatattgatttatcacttgttgattcagttagagagaaaatgccaattgccaagcaaaggatgccaattgacttctggaaagctgcatctctatagttcttatttggaccagtcaacaaggggtacatggttaaaaatctgggatttctatgtaccaaatgaaaaatgagacttccatattagattcccttaaagatggtatatacaaatgtgaatttctgactctggtaataagtgattaagtgccttcttatgttctacagaatctagtacttctttccacaatctgaggttagattcattgtgtgca

SEQ ID NO: 126 - DNA, 1259 bp, Phaseolus vulgaris
ataggggaatagagagagagagagagagggtgtgtctaaaaagcttgaagatgaaggccgtagtgataactactccggggggtcctgaagtgctgcagcttcaagaagttgaagatccccaactccaagacaacgaggttctcatcggagtccacgctactgcccttaatagagccgatacccttcagaggaagggcttccaccctccccctaaaggtgccagtccttacctgggtctcgaatgttccggaactgtcctgtccgtcggtaaaaacgtttccaactggaaaatcggcgatcaggtctgtgctcttctcgccggaggaggttatgccgagaaagttgctgtccccgccgggcaagtgcttccgattccaccaggtgtttcactcacggatgcagctagttttcctgaggtcgcatgcactgtgtggtctactgttttcatgacgagtcgtttatctcaaggggaaaccctgttgattcatggaggttctagtggaattggtacatttgcaattcagatagccaagtatcgaggggctagggtatttgttactgcagggaatgaggagaagctagctttttgcaagagtattggggctgatgtggccatcaattacaaaacagaagactttgttgccagggtaaaggaggaaactggtggacaaggtgttgatgttattcttgattgtgtgggagcatcctactatcaaaagaatatcgatagcttgaatttggatggaaggctttttattattggctttcaaggtggggttactacacaagtagatctccgccctttacttgctaagcgtctcacagtacaaggggctggcttacgtaatagaagtgttgaaaataaagccctaattattagcgaagtggagaagaacgtttggcctgccattgctgaaggaaaggttaagcctgtggtctacaaatctttccctcttgccgaagctgcggaagctcaccagcttatggaaagcagcgagcattttgggaagatattgcttgtgccatgatcattgtcataccgaagttcatgtgtttgaatcttgtgtttggacttcgttgtgatgatctcatctttctaataagattgtgctttaaagttacagcacgaattgacttgtcttggttcatttcaacaatcctacctgtaaacccattttaatctgcatgttcacgctacaaatgcattttaatctgcatgttattaaatgtgattagttattgtatgctgcaatgtctat

SEQ ID NO: 127 - DNA, 1397 bp, Phaseolus vulgaris
gtagcagagcacatgggaggatgtacatgtctataaaaggcgagaatatcgctcatcttcttcccaaaccaccgttactagttccgcagtaggctatggaagataacaaccaggcttcatctcctgcttcaccaaccgaaggaaaaccaatactatgcagagcggcgattgctagaaaagctggtgagccattgattattgaagagataactgtggcgccaccaatgcctcgtgaggtgcggattcgtgttatctgttcctctctctgccacagtgacatcactttcaggaacctccaggactttcctgccatttttccaaggattctgggtcatgaggcaactggggttgtggaaagtgtagggaaggatgtaactgaagttacaaaaggcgatgtggttattccagttatcctaccagaatgtggggagtgcatagattgcaaatcaaccaagagcaaccgttgtactattttccctttcaaggtgtctccctggatgcctcgagatggtacctctagattcactgacaagaatggagagatcatctaccattttttgtttatttcaagcttcagtgagtacacagtggtggacattgccaatattataaagattgatccagaaattcctcctgacagggcttgccttcttggatgtggtgtttcaacaggggtaggtgctgcttggagaactgctggtgtggaaccagggtctacagtagctatttttgggctgggatctattggattggcagttgcagagggagcaagactttgtggagcaactaggattataggtgtggacatctacccagaaaaatttgaaattggaaaaaagtttggagtcactgactttgtgcatgcaggagaatgtgggggcaaacctgtgagccagtttatcatagagatgactggtgggggagcagattattgctttgaatgtgttggtacggcatcagtggttcttgaagcatatgcttcttgtagaaagggttggggaaaaacaattgttataggagtggacaagccaggagccaggataaatctcagttcccatgaggtccttcatgacgggaagagcctcatgggatccttgtttggaggtctaaaacccaagtctcatgtacctattctccttaaacgttacgtggacaaggaattgcagttggatgaatttgtcactcatgaggtggagtttaaggacatcaacaaagcttttgatttattgagtacaggaaagtgtcttcgatgtgtgatttggatggataaatgagtagacattgttaagtactcctagtccttgataatgatatgctacatgaaacatttattcctagctcttttgtatttgataaaacatattaaataaagcagagctgctatcttactgtactgc

SEQ ID NO: 128 - DNA, 1200 bp, Phaseolus vulgaris
tgttagggttttttttctttccaattcccccttctctgttctcaatttgcacactcaacttgagttttacactcttggtgctgcgaatttcaaactgagtaacgtaaccgtcgttcgtgtgtttcgcttttcagatggcgttgcaggagaggttggacaagttcaagaagcagcaagaaaagtgccaaacgacactgtcaagcattgcagcaagcaaggccgcagcaagccaaaaatctgccgcgcatggctcggccaatggaagaaacgcgccccctgcggttaagttttcgaacgacacggagaggcttcagcatattaacagcatacgtaaagcccctgtgggtgctcagatgaagcgtgttattgatctccttctggagacgagacaagctttaacaccggagcaaataaaccaggcatgctatgttgacataaaggctaacaaagatgtctttgagaatcttaggaaaaacccaaaagtgaattatgacggcctacgattctcttacaagtcaaagtatggtcttaaggacaaaacagaacttcttcaactgatacgcaagtatcctgagggccttgcggttattgacttaaaagatgcttaccccactgtgatggaagacttgcaggctttgaaagctgcagggcagatttggctgctgtccaactttgattcacaggaagacattgcctaccctaacgaccccaaattgcacattaaggttgatgatgatctaaaacagcttttccggggtattgaattgcctcgtgatatgattgatatagagaaggatcttcaaaagaatggaatgaagcccgccaccaacactgcaaagaggaggagtgcagcacaaattcaaggcatttcttccaagcccaagcctaagaaaaagaagagtgaaatcaacaagagaacgaagctgaccaatgcccatcttccagagctttttcaaaacttgaacaattcctgattagctctcaactagtgttgtattagttcaaatagacaatgtatcagacagcctataaactagattattagactgaaatagtcaggaggttcttgctgctctttcctactcttatttgtttagaatttttattttttattttatacatcaaggctgtagctgacggactgttgtgatctgtaacaactggtaataatttgtgaatccttgtatattaaaaccatgt

SEQ ID NO: 129 - DNA, 1091 bp, Phaseolus vulgaris
ttgattttcttcttcctttttcctaagagaatctaatctcaatcctcaacctccttattgcgcatatttcttcagatttcttcattcctctttcaaccttttctcttccccttcacatcctcgttttctccgaacaaaaaataaaatctttgttttgttttcttgttttttgttatttgacttggttgtctgaatcggttgtggcagaagggtcgtgagacacagcgatgcagagccaacttgtgtgcaatggttgtaggagccttctgctttacccgagaggggctaccaatgtttgttgtgcattgtgcaacacgattacctctgttcctccacctgggatggaaatgtctcaactttactgtggaggctgtaggacgttgctaatgtacactcgtggagctacaagtgtgagatgttcctgctgtcacactgtaaaccttgttccagcatctaatcaggtagctcatgtccattgtgggaactgccggacagccctcatgtatccttacggagctccctcagtcaaatgtgctatttgtcactatattactaatacgaacaatggacggcttccaatccctgtcaatagacccaatgggacaaccaatgctggaacattaccttctacttcaacatcaatgcctcaaactcaaagtcaaacagtagtagtagaaaatccaatgtctgtggattcaagtgggaaattggtgagcaatgttgttgttggcgtcacaacagataagaaatagcagcatcacacatacaaggtacagtacatgtcacgaggcattatcgcagttactgtcacatgaagatattgtttgtgtatatgaatatatatatatgatattgcagcctgcaatggttcaattggaatcaatatttttccgatccaagagttggatggatatgtatgtatgactgtatatgaagcggacaggttgtgaaaagggcataaaaacctgttttgtgtgattgccagagcctgctttgttgtttccttggtactcaatatccaaatcaattagttcattcagattatatgttcactttcaaatcctagactaccatttcttttatggcttctg

SEQ ID NO: 130 - DNA, 1898 bp, Phaseolus vulgaris
atggaggtggatgaagaagcagccttaaatcaaatttgaaaagccttccctaagcccatgtaatcagttattgggcctagtgacatacctagcagaaccatagtggaaatctgaagaaagttaacacgacgccgtttttcacagcgaacaaaatcccaggaaaataaggatgtcagagaaatgggacaaaaacctaaaccctgcaatgcaaagttgagtttacagttaagagagttagtagagaaatcgaagctgaaaggataatagttagttccaacaccattctttacttatcagagatggcttccgttgatagtagaaagaaatcagtggttttggctctttgcaagtacctttcattggatcccagtgttgttccggctgaaagtttagacagtgatattaagagtctttacttgaaaatcaaagcggaaaatggacacggggataatcactctgatgaggtgttgaagtgggtagcatttgcagaagccttccctgtggccaatgatgcatgcttagagaatctcaagagattaaacgatgaattgtctggaaagtctgtacttctgggcaatggactgaaaccctctgaagccgatgttatagtctattcagtggttcattcttccctggtcaacctttcagatacaaacaaagaaaaactgccacatgtgttgagatggattgattatatccagcataagcaagaatttgtaggtttgtttgagaagatatcgttgcagaagcctggatttgagcctccggtgacaaaacctgttggagtcgtggaagctgatttaaaatcaaagacggagcaaagcataaagaatgtcaacaagtcagaaatagaattatgcaaggataaaaacaaaactgagggaaaggccactggaagaaagtcaacaggagacaaagaacccaccaaagcgaaggcaaaacctgctgaaaaagaagtagctgagaaagagaatgaagttagcgtcagtttgcttaatattcaagtaggattaatttgcaaagcatggaagcatccgtctgcagatagtttgctagttgaggagatagatgttggggaggccaaattgcggcaggttgtcagtggtttggcaaagtacttcagtcctgaggagttaacgaatcgtcgtgttgtacttataacaaatgtcaaacctggaaaactacgggatgtggtgtctgaaggtctggtattatgtgcttcgaatgaaggaccaactgttgtggagcccttgctccctccagaaggagcaaaaattggggaacgaatttctttttctgggattgatggaaagccagaggatgtgctaaacccaaaaaagaaacagctggagaagattacaccgcatcttttcacagatgacaagggggtggccacattcaagggaataccatttatgacgtctggtggaccatgcacatcatccattcccagagcaactattaaatagtgggagagatatggtccatatccactgttcatttgttcttcaccactctgatttttggcaccacaaaatattcaaagttttttattacgtcaataaggcgttactatcgtatcttgttggcaagtttatgttgcagttgcacttgcgtggtattaaatgcttcaaatataatcttgaatccagtgattcttgagtttatactatagtaagtaactctacacattgcaaaaaaaaaccaaagactatttcaaattatacaacaacctacctaccacgcgatattatgcagtccttaaatgctacaatcatgatatcgaatccaatgagtggggcgaatgctacaataactatatgcattgataaaagaacgcaagacccaaattattttacagttagctagccaatgattattgcaattcctcataagta

SEQ ID NO: 131 - DNA, 502 bp, Phaseolus vulgaris
agaaacagggataattgtgaaggaatcgcatcacattacagtgaactgaggacaatgtctgctgaatcgccaagttctgttcgtaaagtggttattcatctcagagccaccggtgatgctcctattctcaagcaatctaagttcaagatagcaggaactgataaattcgctaaagtgatagattttcttcgccgtcagctccacagggagacattgtttgtgtatgtcaatagtgctttttcaccaaaccctgatgaattggtcattgatctgtttaataattttggttttgatggcaaactggtggtgaactacgcctgctccatggcgtggggctaaccctgaatggtggttgctggttaccaaagcttcaaattgtgaatacatattgcttcatttcagaaactgggacatgcatataatcacagtacaccatttctttttaactaggatcttacaggataagtgaagaaaacctggacaggactctaacctggatatt

SEQ ID NO: 132 - DNA, 1667 bp, Phaseolus vulgaris
gattgttgagagagtgcaattgagagagcagaaaaatggggttggaatctgttggagatttagccattaacatgattcttaagaagttagaaggcgaagatgttgccagagtcgcttgtgccagcaaaaggtttaggttttcagcttcagatgacactctttggaccaatctctgcttccatgaactcgctttgacccaacccatcgatcatcttggaaaccccttcccttccttcaaggaatgctatcaagcatggagaggagcttttgatatgtatccatggcctcttgttaagcgtgtgaaaaagtgctgggatagaataaagacctggttgaccaataactttcctgaagctgaggccactctttgtaaaggggcaactgaagctgacattcagacgttggagaatttgttaaaggtggaattgccacttcctacaaggatcctttatcgctttcataatgggcaagaaatcgtaaaagcaaatccagaaactagtacatttggaagttctttgggtctaattgggggttactccttctataatcatttggtgaatgtttatctattgcctatacgtcagataatccaagaaactgagcaaattaggcgtcacttgagctttttaagaagatccaagtttgttcttgtggctgcttcatccactttccgtagaaagttgtttttcctcaactgttccaatggtcaactatatgttggaaccaataaacttcattctgaaaaagacataatcccttgtgtacctcaagatctgataagtttacatcgggaattaaatattgaagagcaacaagatgccatgctactgtggttagaagaacatggtcgtcgtttagaacatggcttcatcaaactctgtgacaaagaaaatggaagaagcattaatcttttcccagaagaaccccctttttgttcaacggctgttactaatggtgtgaaggtccgtgcatctgcattgattatccctgagtttattgatcctcaagatgagaatgaaaagtacttatttgcttattcaatccgcttgtcccttgaaccgcaaggatgcttgattaatggaatgtccttcaactcttgtcagctccattggaggcactggatcattcgtgctaatgatgatgttgtatcggatttcaatggagaagctgttataggacagtatccacttctgcatcctggtgcagaagaatttgtttatcagagttgcacacctctaccactgccatcaggttccattgaaggttcttttacttttgtacctggcagcttggcatacccaaaaggagacccttttctagctacagtggcacaattccctctccagctgccagactatattttctgattttgattctgaatggaaatgaagtatctctgatggcaattgcagctccccaatggcgtttgtgcacattatgtgactttagtgagagtggcttggttcctgagtttttattcttttaagtgttggacctgcacaatttccctatatataatctatctgtagtaatattggatttcttgcgttattcacttgtctcttaactttgtaccctccattcactctgtatatatgcatgcgattcaatgaggtttttgtcatctaatagaatggtaaaagaaatcatcttcgtatttgggtaaa

SEQ ID NO: 133 - DNA, 977 bp, Phaseolus vulgaris
gcaaaggaatatttgtaggttgtaggttgaggaggaaccactcacaagcaaggagagatcaaagaggcaagaacgaggcttcaggctgtcttgaagtcattacaataccttaaacatttcgttttcttctgaacactcttcctctcgcatttgaccttctcacacagcaaatgagtcgccatcctgaagttctgtgggctcaacgttctgataaggtttaccttactgttgctctacctgatgccaaggatgtttctgtgaagtgtgagcctcagggtttgtttagtttctctgcttcgggggttcaagatgaatcctacagctttagcttggaactttatggatccattgaacctgagggttgtaaaactaaatctggcttaagaaacatactatgctcagttcagaaaggagaaaaaggttggtggaagaggctattgaagtctgaagagaaacctgctccgtacctgaaggttgattggaacaaatggtgtgatgaagatgaagagtcaacttctgatttggtatctgatgatgattctcggtttgttgatcaagatgaggggagcagtgatgatgatggaatgttgtatcttcctgacttggaaaaggctaggggatagtaactgttatagtactaacaaagatataagaagcatcgggaacatggaatcatgttgaactactttataagatgcactgtgatatcattggctgcattgtatatagaatcaaagtagtgctttggaacacatagtctcgatcttttgtgactacttggaacctattctgttgagggtttctttgaaaggaattctggttgcatcatataatcaatctaagattcttctcaaccacattgttgtaagattaaacaaccctaactttgaatacgtgtcttttcaagcttgcaacttttgtttgaaatgctattcttccatattttatttcatttttattggatttagcgagggaaa

SEQ ID NO: 134 - DNA, 5963 bp, Phaseolus vulgaris
acactgcacgattattcttccttctttctttcgcttcttccttttgctatttgatctcttttcctctgaatcaccactgcgttgtcgcttctcgttctaggttttgcagccatgggggctgcgtggaggcagttgaaggtcatgctccgcaagaactgcctcctcaaaattcgtcatcccttcgtcactgccgccgagattttgctccctacgattgtattgctgctgttagtagctataaggacaaaagaggatacacaaattcatcctgctcaaccgcacattcaaaaagatatgtttgtggaggtgggcaaaggcatatcacccaactttcaactacttttgcaatcgttggtggatagtggagagtatttagcttttgtgccagatactgatgagacgaagctgttgatagatgtagtgtcaataaaatttccactcttgaagcatgttagtagagtatacaaagaagaggtagagctggaaacctgcatccgctctgatgcttatggtacctgcaatcaagcaaggaattgttcaaatcccaaaattaaaggagcaattgtgttttatgaacaaggccctcaatcctttgattatagcatacgcctcaatcatacatgggctttctccggttttccagatgttacaacaataatggatacaaatggtccttttcttaatgacttggaacttggtgttagtgcagtaccaacaatgcaatacagcatcagtgggtttttgaccctccagcaaatggttgattcattcgtaatattagtagctcagcagtctgacttaaatttcaatgctgaaagtctggaccttccccttcaaggcttcaatgacagtattttctttttgaaaagtccatggactctgtttaaccctgctcacatacgaatagctccatttcccacccgagagtatactgatgaccagttccagtcaatcataaagaaagtcatgggaatattgtacttattgggatttctctatccaatttctcgcctaatcagttattctgtgttcgaaaaggaacagaagattaaagaaggactgtatatgatgggcctgaaagatggtatatttcatctgtcttggtttatcacatatgcattgcagtttggaatttcttctggaatccttacagcttgcaccatgtataatttattcaagtatagcgataagacactggtgtttgcatacttttttgtttttgggctaagtgcaatcatgttctcattctttatatcaacatttttcaaacgggctaaaacagctgtagctgttggaactctatcttttcttggagcctttttcccatattacacagtaaatgatgagggagtttcaataatcttgaaggttattgcttctttgctttcacctactgcctttgctttgggttcaatcaactttgctgattacgagcgtgcacacgttggacttcgttggagcaacatatggagggaatcatctggagtaaactttcttgcatgtcttctgatgatgatatttgatacactgctatattgtgcaattggactttattttgacaaggttcttccaagggagtatggaaggagatacccatggagctttattttccaaaaggacttctggaggaagaaaaaagaagttaaaatatctgggaagaatccagagtcagaagggaatatttcaggggaatatacttccagacctgctattgaagcaataagcttagagatgaaacaacaggagcttgatggcaggtgcattcaaatcaggaatttacataaagtgtatgctacagacaaaggagattgctgtgctgttaactcattacagctgaaactgtatgaaaaccagattcttgccctcctaggacataatggagctgggaaaagcacgacaatctcaatgcttgttggtctgcttcctcctacttctggagatgctctggtattcggaaagaatattgtatcagatattgatgagatacggaaggttttgggtgtctgcccacaacatgatatactatttcctgaattaacggttagagaacatttagaactatttgccatattgaagggagtggaggaacactcgttggacaatgctgttattaatatggctgatgaggtgggccttgctgataaaatcaacagtattgtgagaactctttctggtggcatgaagaggaaattgtcacttggaattgcattgattggaaacagtaaggttataatccttgatgaacctactagtggaatggatccatactcaatgcgcttgacttggcagttaataaaaaaaattaagaagggaaggataattttgctaactacacattctatggatgcagtagatgaactaggtgacaggatagctatcatggccaatggttctctgaaatgctgtggaagttcccttttcttgaagcatcattatggagttggttatactctaacccttgtgaagtcagctcccactgcttctattgctagtgatatagtataccgtcatgttccatctgcaacatgtgtaagcgaggttggaacagagatttctttcaggcttccaatgacatcctcatcagcctttgagaggatgtttagggaaattgaaggttgcatgaaaaaaccagttttgaacatggaattgagtggcaatggtgaaaaggagaatcttggtattgaaagctatggtatatctgtaacaaccctggaggaggtatttttaagagttgcaggatgtgatgatgatgaggttgaatgctttgaagaaaataagcattctctgatatctgactctgtggcttcacttcctactaatgatgatccttccacaaaaataagttatcttaaaacttttggaaattataagaggattctgggtttcatggctaccatgttgggaagagcttgtcgcttaatttttgctacatttcttagttttatcagcttcttgggtatgcagtgctgtagttgctgtctcattactaggtcaacattttggcaacattttaaagccttattcattaaaagggcaatatctgctcggagagatcacaaaacaattattttccagctaataattcctactctcttcctgtttgttggtcttctatttcttaagctcaagccacatcctgatcagcaatcactgaccctttcaacttctcactttaatcctctattgagtggcgggggcgggggaggtccaattccatttaatctatcttttccaattactgaaaaggtagcacaaaatatcatgggaggttggatacagaagttgaagtcgagctcgtacagattccctaattcagagaaggaattggctgatgcagtggaagtggcaggaccaactctgggacccgctctactttctatgagtgaatatttgatgtctagctttaatgaatcctaccaatctaggtatggggcaattgtgatggatgatcaaagtaatgatggaagcttaggatacactgtattacacaactgttcctgtcaacatgctgctcccacctttatcaatttgatgaattctgctattcttaggcttgcaactcaagacacaaatatgacaattcggacacgcaaccaccctttgccaacgacacaaagccagcgcttacaacgtcatgacctggatgccttctctgctgcagttattgtcaacattgctttctcttttatacctgcctcgtttgccgtttcaattgttaaggaacgtgaagtgaaagctaagcagcaacaactaatcagtggggtttctatcctgtcatattgggcttctacatatatttgggactttgtgggcttcttgtttccagcctcttttgccatagttctcttttacatctttggtctggaacagtttgtcggaggcgtttctttgttaccaacaatcctcatgctattggaatatggacttgcaattgcatcatcaacctattgccttacatttttcttttttgaccacaccatggctcagaacgtggttctgctgatccactttttcaccggattgatactaatggttatctcattcattatgggactcatgacatcaacaatgagtaccaattcttttcttaagaattttttcagaatatctcctggattttgttttgctgatggtcttgcttcgttagctcttctgcggcaaggcatgaaagataaaacaagtgatggagtgtttgattggaatgttactggggcttccatctgttatcttgctgttgagagctttagttattttctgttgacacttgcacttgaaattttaccttctatcaacttgacttcattcatggtcaagaagtggtgggaaaaaattaatatcttccggcatgatagtccttatttggaacctctgttggaaccttcttccgaaactgttgttatggactttgatgaagatgtagatgtaaacacagaaagaaatagagtactttcaggttcccttgataattccattatctacctgcgcaatcttcgtaaggtatattttgaggagaagcatcatggaagaaaggttgcagtagattctttaactttctcagtccaggaaggagaatgttttggctttttaggaacaaatggagctggaaagaccacaactctttctatgctatgcggggaagaatctccttctgatgggactgcttttatttttggcaaagatatatgttcccatccaaaggctgctcgtcgatatattggatattgcccacaatttgatgctctattggaatacttaactgttcaagagcatcttgagctttatgctagaataaaaggtgttccagattttgcaatggaaaatgttgttatggaaaagttggccgagtttgacttgttgaaacatgccaataaaccatcattttcacttagtggtgggaataaaagaaaactgtctgttgcaattgcaatgattggtgatccacctatagtcattcttgatgaaccatcaacaggtatggatcccattgccaaaaggttcatgtgggatgtaatatctaggatctcaacaagacgaggaaagactgcagtaattctgactacacacagcatgaatgaagcccaagccttatgtaccagaatagggataatggttggtggacaattacgatgcattggaagtccacagcatctgaaaacaagatttgggaatcatctggaactagaggtcaaacctactgaagtgagttctgtggacttgcaaaccctctgccaagctattcaagaaagacttcttgaagtcccgtctcatcctagaagcttacttaatgaccttgaaatttgcattgggggcactgactctgtcacatcagcaggaaatacctccattgcagagattagcttgacacgagaaatgataagcttaattgggcactggcttggcaatgaagaacgagtaaagacattaatctcttgtacgcctgtctgtgatggagcttctctggaacaattatcagaacaactatttcgaggtggtggcattccgttgccagtattttctgagtggtggctgtctaaacaaaaattctcagaaattgattcatttattctctcttcatttcgtggagcaagatgccaagggtgcaatggtttgagcatcagatatcagttaccatataatgaggatttttccttggcagatgtttttggacttcttgaaagaaataggaatacattagggattgcggagtacagcatcagccagtcaactctagagacaatatttaatcattttgcagctaatccatgaggtgtccccattttagaatccctttcacaaattgctgcttgttggctataacgtgttaaatgtatcaaaatgatgatactccttcacttctcctgcttggattaaacatagaggccttggacgagattctaaggccatggatattgtacagtcaaagattatagtgccattgaattgtaaatatattaattaatctt

SEQ ID NO: 135 - DNA, 932 bp, Phaseolus vulgaris
acacacagacaaaaccctacctctcaaaaccctaatcttgaagcactgtaagtgtgatatggcaagagccatttccttatccggcgcacggttcaccatgcgccttatctccaccaccacatttaacgccacattacacaaaccctcatcactttcacttcgttcccgtcgttttcttttccctctctccaatgccatcgttcatccctccactcgcgttgccgggatccgctgccgcgtcaaccgcgctggcgactccgcctactcgcctctcaactcgggatcttcgtctttcagcgatcgccctcccaccgagatggcgcctcttttccctggctgcgattacaaccactggctcattgtgatggacaagcccggtggtgagggcgccaacaagcagcagatgatcgattgctatatccaaacccttgccaaagttttaggcagtgaagaggaagctaagaagaaaatttacaatgtttcctgcgagaggtactttggttttggctgtgagattgacgaggaaacctcgaataaattggaagggttacctggagttttgtttgtgctacccgattcgtatgttgatcctgaaaacaaggactatggcgctgaattatttgttaatggagagatagtccagaggtcacctgaaaggcagagaagggtggaaccacagccacaaaggcatcaagacagaccaagatacaatgatagaacaaggtatgttcgccgcagagagaacactcagtgaaggaccaaattgtgatcggcagagggatgtgatgtgtatataaaccatggaagtactgtgacatgcactgtcttagtcttgcttttgtagacattctatattatattttcaggttggacttctattggtgttagtgctcgaactcttatggtgtattaagatgaagtccttttgttac

SEQ ID NO: 136 - DNA, 1635 bp, Phaseolus vulgaris
aaatcctgaaccaaaagggttctttgcagtatcttcttccctaaacctaccgagttcgccacccggaaccggcaactaagtctgactcggttgtttctcactgagcaatgcaagccgtctcaaacgctcgccgagtctctcggttgttcctttcgcctcatctccgagcctctggagctcctcactacaccgcggtctctcctttctcagggctcgcgcaacacgtttaccggcgagtgacaactgatccgatacactgcttcttgtctaaggcattttgctcttcaggagtggataccgttgaagaagctccctcaggggatgtgaaggaattatacgagaaaatgcttgactctgtaaaagttaaacgatcaatgcctccaaatgcttggttgtggtcaatgatttcaaattgcaaacaccaacacgatattagacttctgttcgacattctgcagaacctccgcatatttaggttgtcgaatcttcgaattcatgacaattttaattgcaatctctgtcgtgaagttaccaaggcgtgtgttcatgcaggagctcttgattttggaaagaaggctttgtggaagcataatgtctatggattgaccccgagtattgcatctgctcactatttactgctgtatgctaaggaccacaatgatactaaactgttggtggaagtaatgaaacttctgaagaagaacgatttaccattgcaaccagggacagcagatatagttttcagcatttgttacaatacagatgactgggtgttgattagtaagtatgcagaaaggtttgtgaaggctggtgtaaaactacgacaaacctcacttgagacatggatgcaatttgctgccaaaagaggggacaccaaatcattgtggaaaatagaaaatttgagatctgatacaatgaagcagcacactttggcaactgggttttcttgtgccaagggtcttctgttggaacgtaaacccagtgatgcagttgctgtcattcaagttctaaatcagaccttgtctgatacaaaaaagtcaggcatcaagggtgaacttcagaagcttgtatccgagtggcctttagaagttattaagcaccaaaaagatgaggacagaaaggcattagcagcctctttgaaatctgatatccctatcatggttagtgagttgctgagcatgggtcttgaggcaaatgtaagtttggaagacctaaacaggaaggaaggtattccacaatagcattgagttcagaatttgattacattgtatttcagaatgtgcttatttgcggagtaactccttacgacgatgcttccttagccaggatatagataaggagtctgcgatcatagctaatgttgattactaaattaaaattattactttgcttccattcttaccatttcttattttatgtctccaagtacttaagtttttggtagcatactatgggatttagtcagtgtttgaaaaccgaaattttcggaagattatgttgaaacaaaaataatctggcatgtgtactctactggatgaacggcaagcaattgctttggttggcctcgaacttgtattcacatttcatttggttgataatttgggttaaataattcctgacgaaaaaaaaagaaaa

SEQ ID NO: 137 - DNA, 902 bp, Phaseolus vulgaris
cttttctcactcttattatttccttcctcactcataatattcaaccatgtcgcagttgaacggagcctactacggccccgctattccgtcgcagaagtcctaccaccgcccagggcgcggcggcggctgtggctgctgctgcggctgcctcttcagcctcatcttcaagctcatcctcacggtgatcatcatcgtgggcatcgccgcgttcctcttctggctcatagtccgtcccaacgtcgtgaaagtccacgtcactgacgccaccctcacggagttcaactacaccaacaacaccctccgctacgatcttgccctcaacatcacagtgcgcaaccctaataagaggctgggcatctactacgactatatcgaggcgcgcgcattgttccacgacgccaggttcaactcccagtaccccgatcgcttctaccaggggcacaagaccacgaacgtgttgaaccccgtgttcaagggggagcatattctggctctcaaagctgaccagagcgccgaatttaagaaggagaacgccactgggttgtatgagatcgatgtgaagatgtacctgagggtgaggttcaagttgggcgtcttcaagaccaagacgctcaagcccaaagtcagctgcgacttgcgtgtgcctatcaagggaacagccaccgcctttgaaaccaccaagtgcgactgggatcgttgatgggttcggatcattccatctacccgacccgacctgttttcacgtcatttccggcttttcatatttgtttattggttagttttggacacagtcgtacttcttgtccttcagttcatacatattattattattattattatactgcatttcattgtatgtatctacgcttcactattgtatcctctgggggaatttttggttt

SEQ ID NO: 138 - DNA, 1440 bp, Phaseolus vulgaris
agaagtggtagtacagaaaagaaagagagaagtgagggaaaagggtgaaagaaacaaagggggaaataacaggcttagcagcaaaaagtagcacctcccctaagcttatcccagcgccatactccacccacttccagtagtttcagtaacactcatgggggaggaggaaaagaaaccagaggaacccaaggccaaggagaaaaaaccagaggaacccgaaaagaaacaagaggagaagaaggaagaaactgcggcaaaaccagcgggagagaaaaaaccagaagaggagaagaaagaagtgactcctccaccgccaccgcctccgcaggagattgtgctcaaagtgttcatgcattgcgagggttgcgctcgcaaggttcgtcgctccctcaaaggattcccaggtgtcgaagatgtactcaccgattgcaaatctcacaaggtggttgtcaagggagagaaagcggatcctctgaaggttttggagagaatacagaggaagaatcacagactggtcgagcttctctctccgatcccgaaacctccagaggagcagaaggtcccggaagaagaaaagcccaagctcgaagagaaagttgaagagactccgattgtgacggttctgaaagttcacatgcattgcgaagcttgttcactggaaatcaagagacgcatacagagaatgaagggagtggaatcagctgaacccgatctgaagaactcagtagtgagtgtgaagggcgtgtatgatccagagaagttggttgagtacgtgaaaaagagaactgggaagcacgcagcgatcgttaagcaagagccagaaaaggaagagaaggtggaggaaacaaaggaggcgaagaaggaggaggttgagaaagagaagaagagtggtgaaggagaagaaaacaaggaaaaaaaagaggaagaagcaaagggtgagaccaaagcagaggaaacagcagcatctagtgaagacagcaacaaggttgttccagaggtgaagattaatgaatccttctataactcaccaaggtatggcatggaggtgtatgcatatcctgcacaccctgtacaccctgtacaccctgcataccctgggtattaccatgcctaccctccccagatgttcagcgatgagaacccaaatgcttgcattgtcatgtaaaaatggaaggtgtcaagggtgatatgggaaaattgtgaagtatgtgggtgggtgataatatagattataccctttcttatgttacttatgcactgttgtactattcctgctgaaagtacactgtatgcataaactatagaattttcaattttgtaagacttcttttgctttatgtttaagtagaatatactatattacttaaaaatgagaaaaaaataagtgttttggctgactgcatattcaagtttcaaaataagatgattttttttttcaaa

SEQ ID NO: 139 - DNA, 1578 bp, Phaseolus vulgaris
catttttacaattcgagaaataaaagaaagggagtgccgggtgaagaagcatttcctctcctctaccatggacagcgtttgtgcttcgtctccgccgtttcagaccggaccgtccggccacccgcgccacttttacctcgctgttgacaggctccacttcaaaatgcaaacggtaatcgaactcgtggatctggtggctcgacgtccatccttgcccatcgtcgtctgttgcagcacgcgcgacgacctcgactctctctgctcctctctctccgctctccccttcgtttcctcctctgctctgtacagtgatctcgctgaagatgaacgcgctttcctcttggaaaagtttcgacaggtaacagctcagtggaatcagacgaatcacggtggcgcgccgaacgaggacgagattgggaaagacgagaggtctcatatgatcattgtaaccgacgcctgtctccctctcctttcttctggagaacttcccttgaatgctcatcttctcattaactacgagttaccagcaaagaaggagacatacactaggcgattgacaacttgtttaacagccgatggaattgttattaatatggtggttggtggggaagtggtgactctaaaaagtattgaagagagcagcaatattgtcatgcaagagatgcctatgcgaattcttgacattttatgaagatctttagtcttgctctttcctgaagaaagcaaaatttgatcgcttgcactcatgaatggttcaagacatgaagctcgctcatttctttgaatattctgggagtagtcacttgtcagtgctccaaaaaaatactgtcttttattagtattttggatgtgtagatttttatgctagatgacatcttttattggttgtttaaaattagaacacagaaatttggtagaaatgacaaacttcttagtcttctcttttcttggaggtataattgtaatgtatagttcaacattgttaaaggtatttgaggggaggaagcagttgagggtctattttctctccctctctgggaaagatcaatggaaataacttttgtagttatatcttcgggagaaatttaagaatgaggtggaatgccaaacacgtggtaaaatgctcgacatgtacaaggaaacttataatgtataaactaagcattgataatgctcgacatgcagtatttgtggcatgtatcgcaatgtagacagtggaacacagacattgacatgtagactatgtcaaggcaaaatttactagttgaagtgtcctgaaatctgacagtaccacttcttacgtggttagttttgcagaaaataacaggcctttaatagcataaaagtgcctgaaatctagggccttgtatttgtcctgaccattgcttgggaaaacactgaagcaacgaagcacttaagcagatttaacaagtgtactaatactgtatgcagttttcattgagatcaccctgctgtgagctaattttctttgctcttgcagggtaggaattgtgccattttcaattaggcttccatgttgaacagaatatttgaagaagataaaagaggttgagaaga

SEQ ID NO: 140 - DNA, 822 bp, Phaseolus vulgaris
tctcacttctcactacttttttttctaggttgatctgaggaattcttttatattgtcccgtgtttcttgtttctgagtgttgattttgaaggagaaatgagtagttacttgggtgcaggtgttagtactgggactgtcccagttaaccacgacacaaatgggaaaatgtttgataggaggataaggataactgagttggtgttgaggtgtgtgatcctaggtttgggagttcttgcagctgttctcgtgggaactgattcccaagtcaaagagtttttctcaattcagaagacagctaaatttacagacatgaaggctttggtattcctggtagttgcaaatgggttggctgctggcttctctctactccaagggctgcactgtatcatttgtgtggtcagaggaagaacactcttaagcaagcccctagcatgggtcattttttctggtgatcaggtaatggcatatgtaacagtggcggcagtggcggctgcagggcaatcgggaatgttagcaaaggtgggccagccagaactgcaatggatggagttgtgcaacatgtatggaaaattctgcaaccaagtgggagaagggattgctagtgcttttggggttagccttagtatggtggtcctgtcttgtatttctgctttcagtctcttcaggttgtatggtggtaacagaatgaaaaatgtatattggtaggttggaaaataccattgattcaagttaatagcctacctaccactgaatcaattggccagcaattgttctgcaacttgcaaggttcttctgagtatggtgtatatgcagtactgaatg

SEQ ID NO: 141 - DNA, 1367 bp, Phaseolus vulgaris
cattcagtcaaccttatacaatcacacgcaacccatttctgttaccacaataactataaaatctttcacaacaaacacgtgtcttcattcttcaatcatcatttctaactgctcacaccaacgccaccactccattccccaatgcttcgttttcttttgctgctgttcttactgggcctgggagcccgggtggagtcacacgaagaatccggcccctggagctgcgactccgactccgagatccgagccgaggccaatttcaaacccggcgttattacactggatggccgcgccgacgattggaaggacattgatgggtcctacttccccctcctccccgccctcgaccctgacgctgagaatgaattcaaagggggaaagatgagcgttaagagtggccattacggccgggatatcttctttctgttgcaagtcgacggtgattatgcgtactccaaaggtgaaagcaacaaatgtccatctgttgctctcatgtttcagattggagatggtgcctcttatcataatatgggtggctgtgaggaacattcaacctcatgcactaacaagacctgcaaaggtcatgaagtggacattatgcacttttccataggaagtgctattccgggacggctttatggtggcaatcccctggacaatagggatggaaatggtggcgacaggtttggtcacttggttgatctgtattcctggaatccacattgtagatacttggacggaactggtcctccaggttctgctaatgattctagtgcgcagaatgactggaagggtgcctggtggcatagtagtttcacggttcactcaggtttcgtagaggatcagagtccatatgcagataatggaaaaaagggcacatacttttttgaattttccaggcctttgaggactatggatcatcttcaacaggacgtgcaatttaacatcggtggatccagtaagatgtctgttgcattctggtatccactagatggtcagccatggcatggttcgggacactactctgttaactgtgattgggttcccattgacatatctattggcggttctttgacgggcaactcagtagatgcagcatcaagtagttcgtggaatgtggctagtgccttttccgttatactatcagtagcagcactttgtgtatctgtgtttgtgagctaccgtgtgttcaatcccaagagtgtttcctttacaccgttagagaacaacctttaaatattgaaccaacagcttgagtttgggattgtactattcattacgcttgtactagataggtttgtactgtgtagtgctttctctttgctctatttttttagttgtaactgaagcattactttagttatttt

SEQ ID NO: 142 - DNA, 1120 bp, Phaseolus vulgaris
gaaatacgtggtagaaaaatatctcatcgaacttaaaaggggattggacgtgaactgatactgtttgcgtggctgattgttaacaaatctgacgatgaagtgtgtagtgttgctgtcagtggttgcgtgcgccttcgcggtggcggtttgggcggcgaacggcgatgacagcctggttccgccgcgacgggaagtgtacggcaatggccgaatattcgacatcagtcaccggtaccaccccgagatgccggagtttgaatcgaaggacggcatagggcagttcctgtggcttccgaagagcatgaagaacggttccatcgctaacaactccgaaatgaagctcccaacccacaccggcacgcacgtcgacgctcccggccacttcttcgaccactacttggacgccggcttcgacgtcgacacgctcgacttggatatactcaacggacctgctctgttagtcgatgttccaagagatagtaatataactgctcaagttatgaagtcgttaaatattccaagaggtacaatacgtgttctcttccgaacgttaaatacagacaggcggcttatgtttcagaaggaatgtgacacaagctatgtaggattctcagtggatggagcaaagtggcttgtggagaacactgatattaaacttataggagttgattacctatctgttgcttcttatgattacttgatttcatctcaccttgttcttttaaaagatagggaaatcattcctgttgagggcttgaagcttgatgatgttcctgcaggattttattcggtccattgcttacctcttaggttgtctggtgctgagggatcaccaattcggtgcattctgattaagaattaaggaaacagtgttgtgtcaaatgcagcaggaggtgcaaatcatcagggatttatgcatgtacaaggcgagagggatgcaacaatcttagtattacgttggatttggtgtccttttgtctgttaggatggaactgataaattcagtggttcagttatggagcaagatagtaaatcaaggtgttgtgcatcgagttttgtggcttaggttcactgttactagatacacgcacaagacagtattttttagatattagcatta

SEQ ID NO: 143 - DNA, 1087 bp, Phaseolus vulgaris
tccctcctccttcctaattctccttattatttagttctctttgtcccttataagcctgccctcgttctccaccatcacaatcaattttccttatctactccattcttttctcttccactccctttttctctctctttctctttaaacaaactcacacaacaacatgtgcgcgcccatatccgaactcgaacaggaagagctgctcgaaaagctagaggtcttcaagatcaaaggccgcgacaagcatggccgcaagatccttcgcattattgcaaaattcttcccagcgcggttgatcagtattgaggtgctgaagaagtacctggaggagagggttttcccgaagctggggaagaggaaattcgcagtgctctacgtgcacaccggcgtgcagagaagcgagaatttacccggaatatccggtctccgatcgatctacgacgcgattccggccaacgtgaaggagaatctggaagccttttattttattcatccgggcttacaggcccgccttttcctagctaccgttggccgcttcctcttcaacgctgggttgtatggaaagttgaagtacattagcagggttgattatctgtgggagaacatgagaaggaacgaggtggagattccggagtttgtgtttgatcatgacgaggatttggaataccgtccgatgatggattacgggttagagagtgatcacgccagagtgtacggtggtgctcccactatggattcacctgtgaccacgtattccatgaggtgcatctcataggattctctccaggggattcagtaaccctttggccccttgtttcctgcgttagttagactgggcctagctgttagttaaatgggcccatagctatgtggatgttgatattgtgcagaaaaaaaaaaaaggtgccattattaggttttgctaatgtggtaatacttatccaatagcattttaagttttggttgggggattcagttccctgatattaaaaagaattccacccactgattcttcccatgttctttgctctttcacattctcccattcatttctcaatcttatcagaatctctccactatcacttta

SEQ ID NO: 144 - DNA, 442 bp, Phaseolus vulgaris
ggtcggagtcttctgtacagaatcagaagatctgatcggtataacaacaaaacgatgggagctgaaaatgaatcacaggaaaaacgcacacaagagaggccaaagtctactatcacacaggaacagttcctttcatggaagcgccaaaaggatgccgctgtatcagccaacaaagctgaagtatccaggaaacgtgcggaagatattgcagcaggaacaattcaaatgaatggccgtgagttgtttgcacatgagccatgggtgtttgataactcacaatattgagttcttttagagctgtggtcatgctttgaagacttttattgtaaaggaagtatttttatttatgcttttttctgggatggtggctcgtcaattgcatttcattttcctttttatataagtattttatttttaagtacatctttgcttgtaccaagac

SEQ ID NO: 145 - DNA, 1708 bp, Phaseolus vulgaris
atttttgtgtattggagatttcgttataaattgtaatttttatgaatttgtacaacaacatcacatactatctccattattgtttagttttcctttatctggaagaagtttgaaggaacgtttagggtttgaagttgtgagttttgtttctgaaatccaatcggaacagtgagagagagaaatggcgttgaaatttttgaacaagaagggatggcacacggggagtttgaggaacatagagaacgtgtggaaggctgaacagaagcatgaagcggagcagaagaagttggaggagcttcgcaagcagatccaggaggagagagaccgcaccgagtttcgtcttcttcaggagaaagctggcctcgttccgcaccaggagaggttggaatttctgtacgattcgggattgtccgtcgggaaatcttccaattccgaaggattcaaggtccttgaacagttgccgaaatctgatgcggcggatgctccaggctcctctgcttctaaggagggtgcaagcgtgcctggggcattgtttgaggagaagcctcagtctgccaatgatacttggcggaagctccattctgaccccttgctcatgatccgccaacgtgagcaggaggagctggcaaagataaaaaacaaccctgttaagatggctatgataaagaaatcgattgaaggaactgaagacaaggagaaagcacataaaaaggaaaagaggaagaagcaccgttctagtaaatcaaagcataaaaaacagtctgattcagaagatgatcctactgaagggaggaaaaggagtgataatggaaatatttacaagaatcataataaggctcaatctgattcagggtatcaatcagatgaaagagaaaatatgaggaaggatcactatgaagacaaaaaatacagggaaagatcacccggccaccaacagagacagagaaagggaaaagactacaatgaaggtgctgatgacagaaattatagcaggtcgaagtcagagaggagtgtccgtaacagtcaatcaaatccagggtatgaatcaactgaagttgaaaagagaaggatgaatcactatgaagatagaaaatacagagagagatcacccagtcaccaacagagacaaagaaatgacaaagactacaaagaagatgctggtgacaggaattataataggtctaagtcagaaagatatggttcagaagatcagtccaatatagatgccccaaaaagtggaggtgggcgattttctgaaacaagctccaacagatattcttcttcacatgaacatggatataagcgcagaaacgtggctcctaagctttcagaagaagagcgggctgctaaacttaggcagatgcaattggctgccgaagtgcatgaagaacagagatggaaacgtataaagaaggctgaggagtctgatgcacgtgaagcagtccagaataataacgctagtggcaataatttcttggatagtactcagaaaagtgtttatggtgcagacaaagggggaagtgcatcaatagctgagagtgttcgtcgtcggacatattattctcaaggcaggtctggtggtgaaggaaatgcatttcggcgatgaattctgtgtctttacttcaccaatgtagtagacatccctcctgcttctgtcttctttcttggactcctttgttgtataatgtcaaaaactgtttaatttcta

SEQ ID NO: 146 - DNA, 857 bp, Phaseolus vulgaris
gtatgaacctaccgtgcctggggaagcttgggaggtatttggctaaaagttgaagagaaaaatggcaatggcatggttgcagttgcagagaatcatcaccaaaggaggtgctaatttgatctcaacactcccacactctacgccttattcttcttctagattcttctccaaatcatccctctatgttgtgaaggttggaatacctgagttcctaaacggaattgggaaaggggttgagtctcacgttcccaagctcgaatccgaaatcggagatttccagaagcttcttgtcactcgcaccctcaagctcaagaagctcggtattccttgcaaacataggaagttaatattgaaatacacacacaagtacaggctgggattatggaggcctcgtgttgagtccatcaaagcttgattggtttctaactagtatgtagtcactgtttgttagatcatattgctaatgtttagcagcagaagcagaatggcaatgctcgactttacatgaaaagatgaagtcactttctttagagaccacacatcttttcacctcatttatctcttctgaacagagtgtggcatttacaccagttatgtacaatggacttgtcttaattgacagtttttgtttgttacttcatatccccggtggcattattccatattatgtgatgcatcacttgtttttggcgaaaataatattattgagggctttggagtccgagatgctttcatttagttcagatggctgcggttaaatccaaagatgctattgcagtcttttctggttgttgttaattggtccgtgattgattaaatactgtgtttttttataataaaactaatgttaagcagca

SEQ ID NO: 147 - DNA, 850 bp, Phaseolus vulgaris
caaagcagtgaggaagctgagcgttagaaagaaagggagaagcgcaaatacattttctttctttctttctttgtttttgtatctccaagaaaatcatgggttcaatcaatctagtgctctcgtcaaccttgttgctccttttggtcggttttgcaacctccgatattaaccaagacaaatcagaatgtatggacaaaatcattggtctggctggttgtctcacctacgtcagtggtgaggccgcagtccccaccatggattgctgctctggtctcaaagaagttatcgacaaaagcaagaggtgcctctgcatcctcatcaaggatcgtaatgacccaagtcttggcctcaaggtcaacgtcaccctcgctcttaaacttccagaagtttgcaaaacacccactaacataactgagtgtgttgatcttttgcatttgccaccgaattccgccgacgctaaggtgtttgaagggtttgaaaaatccttgacaaaccaaactagccccccttctacccctgctgctactcctgcaaagggagaaaacataaatgatgataacaagaagaatggagggtgggcaaagaaggggttggtgacagaagtggtatgtggaattttaccgttactgttggtatcccatttggtgctgttcctggtttgaagcttaaagatggaaggtaaagtgtgttaggtggttgtgtctattattgtatgggtttcatgtgttatgcatacatagtttgaggatgtaatttctaatttgttgctactaggcgtgttgtccttttcctctagttattatgttcagtgtgtacccattctctcttgtttctgagtgattaattttcc

SEQ ID NO: 148 - DNA, 531 bp, Phaseolus vulgaris
cttctgttctggttaggttacgctggatgcagcacagtgataatgaaatggaagcctccaaactcagtaacagtattcaaaatattcgatgccatcactgcgcaggacccctttcaaaccgcatggaaactagtcactggaatgtttctcctctcatcagggatagcttttctatgattggttctgccgttggcggcaccacaagtgcattttatggattcaatcttgttatgcccattgtccagagaagaataaaaggacccatgtggttgcattttctcattggtgcaccccctgtgatagtattctcttcagcatgcgcgggactagcaggtggtgctgttcctgctgcggcacaacttgtttcctcctcttatcatgcagcataccctcccccatcaaaggatgaatatattcaaaagtcaataaaatgagataattgctttatttatgtgaccatgcattttaaaacgagtgtggtgatgagagttttgttttttccttgtgtaaatactgctggaggttggtacg

SEQ ID NO: 149 - DNA, 2066 bp, Phaseolus vulgaris
cacaagcaccttcatcacacatctctctctttatcccaaaggggtggaacactcttctccaccaccatccatcttattcttcctattcttcttcttctttttcttcaaaccatgtatagtatttgactgtttctgattttgtattcaccatcttcattgtgaagtggtgaattaaacagtttggcatcttcttctcatggtgtttcagtctcattctggatcactcagctcattctcttaatgtcaagataaaaaaaaaaggtagaggatgcagggaagctcgagaattgcaagtaaaagtggaaaagcctcaagcagagaaagaaaattggctttgaaacaagatgtggataggttgaagaagaagcttaggcatgaagagaacattcatagagcattggagagggctttcaacaggccattgggagctttgcctcgtcttcctccatatctccctccatatatactagctcttctggctgaagtggcggttctggaagaggaaattgttaggcttgaagagaaggttgtgcatttcagacaggatttgtaccaggaagctgtctacatgtcatcttctatgaggaaacttgaacattcagtttcagctcctccaaacaagtcaaattcaaccatggatagtcccaagttggaaaaattgaagcttcaatcccaaacagttggtaattcagctgcagaatctgcaacaaggcctaccacaactctcacagaggataaggagaatcaatcctgtagtaattcttccaagagcaggaaccaatcatccaaccatatgaacaaatatgcaatcaaaagacttcacaataaatcaccccagaaaaggttggatcatccaaaaataaagcaagaaccaaggttgaacagccagcaaattgcagatttgagaaaccatagtccacataaaagttcatcagaagctgagagaccaaatataatttcggaaaatattgtgaagtgcttatcaagcattctcatgagaatgagtgctgtgaagaatccaggttctgcatgtgacattccacacttgtgggatctaaaacccaaaatgtgtgatgaagaaacagtgtttggggatccatatggcatctgtttggaatttgggaagagggatattggtccatacaagcaattatgtgcaattgatgctaaatctttcaatccaaaacgaactgcaaatactttgtttttactacaccgtttgaaacttctttttaggaaactagcctctgtcaacctagaaaacctcaaccatcaggagaagcttgcattctggataaacatctacaactcctgtatgatgaatgcattcatagaaaatggcataccagaaagtcctgaaatggctgttgcactgatgcggaaggcaacaataaatgtgggtggacacgtgctaagtgcaacaaccatagagcatttcattcttagacttccttatcattggagatttaccttttccaagggaacaaaaaatcatgaaatgacagcaagaagcatgtatggactggaactgtcagaacctctagtgacatttgctctctcttgtggaacatggtcctctcctgctgtgagagtttacactgcatcccaggttgagaatgaactggaagtggccaaaagagagttcttacaggcagcaattggattttcaacttcaaagttttctgtccctaagttactggattggtatttgctgaactttgcaaaagacttggaatcattgctggactggatctgcctccaattaccaagtgaactggggaaacaagccataaaactcctagaggaaagaaaaactgagcccctctcacaatttgtacaaataatgccatatgatttcagctttagatacttgatatgcacataatttcactttagtaattccatgtacattgcttcactgcaactctttatacaactgtagatcatacatacagacaaccttgggtagaaatgttcagattccttcttaactaaagtgaataaaacaatcactgtataagctatggaatttgaactatgcaagtgtgtagcttttccacaaaagc

SEQ ID NO: 150 - DNA, 948 bp, Phaseolus vulgaris
catttaatgcatgtactggtttgggttttgggttttgttggcagcaaagcagtatcttggatcccacaggtttgagcctacgcaaaggttgttggtcaccggtgactgttgaagagaacgatgacaacgtcaaccatggatgttcttcatttccaccacacccctttttactgtgaggagaatgtatacttgctttgcaagaagttgtgcagtgatggaatagcaaaagctgagggatctgatctttttgttgtcttcatttccaacgaaaagaaacagatcccactatggaatcaaaaggctagcaaaagagctgatggggtgattctatgggattatcatgtaatttgcattcagataaaacaaggagatgttcctccactagtatgggacttagattcaacccttccttttccttcacctctaccctcatacgtgtctgaaacaatacgaccatcttttcaacttttttctgattataacagattattcagagtagtgcatgctccaatatttcttcgtagttttgcatctgatagaaggcatatgaaagattctggtggaaagtgggttgaagaacctcctccacacgagcctatagttgcagaagatggaacagtgcacaacctgaatgaatacattaacatgtctgttgctgatgctattacggatgttacaatcagttcagtcaaagatgtaatttttacccagaaaaatggtgtggtgataaaggataatcagcttgaggaattcatttgtcagttatcttctttagaatagcaccattcatattgctttctggtttgtatatgttcagctgccatccaagatactgtcaaatattgtctcccgtttaatgggtgttgtaaaaaatgcttcttttgaaggtgtctttctgagagtggtgtgcaaggaatggaagtttaagctccatgttgtttttcagga

SEQ ID NO: 151 - DNA, 1305 bp, Phaseolus vulgaris
gaggccttgagtagagctcttggtgctttcaatttgaggcacattgctgcgtgcgaatttgctggtagagtaaaacgccattgaagctcattctaccatttttttcaacgtttcacataaggggagagtagaaaaaaatgattagacgaaggttatctgttctctcaacgtcaatcatcagaagctcaaatcatagcaaacccattctcagatacccttctatccaatttcaaccctttcagctccctcattctcccaatgctcatcgaacaattagtcgtaatgaatttccagaatttcaaggttttcgggcgtacagtcttctgagcttgaatgatttgagagataatgttcccaggaaacagcccacgaggaaggggcgtgggattgggtctggaaagggtaagactgctgggaagggtcacaagggtcagagagccagaaaaggtataaaattgggttttgaaggaggccagactcctcttcgcagaagactacccaaacgtgggttcaagaacccatttagcctcatttttcagccaataggtttgggtagaattgcaaagtttattaatgctgggaagatagattcttccgaactgattacaatgaaaacactcaaggatgctggggtacttgggaagcaagcgaaagatggagtgagattgatggggcgtggttccgagcagatcaagtggccaattcatctagaggtatcaagggttactgttagggctaaggaagcagttgaaggagctggtgggtctgtgagaagggtgtattacaataagttgggcttgagggcactgctgaagcctgagtggtttgaaaagaaaggaagattgttgcctaaagctgctagacctcctccaaagcaaaaggataaagttgatagcattggtcggttgccagcaccaacaaagccaattccatttttagttgaaacaaccaaggatcttccagttcagccacttagttaaataactaatatgtgggcactgttttttaaaattttgtaattctctatggtgtacctcttgctctcaagttgttcatgcagttcatgcattgtgaggttgttaattcagaatgagataaatgaattccttggggacaaatgaaagggaaaatcttgtttattattttatttctttcaaggatttgatctctgtcactcgattgaaaagagccttaggttactgtctctgctgggaatagaatcttagcctcttcattaagggtaatttgcaggaacactcttcactgtttacttttctccaggtatggatggtgcttgtcaaaatg

SEQ ID NO: 152 - DNA, 798 bp, Phaseolus vulgaris
ccatatgtgcctccataaaatccacaaaacacagacactctcctttctccgatcgtctttctgccaccaacatggcttccatcactccacttcacactatgcttcccaacgctgcgcccaaactccccgcatctgtcgctgtttccaacaccaaggtgtcgtttgggccctcacctgggctaccctgcaccgccattcagaggaacaagagtagatcttccagggttgttgtttcggctgttggagacgtttctgctgatagcaccgtttaccttgttgctggcgcggttgcagtggcactcgttggaaccggattccccatcttgttctctcgcaaagacacatgtcctgaatgtgatggagcagggtttgtccgaaaggcgaatgtgacgttgagagcaaatgcagcacgaaaggatcaaactcaaatcgtttgtgctcgttgcaatggattgggtaaacttaatcaaatagacaaatagacttaacaaaatcacttcttttctcctttctttgttttcttaatatgtaactgtttaagcataattatcccctccttcatcctttttcttcgtgtgggacgaacaactttataatatgtcatgataggagagaaaatcacaaatttcactttgttcaaaacctaccattttgtattgcatttattatttgtgtttttctctcccatttcatgatactccaatattcctatgttttctttaagtgtatatgttatatgtaattgaaccatatttgtgaatgcagatgtgttcaataaatatcatatgttgatgttca

SEQ ID NO: 153 - DNA, 1105 bp, Phaseolus vulgaris
agagctacactgcaaggataaagaggcagtgggagagatcgagggcaaaacacagtgttgtgtttgaaattgtatattatgggaatgaaagctttcatatgtctgatgtggttgttgatgtgggtctctcaatccaaaggccgattactgttcatcccatcaaaacccgacccaaatgatgctgctgcctctgctcgttggctcgtctctctcaatttctggggagtcttgaacactatatcagctgatttgggtggagctccctttgggaatgtggtgtcatacagtgatggactgactggtgccggcactggaatcccttacttctacttgacaagtctagatccaacagcaagaaatgcactggaaaatgataaagcttcacttacagtcagtgaataccctcttgggacttgtggcacgaaagacccgatgaaccctacttgctcaaaaatttccctaactggaaagctgaaattggttgatcaacagtccaaggaagccgaatttgctagaaaagccttgttctccaagcatccagagatgaaagactggccgaagaatcacaactttcaattcttcaaattagaaattgaaaatatatttctaatcgactggtttggtggtccaaaaccactcacagtggaacagtaccttcatcctaaaatgaacaatgttggctttttggttcttaatctacagagtgctctttgaattgctattcctattgtgggctgtaaatgtgccatggaattgtaaatagatataccgtcttttgaattgtgtattccctccaaaatactcttgggccatggttctttatccttgtatatttgaactctgtacatgtttatgatcttgggttcttgcccattgtgttgtggctattatatctgaaaatactgtaatcattaagtggaacaaaaggcatcaaagagcaataattgattactatcagttgctaatgcttatctcttttatctgggaatggtttcagtcaaagcatttgaagctcccattgcggcacagcataaaaagattcttaataaaagtaatagattgttcaaatgcttcggtcattgcttctccctcttccatcctgggc

SEQ ID NO: 154 - DNA, 800 bp, Phaseolus vulgaris
tcacaacctcgtcgcgttgtccctcaccttcgccgaggaaccaaagacaccacctcgaaaatttctcagttagtgttttgttcctctctgttttaacagatttcgtgttctgttaattttctttatctctttgtcaaatgccacccttctgatccagaattcactttcctccttttcgtttaaaagggtaaaggaattcacaatcttttccattttcattttattttatttctcttgaattatatagcattgagaagataatggaggagatgaaggtttctcggcgggtgaagtggtggcagaacatgatgtaccccgttcgacgggtttggtttagcgtcgccactcgtctcagaattcgaaaaaatgggttactgaaactaaggcatgatgtgagggcatgtgagtatgaggacattcaagtgatgtgggagatgctgaacagaaatgaatctgagtttggtaattcttccaagaaatccaacaaaaacaacaccaacaagaagaacaagggacaatgttggaagttgctgaagtgggcaaggtgtgctccatattactacatgtgccgtgcctgatcatgattgctgtgtcagtgtttttctcttgacagaaaaatccaacctgcgtgttggtgtggctttgccttcaatcatgaataaagggggttgtgcagaacacacggtggttctccacttctctgaatcaaccacctcaatgaacaaccatttgtgtgtgtatatatgtagcaactgcgttcaccaagtcgatgtgaccaccaaaatatctgtatgtgtagg

SEQ ID NO: 155 - DNA, 3697 bp, Phaseolus vulgaris
gagaatagagtggcgacgcgagtctctcgtaatcaatcaaaaaccctaaccgcgcgtgctcgtcgccgctcatcatcttcattcttttctcctcgccgccatggatcccgaggtgcaacaatcgcaggtggccgccatccttggtgccgatccagcggctttccagacgctgatctcgcacttgatgtcctcctccaacgagcagcgctcccacgcggaggcgctcttcaacctctgcaaacaaaccgatcccgataacctctccttgaagctcgcgcacctcctccactcatcgccgcaccacgaggggcgtgccatgtccgccatcctcctccggaagcagctcactcgcgacgactcctacctctggcctcgcctctctccacagacgcagtcctccctcaaatcgctcctcctctcctcgattcaaaccgagaactccaaatccatctccaagaaactctgcgataccatctccgaactcgcctctggaattctaccggataacgattggccggaacttctcccttttatgttccagtgcgtgtcttccgattcccctaagctccaggaatctgcgttcttaatcttcgcgcagttgtcgcagtacatcggcgattccctcactcctcacatcaagcacctccacgacatcttcctacagtgcctcaccaatccctccgttaaccctgacgtacgaattgctgcgcttaacgccgttatcaatttcatccagtgcctctccggttccgccgatcgtgaccggttccaagacctgctacccgcgatgatgcggactttgaccgaggcacttaattccggccaggaggccaccgctcaagaggcgctcgagcttctcatcgagctcgccggcactgagccgaggtttttgcggcggcagcttgtggatgtcgttggcgccatgttgcagatagcagaggctgagtccttagaggagggaactcggcatttggcgattgagtttgtgattactcttgccgaggcaagggagcgtgcccctgggatgatgaggaagttgccgcagtttattagtaggttgtttgcaatactcatgaagatgcttcttgatatcgaggatgttcctgcatggcacagtgctgagacagaggatgaggatgctggtgaaaccagtaattacagtgtgggacaagagtgcttggatagactctctatatctttgggtggaaacaccattgttccggttgcatctgaacagttgcctgcttacttggctgccccggaatggcaaaaacgccatgctgcacttatagcacttgctcagatagctgaaggctgctcgaaggtcatgataaaaaatttggagcaagtggttgccatggtattaaactcctttcctgaccaacacccccgtgtaaggtgggcagccattaacgcaattgggcaactatctactgatttgggtccggatttgcaagttaaatatcatcaaggggtgttgccagcattagctggtgcaatggatgattttcagaatcctcgtgtacaggcacatgctgcttctgcagttctcaacttcagcgagaactgcacacctgatatcttaacgccatacttagatggaattgttagcaaactgcttgtgcttcttcagaatggtaagcagatggtgcaagaaggtgccttgactgctttggcatcagttgctgattcttctcaggaacacttccaaaaatattacgatgctgtaatgccatatctgaaggctatattggttaatgcaaccgacaaatctaaccggatgcttcgggctaagtctatggagtgcataagtttagttggaatggctgttgggaaggagaagtttagggcagatgctaagcaggttatggaagttctaatgtcccttcaagtatctcaactggagaccgatgatccaacaacaagttacatgctacaggcatgggctagactatgcaaatgtctaggacaagattttcttccttacatggagtttgttatgcctccattgcttcaatccgcttcacttaagcctgatgtaaccattacatcagctgattcggacaatgacattgaggactccgacgatgaaagtatggaaactattactcttggggacaagcgaattggaatcaagactagtgttttagaggaaaaagctacagcgtgtaacatgctttgttgctatgctgatgagctgaaggaaggattctttccttggattgatcaggtcgctggaattttagttccactccttaaattttatttccatgaggaggttagaaaggcagctgtttcagcaatgccggagctattgcgatctgcaaaggtagccatagagaaggggcaatctcaaggacgggatttatcctatttgaaatttctgactgatagtataattccttctctggtggaagcattgcacaaggaacctgacacagagatttgtgcaagcatgttggattcattaaatgaatgcttacagatctctggggtgcttttggacgaaagccaggtcagatctgttgttgacgagattaagcaggtgatcacggctagttcaagtagaaaacgggagagagctgagaggacccaagctgaagattttgatgctgaagagggggaactaattaaagaggaaaatgaacaagaggaagaagtttttgaccaagtgggtgaaatattgggaactttgatcaaaaccttcaaagcctccttcttacctttctttgatgaactgtcatcatatttgacacctatgtggggaagggacaagactcctgaagagagaaggattgcaatttgtatttttgatgatgttgcagagcagtgtcgtgaagctgctatcaagtattatgatacatatctcccattcctgttggaagcttgtaatgatgagactcctgatgtcagacaggctgctgtgtatggccttggtgtttgtgcagagtttggtggatctgtgttcaaaccactggttggagaggctctttcgaggttaaatgctgtgatccagcatcctaacgctcttcattcagataatgtaatggcatatgacaatgctgtttctgctctgggaaaaatttgccaatttcatcgggacagtattgattcagcccaggtagtccccgcatggcttaactgtttgccaataaaaggtgatttgattgaggccaaagttgttcacgatcaactttgtttaatggctgagaggtcggacagtgagctgctgggcccaaacaatcaataccttccaaaaatagtttcagtgtttgcagaggttttatgtgctggtaaagacctagcgacagaacaaacagctgggcgtatgattaatttactcagacagctccagcaaactttaccaccctctacttttgcttctacgtggtcatctttgcagccacagcagcaaattgcactgcaatccatcctttcttcatagttttcactgctttgctgctttacaatccatcatttcttcatagcatcctggcttggcatttggtgtattgctcttcttgggaacaagctttttcctgtttggtggtctctatttgttacccattctttttgccataagatggtttccatcattcattcttgcatggtgttttatagcaacatggcttcagttttgagaatgcagagtcaattgtgattggaaagggaacttcctgtagaatgtgtatattat

SEQ ID NO: 156 - DNA, 699 bp, Phaseolus vulgaris
tggtccttgtttgtttagagtgttgagtgtttgtgagagtgagagagtgaaatggcgtatctcagattcttacacgcaccactgccacagcctcagctcacactagggtttccttcgccacctcaatttctctccattgctccacctctcaatttctctctctcctcttcttccttcaggtgcaaagtttttaggagattgaaagtgaatcaaagggtgttgactgttttcgcaacaaaccccaactctgtagatgggaaatcacccaaagaaggatcagaggtaaataaaactagcaatgctgctcagggacctcctctccttactattttggctggactttttgtccttttcgtagtttgttggagcatttggtccatcatagcgtggctgataagtttgatagttactgctcctgctccgaaataaatttgattataatgtttgtgtttgtattttaagccactgctttagtccttatgaatttgtctttgtttctttctactattttccacttaatagaatttgagtgctaaacatgctaaagtgagccaagagctggtaaagggaagaaacagaattggcaactcctaatgggagagagcttatgttcatgtctgggtattgtcaaccatcttttagttatggattccattggggctgtgacttcggtatatattttgaagaactgtagttgct

SEQ ID NO: 157 - DNA, 955 bp, Phaseolus vulgaris
accccacccacccaccttctttctctctttctgcctttcccctttagttttcctttgctcttgtcttctggcttctcctatttctctccgatctcatgaagaagatcaaacccgttgtctccatggaccctccttacgaggcgtatcagggtcagaggactcggttcaggcaccagagtctcttgcaggattatgaagacctgcacaaggaaacagaagccgtgagaaggaaattgcaggctacggagcagaaaaggttgatactggaagatgaagttagatttttgaggcatcggttcaaatacttgctaaaacatccgattccaaagcctcaaccaaagaaagaagttgtaaagtcacagaagctcaaaattcaaactcccatcatctcgaagggaaagagttacagtagaaaggatcatacttcgcgatcccactctgcatctcatttgaaccctaatggaaagatatccaatgtggctgaagtgccattgcaaaaaactagccatctgtttgatctaaaccagaatgctaggaattttagttctagtagaaaagacagtactattcactgttctgcttcaccagcacgtgacttgaatcacaaagaaaggcttcacagcagcaaagaagccacaaagaagagtgtagctccattttttgacttgaaccagatatcgagagaagaagaagagttgcaaggcaacagtgagaccatgaggattgaagaaccaaagagaagtacacatagagttggaagtgatgagcagcacaacgatatcaaactctcagcttgtagaagtgttggtgatggatcaaatagggcagggaagaggaagatttcatggcaagaccaggtggcattgagggtttgatctttaaaagtacagtaggctgaattcttacccctttggaatgtctagtctgccttcatatgcaacagatttttaacctt

SEQ ID NO: 158 - DNA, 1680 bp, Phaseolus vulgaris
gggacagcactaccaccacctgcacctctcttaaccctaatactggaagacataacattatagtgtttctgagagtaaattttcgtttcagatccccaactctcaacaacccaaacccacgataaaaacacagcacaagagtaaagaagaagaagaagaagaaaggctaatagcatagcagcactgaagttcgtgtcagcgagcagccatggatgctatacggaagcagctcgatgtgttgatgggagccaaccgtaacggcgatgttcgtgaagtcaatcgcaaatactacgatcgcgacgtctgtcgtctctaccttgtcggtctctgtcctcacgaactcttccagttaacgaaaatggatatgggaccttgccctaaggtccactcccttcagctccggaaagaatacgaggaggcaaaggggaaagggactgataattatgacagggaattggaggatgttatagataagcttattggtgagtgtgataggaagattggcagagctctcaagcggctcgaggacgaggatgcaaaggctgccattgcgatttctgtctctgaagttactcagacgcttgaggtgcttgagctgtctaagcaaattaaagagaagttgaaagaagctgatcaatacgatcttgaaggaaagacagatctcaagattcgagctctagaggttgtagaggagcttagaactaagagagcagacaagcagtctatgcttcttttagatgcctttaacaaagatagggcatctttaccaacacctctgccaaatccaccacctttggcacccattcctgtagttgcccctgatcctcgaacacaagagatgataaatgaaaagctgaagaaggccgaggatcttggtgagcaaggaatggttgatgaagctcaaaaagcaatggaagaggctgaagcacttaagaagcttcctgccaggcaagagccagtgttggattcatctaagtatactgctgcagatgtgcggattactgatcagaagcttcgtgtgtgcgacatttgtggagcatttttgagtgtttatgacagtgatcgccgattagctgatcattttggagggaaacttcatttagggtatatgcagattcgtgagaagttagcagaacttcaagaagaaaggaacaaaagccgaaagactgatcggcatgaagacaggagatcaaaagaaagaagcaaggatcaagacagggagtcaagtagggaccgtgaacgtggtgaaagtcgtgaacaagggcgagaccatgatcgtaggagtagggaccgtgacaggcattatgatagagatcgtggccatgagcgagaccgagacagagtctccgaccgcacccgcggctatgaatcaagaagtcgtaggaggtcacgctctagatcccgagagcgaactagagattatgatcgacataggcgtcatgatcgatattagcaattgctatgaatcttatggatatgacaatctctagtttaggtgggtgttgaacctcatgttggacaaataattttgcaatttcttgtgttgaactgttttcctgatgatggatgtagcttgagcttaggtgtagctaaattatggtcttgtgttgctttgcagatattaatccaatttgtaatctgccttactttggagcagttcttgctattgtgcttaaaaat

SEQ ID NO: 159 - DNA, 1415 bp, Phaseolus vulgaris
atccaaaatgaatagacagagaagaagaagttgtaagagagggggaaaaacctatgcgaagctcaaagcattgaacttcttctccttaggcagcaacaatggccgcagaatcatctcgcagaagcggcaaacgcccttttgtggaagaagacgacgaatcaagcaaagaaccaccagcaaaaagggttaggtttccaaagggtaagaaagtgaagccaggagatgaagttgtggacaaaggaaatgttgaggagggtgaagttgacataatgaatccccgggtagctgccaaagctgccaaagagcgggcaaatcaaagaaatcaatttactgctgaacttctcagtgagggcactggaggtattggaatagacttttcagttgctgaagtcacatatgaggatagcgagaattttgttgatgatgggattcaaattgaacctttcaacctagacaaagaaagggaagaaggttattttgatgcagcaggaaattttgttgaatatgtaagagagaatgagatcaaggatgcgtggcttgataatattgaagttgatccaaagtattctgcattaaaatctgtaccaaccaatgatgaagatgaggaaccacccgacctttcttctgaagatattggaatcatgaagagacgcattgcaaatgttcttgaatctggggaaacggtattgcaagccttgagaaggttaaaaggtaacagtgacagaaaggcaaaaatgtctgctgaggctaagattatatttgaccagctaactgaggatgctatgaagctgatggaggatggtgaatacaatgtttatcatgaaaaacgagaggtttttgttcgtgaagcggaaggatatgagaggttatcccaggcaaaagaaggcacatcaaatcaacatttggctagtggagaagcctctggcaatggtgatgatgattttgatatgtttgccaatgatgatgaacaggataccagtaagccatctacaaatgaaaataatgcagttagtcaatcttcatcggatgccacaaattctgctggagcattgcaaaatgattatgtgtatgatgaatcttcagggtactattacagcagcagtttgggctattattatgatccaaatacagggctttatttctctgcagcatcaggacaatggtactcatttaatgaggagactagcacctacgaagaagttgacgaggttccatcgaatgtgaactgagggacttgtctcaagggacagtaggctagttatagcatagccacaatcattgtctacgagtggctcatgtacagaccgaaacactcttgaactttttgtaccttatgagggactgctgccactgctcagaattgtgattttatcttttacaaggttgttgttttatagtagctaaacttttcgcgt

SEQ ID NO: 160 - DNA, 716 bp, Phaseolus vulgaris
gcgaacggaggttgcggacggagtgcgaagcggttgcggccggagtggtaggagcgacgggaagttttgtagcattttttgtgttggggcagaccatggatgacttgtttgattcctcgttgaacttggaggacacccattacaaggaaggctatgatgaaggccacagtcacggccttgtcgcgggcaaggaagaagccagacaggttggcctgaaggttggttttgagattggagaggagcttggtttctataggggttgtgttgacatttggacttcggctgttcggcttgatcccacttgtttctcttcacgggccaaaacaattgttggccagatggaggagttgattgagaaataccctctcatggatccagaaaatgtacaagtgcaagagatcatggatagcctcagggtcaagttcaagatggtttgttcttccttgcatgtcaaacttgagtataatggctatccaaagtcttctacagaagccaacgatattcaattttgagctgcttatgatattttcagtcttctagagataccagtgtgtagagatacaatgagttgggcaagttgatgaacaaattgcttgttatcatttctataaacggtcgtataagtcaatgtattaaatagttattttatattaaaaatgataatgtatacattgcttatgaacgtaatcttgataagtattgtcaagaatattatt

SEQ ID NO: 161 - DNA, 2776 bp, Phaseolus vulgaris
gcggccgcctgcaggagaccaaaaagggaaggagaagacttcgaggggcgcaaaagtactactactacaacctcaaacacacttggaatcagaagaggcttgttaatttggtactacacactgaaaactaaggtacacagaattaaggcacaatcaccgctactgtgtcaatgaccatgccaagggtttctgccaatccttctccctcgtgcttagtctctatggcttccaccgtcagagcttacgcgctccctattattctctttgctggagccatgttctaccagctcttcattatccccaatgcctttcctccttcccattacgacgttctacaaattgagagctatagttcgattgacaaagtgcaggaggcttacgagaagcttgaatctaaattgaattctgctgaggaagcttttgatattcacaagtttttaaagattcgatatgcttatgagttgctgacagatcctttatggaaaagagactatgacacatttggtattgatgaacaacttcatattgttgagagtggtagcaagcgttatgcagggaaacatatttcagaattggacttccctttactacaggcccgatctggatttgtggatcactcttctaaagtcattacatccagtgacttccagtatatatttccagatgttaagccatggctaattcagttgttttcatcagggagcgaaaattgtgctcaattttccaagtcctggaataaaattgcttctttattggatgttgttgcaaacactggtgtggtggaacttggtgagaaggagcttgccatatatcttgctgataaatcatcaactggaaaaccattttttagaaatggtgttccatctcttattgtcattcctgcaggatgtagatctcctaaatgtatgacgaggtttaatggcgagcttagtgttgataaggttacaaattggttcgcaacaactatagtggatttacctcaaattaactactactcaagggaatctttggtgccaaattttcttggtaaaactagccatcataaggtaaaagtcctctttttctcaacatttggtgagcgtgctgctccatttatacgacaagcagctaaagactattgggcttttgcttcctttgcattcattctctggcgggaagaggaatcttcctattggttgggagcatttggagtgcattcagcaccagctattgtatttcttaaagacccaggtgtcaaacctgtggttcaccatggtctgtttcatcttttgtcatgttacctcattaccatacgaatatacgtttgctctttcattgaactggctatctatgcattgtgtattgcaggttctgtcaacaattcaatttttttgcagttgatggaaaataataaacagcaagagcttcgacaactaaggagtgtgacatcaatggagctaggttgtgatccccatggctattctcgtgctggttatgatacaatgatatggtattgtgctatcgtggttggaaggccaagtttggagctgaacaaaatgcgtgaaactatgtgcagggtccaagaaacattttttaagcacagccaagtggatgcatcatctgataatcaatccttaactccagctgtggatgcatttaaaagaaggcggctgacatttgcttggcttgatggtgaaaagcaaaaggattactgccaattttacattggtcaagcgggtagcgatcacacatgtgggcaacgacggagtgtgactgatattcctaggttatttgtcattcgttacctgaggaatggcagtgctgttgatttgagaacagaacaaaaaacggactggaaatcatcactggtccaagatctaatcagtgattctgatcttgcaggccagtttgtagctgggtacaagggagaagatgatgtttcacagataaccgcttggcttgcaaacattatttctgatggtgactccagagaattaccattctttactttacgaactcctaagcttgtcccagatgacacagaacctatttggtccataacagcacaaaatattcctctgaaaaatctgaaacagagtattcttggtagtcttagcggactctctatataccgtgaggatcctagagttggtccgtttttgcttctgggtgcattaatttctttgggtactatctggctgcgtaggagccaacaacaagttcagccatctgaacaaaatcaacctaattccaatcagccatctgaatcaaatcaaccaactcaacccagttccaaggatgaaagaaaacaaatgccaagagaccgggtcagaagtcggtcaaataaaaaaccaaccccttctatgactgattttgaaccatcggatgcttaccaggttccactatcagattctgattctcagtaatctcagtttggtttctccatgaaggaaaggaaaatgcacacagttacatggtctgaaggtgaaattcttgaattgtgttcttggtttggagcaagataatacaggattgtcaccatatctcaagaagaaattaggagtcacgtgttttgttttggttaaaacgaaaatttgactgttctggtgtatatttgtttaatacttcgattaggatatttattcacgaagtgcttttaccaaaattaagagccttaaatcaagtgaccataaaattgcctgacctgtgaagagtctgtcataattaattcgtggaatttctaattagtgattcttacctgactagctgcatgacacgtgtattttgctacgctggg

SEQ ID NO: 162 - DNA, 709 bp, Phaseolus vulgaris
gaccttgtagtgagtgagaagcatcagacacagttggagggttttccaacttcccaaatctcaggcatttttgccacactcagaactaaataccaattgaaagagaatgaacaaaggtggaggagcggggttaggaggtggcgccggtgccggaagcggacccactgcggcagcagcctcagccgcagcgcagaagcagaagactttgttgcaaagagtcgaaggtgatattgccaatatcgttgataactttagccacctcgtcaatgttgcaagggtaaatgatccaccagttagaaactcacaggaagcttttatgatggagatgcattctgctaggatggttcaggcagctgattctctgttgaagttagtatcagagctaaagcagactgcaatattttcaggatttgcctctcttaatgatcatgtagaacaaagaaggattgaatttaatcagctggccgaaaaaacagatcatgctttatccagagttggggaggaagcggctgctaacctaaaagaacttgaatctcattatacttcttctgcacagaagaccatgcaaaacctgcaaccatagttaagaatctctaaatgcagtatgcggatcatgctttattcagtatagtagtttcttaattttggtttcaagtctgttctttctttactgagaacatggaagcaaatagcagcactcattttgagt

SEQ ID NO: 163 - DNA, 2346 bp, Phaseolus vulgaris
gcctttctcaaacttttccattccagtttaaaccctagcgaagggtttaagctcgcgctataccaagcttcttcatgatctattcggaaggagcattctaagctatggccgctgcaaggttaacctcattcgtggcggtgtcatccgctgcggtggtttccatgtccacgttctctgatcgtgcctacgccgactcttccttccgaatccctttcttctcttcttcaccttccaatgcgccggcgccgccgaaccagtcttccgacagcagttcagagcctccggcgcctgaggaacctaacaagtcgggtttcgacccggaatcgttagaaagaggagccaaagctctccgtgaaatcaacagttcttcctactcaaagcaggtgtttgatttaatgcgaaagcaggagcaaactcgcctcgctgaattagacgctgagaaagttcattacgaacttattcagtctcaaggagatattgaaaggcagcgaaaaatggctgaagaacaacgtaatttaatacaagagcaagcccagagacaggcccaggtgctgcgatatgaggatgaattagcaaggaaaagaatgcagacagatcatgaagcccagaggctacataatgttgaattggtgaagatgcaagaggaatcttctgtaagaaaggagcgggcaagacagtctactgaagaacagattcaatctcagcagcgtcagactgatagagagagagctgaaatagaaagagaaactattagagttaaggcaatggcggaggccgaaggccgagtacatgaagcaaaattgacagaggatcataacaggagaatgcttatagaacgactgcagggtgaaagggataaatggcttgctgcaattaacacaactttcggtcatattgaaggtggtctaagggccttattgactgatagggacaaattgcttatgactgttggaggagctactgcactagctgcaggagtatatacaactagagaaggtgctaaagtcacctggggctatattaatcgaattttagggcagccatcactgatccgggaatcatcaatggaaaaattccctggatcaaagataatttctcaagccaaaaataaacttctaaatagtagtactttggctgggacagaaaagcctattggaagtaaaaatggccttgaaaatgtaatcctccatccatcgctgaagaaaagaatagagaaccttgcacgtgcaacatcaaacaccaaagcccatcaggcaccatttcgtaacatgcttttttatgggcctccaggcactggtaaaacgatggttgcaagggaaatagcaaaaagatcgggtttggattatgccatgatgacaggtggagatgttgcacctttggccgcccaggctgttaccaaaattcatgatatatttgattgggccaagaaatctaggaaaggcctattgctttttattgatgaagccgatgctttcctttgcgagcgtaacagcacgcacatgagtgaatctcagcgaagtgctttaaacgcattgctattcagaaccggtgatcagtctcgagacatagtacttgtccttgcgacaaatagaccaggtgatcttgacagtgcagttactgatcgcattgatgaagtgattgaatttccgcttccaggagaggaagagcgtctaaagttattgaagctctatgtaaacaaatatttatgtgatgacaacaatggcaccaagggaggcttcttgccgaagaagcagcctcagaagattactatagaagatttatccgaagatgttttcagagaggctgccaagaaaacggagggattttctggccgtgagatcgccaaactcgtggctagcgtccaagctgctgtctatgggcgcccagactgcatgttggattcccaattgtttagggagattgtagattacaaggtggtggaacatcaccaacgactaaaactagcagctgaaggtggccagcccggccaaatataacttgctgtgtgagatttttgtttatggtgttatgtgagtgcgtatttgtgcggcagatgaagcagattcgttaaaagtgcttcccctagacttagaagacttacaagaatcttctggctttattaatcattaggagtaggaggctttaatgacttggaagctgcattccagcattgcctttccacttcatgctacggattgagaagccatgtttttgagagcagagaagtcaaattaccttgattaataataaattggtaggatatgctccaagttgtaatttaaatttaattttttatgaatatgatttcgttctaattccagtgaagattcatccaaagtatgctaa

SEQ ID NO: 164 - DNA, 1082 bp, Phaseolus vulgaris
cttcaccaccacaactctagcctcaatccttggccgccattgtttcttcttcttcttcttcttccatttcctttccctctttctcgatctcttttcgtttacccttttggagattttgatctcatggccctcgctccttctaaagtttcccccttttctgggttttctctttcagacggtgttggggccgtgagaaacccaacctgttctgtttctttgagctttctgaataagaaagtgggaagcaggaaccttggtgtttctgcctcaactgtgcctcttactggggtgatctttgaaccctttgaggaggttaagaaggaagagcttgctgttcccactgctgggcaggtttcgttggctcgtcagtattacgctgatgagtgcgaatctgcaattaacgagcagataaatgtggaatacaatgcatcctatgtgtaccactccttgtttgcatactttgacagggacaacgtagctctcaagggatttgccaggttcttcaaggaatctagtgaagaagaaagagagcacgctgaaaagcttatgaaatatcagaacactcgtggaggtagagttgttcttcacccgatcaagaatgtaccctcagaatttgagcatgtggagaagggggatgcgttatatgcaatggaattagctttgtctttggagaagttagtgaatgagaaacttcggagtgtgcacagtgtggcagatcgcaacaaagaccctcaattggcagacttcattgaaagcgagtttctttctgaacaggtagaagcaattaagaagatctcagagtatgtggctcaactgagaatggttggaaagggtcacggtgtttggcactttgatcaaagtctgcttcatgatggacatgccgcttgaacttgaatagtctttattagtcttcgtttatatttgctcttgtattaagttctgggttgttttctaatttagaagtagtatttaagtgtttttcctgagtactgaggtgtaagaacttgtagtgttgtggtagggagtatcatatgtaaaagactgcaagcattttatgcaataacattcgatatctgcttttc

SEQ ID NO: 165 - DNA, 821 bp, Phaseolus vulgaris
aagaagccccttaacttaaaccccctcatgttcttttctctttttggtctaagcaaacaccaccatggcagcatcagtctttaacactccctccttcacactctttgtttttctctctctccaactttatctctctttctcttcctcttcctctccctccatccatgaccttctccgttccaaaggactaccccctggcctcttgccagaagaggtaaagtcctacactttttcccgaaatggccacttggaagtgttcctagatgcaccttgcatgaccaagtacgagaacagggtcctctttgaacaagtattcactgctaacctcacctatggtagtctcataggagttgagggtctccaacaagaagagctctttgtgtggctccctgtcaaggacataatcgtaaatgacccttcttcagggttgatactctttgacattggcctcgcccacaaacaattctctctctccctctttgaagatccacctcactgcaagcccgaaggtgggttgaggaatcatgtgaggaaggaaaaaggtttggaggtcctgaggtagaaaaagatgccaccctgtgtttcgggcttcacttgttgtctttttctatgtcatgtttatataattttagccttgcaatgcaactatagttaatgagcttgtagcgtagaggttgagcatgtaaaaaggtgaagagagagagatgaagagagaaaaaaaaactaaggaatcttgatgtcttaatcaaatttacaagttgtaattttcttctaacttttgtgcattatattcaccggtaattgctatgttgttccgtttt

SEQ ID NO: 166 - DNA, 1599 bp, Phaseolus vulgaris
tcgtgaattgcggctgccactgccttcttccgcttctgggcctcgctcagaagtcagaatgatgtctgtcacaggcaaagccattgattttgctggaaaaaacttggtgtcctgtggttgctcttccaatgcttcctttgataggtacacggtcaggaactatgccaaggttaattcaaaagggtgtggcagaggtcatggagtttgtaaattgttttgttgtacgaggaggaacactcagtgtcgggtttcttctatgaagactgcagaacctacggtgaatggggggagtcaagcaattgaaagccttaccaagggatcttacttgaagggttattcagaatcccccatttctccagctacgttctttgaagttgttgctgatgatttgctaactctcaataaaaatcttcagtcgattgtaggagcagaaaatccagttttaatgtctgcagctgagcagatttttagtgctggtgggaagaggatgagaccagctctggtgttcttggtagcaagggcaactgcagagttgtttggcttgaaggaacttactgtaaagcatcgacgtttagcggagattattgaaatgattcatactgcaagtttgatacatgatgatgtactagatgagagtgaccttcgacgagggaagaaaactgtacatcaaatttttggaacaagagttgcagtgctggctggagacttcatgtttgcacagtcatcatggtatctagcaaaccttgaaaatattgaagtcattaaactaatcagccaggtgatcaaagattttgcaagtggggaaataaagcaggcctcaagtttgtttgattgtgatgttcaacttgaagagtatctaatcaagagctattataagacagcatccttgattgcggccagcaccaaaggagctgcgatcttcagtggtgctgacagaagcatcactgagaaaatgtatgaatatggaaggaatctgggtctatccttccaagttgtggacgacattttggatttcacgcaatcagcagagcaactgggaaagccttctggcaatgaccttgccaagggcaacctgactgcaccagtaatatttgcactggagaaagaaccgaaattgagggatatcattgagtctgaattcagtgaggttggttcacttgatgaggccatcaatttggttaagagttgtgggagcattgaaagggcccaagagttggccagagagaaagctgatcttgcaattcaaagtctccaatgccttcctcagagtgtgtatcgtttagcccttgaggatatggtggcatataaccttcaacggattgcataaacttatgcatgctgaagtataaggacatactgttaaaagaaaaacacaaaaacattcttttggtcctaatatatagggataagaaacttgaacatgttgtcctttcaagaatttcttccaaattctactcctgtgctacttttggggtacttatatacgcattgaaggacaaagcaagtgcacattcacataatttaatatatttgctgcttctccctcaaagtaaaggacaagaacataatatattcctttattgtatcaatacaagttgc

SEQ ID NO: 167 - DNA, 582 bp, Phaseolus vulgaris
aagcaacaacacaatggcttcggacgaaacccagaacaaagtgatcgagccctccagcagcgaccttctggccagcgcgaagctggtggcgaacgcggcgcagtctactctgcggaacgaaagtgacaaggtggacaagacgaaggtggcggacgcggcgggggaccttcttgacgcggcgggaaaatatgggaaactggatgatcagaagggcgtagggcagtacgtggacaaagctgccgattatctgcaccagtaccaggacaaggctgctgcaccttctcagcctgcagactccaaacctgaagaaagtggtggtttgggtggtcttgcaaacttggctggaggcttcttcaaaaagtagtggtagaagaagatgaaggtctttagtttctcagtttcgtgttgttcttgtatgatgtaagattgaataaatatgatacagtttggtgtttgtagaagaagaccttttcttagttccacaaacatgttcctccaagacactcttctctttctatgtatctgttcccttttgtatattaacgttgaatcatttaagattttcttgtccagtagattctg

SEQ ID NO: 168 - DNA, 1425 bp, Phaseolus vulgaris
atcaagtcttcaacttttcttctgttctcagtgtctctcccttccaaaaacacataatccatcaaactctgatggcggccatggcaaccactgccctaacttcaaaccccaaactctcattcttcgaccacaagcccacctccttccatggaaagcccgtttctcagtcccgcctcacacccacaaaatcctcctccaaacaacccacaatctccatgtccctaactccaccaccttacgacctccaatcctttaagttccaaccaatcaaagaatccatagtctcacgcgaaatgacgcgccgctacatgaccgacatgataacctacgccgacaccgatgtcgtcgtagtgggggcgggctccgccggcctctcctgcgcgtacgagctgagcaagaacccggcggtgagcgtcgccataatcgagcagtcagtgagccccggcggcggcgcgtggctcggtgggcagctcttctccgccatggtggtgcgcaagcccgcgcacctcttcctggacgagctcggcgtggactacgacgagcaggagcactacgtggtgatcaagcacgcggcgctgttcacctccaccatcatgagcaagctcctggcgcggcccaacgtgaagctcttcaacgccgtggcggcggaggacttgatcgtgaaggaagggagagtcgcgggggtggtgacgaactgggctctggtttcgatgaaccacgatacgcagtcctgcatggaccccaacgtgatggaggctaaggttgtagtgagttcctgcgggcatgacggaccctttggcgccaccggagttaagaggttgaagagtattggcatgattgatagcgtccctggaatgaaggccctggacatgaacactgctgaggacgctattgtgagactcactagggagattgtgcctggcatgattgtgactggcatggaagttgcagaaattgatggtgctccaagaatgggtcctacctttggggcgatgatgatatcaggtcaaaaagcagctcacttggcgttgaaggctttggggaggaataatgcaattgatggaacgtgtggagttggaagggaagaaccagaacttgttttagcttcggccaacactgaggacattgttgatgcttaaactttatcatcacataccttttctgtttcacctgcagcctatgatttgaattctggaataaataaagaaaagtgtgaatgatgaaggataaagagacggtacctgttatgtctgtgtttgtgtggattgacaaattgtcaccaccagccatgtaactgtaagtaagcagccaaaaatcaaattatcggatcaagaagagataggttaaattacccttcggcctgcttgtttgtgttaaatcataaagaattgttttattctataaaaacaagagttgcagtatttt

SEQ ID NO: 169 - DNA, 1187 bp, Phaseolus vulgaris
atgatctcttcttccacaccaacataataaaattttgttcctgaatttgttattgcaactggtgcacacagaaactaaggttggagttaatctctggtgctgttgaagagtgaaaaaaagggctagcatggacagcttggaagagcaagtgtttatgttcattgatgaacaatattatcattaccattccaatttttccaatgaatcagagcttcaagtggaggaggatctatggtggcaagacaacagcgattctgatgattcatcccagaggactttgtattgggaatctcaggtcgcactgcttcaggaaattttggagcattacagtcaaagtggctcaaaattgagacgagaggttggtcgaatcatagaagaggtgaagggttcagatttctgcagctgctataaggctaactttttagattgcagcacctgtttgagaagagaaattgttactaagctcagagatagaggattcactacaaacctttgtgtttcaaaatgggaaaccacaaaaaagtttccaggagggtgtcatgaatatattgaagtgtttgcaaatacatcatcaaagaagaatcagattcgtatcctgatcgaattggagttgagagaacagtttcagattgcaaaagcgagtgaaaattaccaggatctggtgtcgtgtttgcctgaattttatattggaaaaccagagttcttgactgccattattcgagtgatgtgcaatgctgcaaagaaatcaatgaaggagaagaaaatgcacgtgggtccgtggaggaagagtagtttcatgaaaatgaagtgggcagagttcaatcaaacattaaacaataaatcatttggtacacataccactcaatcttaccttggaatttcaggagctcatacacctgtggtggtaacctgaattagaaaaaatattcaattccattactgaattttgatcttagagaattctttagtagtaggagttgatgcccaagtggagcagtgtatcattagatcatccatttcagtgttctttactttaggtacaagattatgatgtaatataattatctagcaatagaatatatcatatagtaatattttgtgattctcgtttattccgcaaaacttttaatcaaattcttcaaagaaataactaatttaatttactttttattcagctttactataca

SEQ ID NO: 170 - DNA, 675 bp, Phaseolus vulgaris
tctgtgtgtggtggtgtagtttatcagatgacgtgtgtgtgttaagagtgtagcagaagagaagagaacaaagaagaaagtggtgtggcgtggaaatgtcgaagaaaggaggaagtggcgcttcgtttcagaaggacgtgccatggcgagcgtcttcttctactgtcaaacccatccccaaaattcaccactctccacttcttcgcgtttcccaaacacccgttaccgattacgccgtctccgtcatgaggcatccagaccctatagggagtggattgggtgacgatgccatagtggaagcagctggtcctgactgcctcgtacctggccagaaaatgcccatccaattacttggccttcaggtctggccaatccatgtggacctgaagtttttggaaccagttgggcgagaacttaagatgcttggaaagttcatggatgatgccgttgaactaatgaacaaatcattcatcgagcgttgattatacgtgcgttgcgaagagatgaaatagttgcaatttgaatttttgtaagaaatgagaaatatagacaacaagcagagtgactgtaaaatttggctgattttgtatgtaaaagagaattgcagtgagatatttttgttcggtgattattcccagcctattaatgccaattagaaactatttctcccctttc

SEQ ID NO: 171 - DNA, 959 bp, Phaseolus vulgaris
gatacgcgtctctatgaggcccatattccattgccattaccgacctcacaactcatcgcaacaccttcaaatccccctctcctttctctcgctcctcttcgcaacccatccaccacaatcacaacccttttctcctttctctctccttctctctctctctctctcttctctctctctctctctttctctccctttttctctcatacgcaaaacctaactctcttttcttcttcctccatggctcagaaaaccgaaaacgaagaaaccgagttcaaggttcccgaaactattactctctgcgttaacaactgcggcgtcaccgggaaccccgccaccaacaacatgtgccagaactgcttttccgctttcaccgcctccaccgccacaacctcatccgccgcctcggccggaatctcctcgccctccgctagatccgttgcttccgcgcgtcctcagaagagatccttccccgaagagccttcttcggctgcagatcctccctcctccgaccaaaacgcgccgtccgaggccaaacgcgtcgtcaaccgctgctccggttgccggcggaaggttggactcaccggattccgatgccggtgcggcgacctcttctgcgcggagcatcggtactccgaccgccacgactgcagttacgactacaaagccgccggaagagaagccattacggccggggagaatccggtggtcagagccgccaagattgttaaagtctgaaagaaaggaaaaaaacacaaaaaagcaagagaaacctgaaacggaatctcgttcgttgaccggttccgcgcgatcatgggttttcggtttttttttttcagattatatatatagagaagcaaaagaaagtagcaggtttaagagagagcgtgtgtgagatttagagagagattgttgctgaaaagatgaagaagaatttatctgaatttctcttgtgttcgatc

SEQ ID NO: 172 - DNA, 1211 bp, Phaseolus vulgaris
aataacacaaattatccatttcataaacccctttcttctctgagaattttccacgcacggattttccctgaaaatgatattttctcgttagattttcccgaattcaaagttctgtgggacaaaaaaaaatccaaaattttcatggcccttctagttcacgcccctgaaatatctgttgctcttcaaattgccccaaaccctaaccctaggctgagcaaagtccacagcttcaaaccccagacaaagggcaaaacgattgggtcagctcgcggagtgagagtttcttgcaaagtgaaagattatgaagttttggatttgggtttggatgagagcgtgaactcgtacggtcaattttcggctcctgtgaagccagggtcgaagcagagcaaagagaaggaagaagagaagcagaattaccatgttaatgtgggatacgctattcgaactttgagggaggatttccctgatctcttctacagggaacttagctttgacatctacagggatgatattgtgttcaaggatccaatgaacacgttcattggtattgagaattacaaatctatcttctgggcactacgattccatggcaaggtatttttcaaagctttgtggattgacataagtagtgtatggcagcctgttgagaacgtcatcatggttcgctggactgttcatgggatcccacgagttctatgggagagccgtggtaggtttgatggaacctctgagtataaacttgacaagcagggcaagatttttgaacacagggttgacaacattgctacgaattcacctcctcggttcaaagtgttgagtgtggcagaattaattcagtctattggctgcccctcgactgcaagacctacctattttgaaacatcttcacatcccgagagaacgtaatgttgctcaggttcttgaagttttggtgtaaattgtgcatattatggtaaacaacaaaacatggagttagatttttatcttgcttgttacataaacctgtgagaaaaaggtcctttgccattgacttggtcttgtggtgctcgatattgttgatagcagttatagggtcattgttgtcaattgtaacaagttgaatttaaaatccctgtatataatgcaattggtacttatgtctaatgtcttaatctgtagatccatataagcaatttatgtagtgatgctgtattcatattcatcattgtttc

SEQ ID NO: 173 - DNA, 3415 bp, Phaseolus vulgaris
ccgcatcaactttagtcaactcttcttctaacttctatttcaataccttctcttattcctctgttattcttaaaattccattattagccctctccgaccaccgtcgccacctccttccaccgcctctcttgtacctccagagcttcctcccgcactcgcatcagcttgctctgtgttcgtttagttgctccgtcgagtcatatcaattctcaagtatgaggattgccaaggaagaatcatcaagcagtgctgcacaggcaataagcttgatatcagcagtgaaggaattgcaagaggttactgctatggatctcaacaaattattgagagactctgaaaatttcactattcagtaccttactgaaaaaggatcaatactgaagattgatatggaaaagcttgtgggatctcttccattgcaccttagtaccctgctgatgtcagctgttagaaatgaagccttgttcagatacctgttacgtggcattcgactcttgcattccttgtgtgatttagcctcccgaaattctaaattcgagcagattatgctagatgatgtgaaaattatggaacagctgactgacttggttttctacatgctaattgttcttggtggatacagaaaggaataccatgcttttagttatatgcaccttttgcattcaactcttgtagcatgcaatttacatctattaacagggtttatatcaacacaatggcaagatattgttcatgtattgcttgcgcaccccaaggttgacatatttatggatgcagcttttggatcagttcgcatggttgttagttttcttgagaatacactggtagcatatcaagaagatgtttctgtggaatcaaatcttactgcaggacaaatagtttattatctctgccagcagtgtgaagcttctctgcagtttcttcagtcactttgccaacaaaaattgtttaaggagcgccttctcaagaataaggaattatgtgaaaagggaagcattctttttctggctcgatccatcttgaagttacacattcagccatcttttccatctagggtcatggcggctatttctaggctaaaggctaaaatactatctattctgctgagtttgtgtgaagcagaaagcatttcttatcttgatgaagtagccagctcagcacgaagtttagatttggctaaatctgttgcattagaggtttttgacttgttgaaaaaagcttttggaagagatcctgggcatctcactgctgacagaagtcatccaatggggtttgtgcagctcaatgcaatgcgtcttgctgacatcttctctgatgattcaaactttcgatcttacatgataatttgttttactaaagttctgacagcaataatttcgctctcccatggagattttttatcctgttggtgttcatctaatctgtcagagatggaggaagatgctagtcttgaatatgatatatttgctgcagttggatggattttagataatacttcaccagatgtaagaaatgctacaaatttggaattcaacctagtccctaacagcatgcctaaggcttcttatgcacatcataggacatcattgtttgtcaagttctttgcaaaccttcattgttttgttcccaacatttgcgaagagcaggagaggaacctttttgttcttaaggtcatggagtgcttgcaaatggatctttctaacttgctgcctggattttcttttgcttctgatgctcctaaagctgccattgctagcaaaaacctccgctcattattaagtcatgcagaatctttgattccaaacttcttaaacgtggaggatgtgcaacttttaagagtgttttttggtgaattacaatcactgtttacatctactggatttggggaaaatcaagtccaagatagcaaatttgaggagtcacaatcttgggataagatttctaaattcaacatcaatgaacattatcaggaggcacagagtgcagtgggatttccgccatctttaactggaaaagaacctgctgatctcaataagaagggtagtaacttcaaggaaggaatgtctgagaattctgcatttccggacatggaccaacataatagccgagctgaagagacaaatcaaggcaagggcttaaataggcaaaatcaggtggatgataaagggatacctggtaaaactgcatcaggaggagcaagagatatggacaaggatgctcagaatgttgaaacaagtggttcagatactagttctgcaaaaggaaagaatgttgttgatcatatggatattggagaactttcaaaatcaaatgagcgtcttaaacgaactgcagttgaggaaaatccagaggatgaaaagattgagctttcacaacgaagaaaacggaagcgaacaataatgaatgataaacaggtgttgttgattgagagggcactcaaagatgagcctgatatgcagcgtaatgcagtttcacttcaatcatgggcagaaaaactaagcgtgcatggttccgaggttacatcttcacagcttaaaaattggttgaacaaccgaaaagctaggcttgctcgcacagctagggatgttcgcacagcaggaggtgatgctgataatcctgtcctagaaaagcaaagagggccagtacctgggtcctatgactcacctgaaagtccaggtgatgtatcacatgttgcgagaatagcttccggtgataataaaccagagccttctctggctcgatttgttgatattggttctccagaatttggtcgttgcaatgcaggtcagtatgttgtgcttgttggtgttcgaggagatgaaattggcagaggaaaagtgtttcaggtgcatggtaagtggtatgggaagagcttggaggaattagccacctgcgttgtggatatttgtgagctcaaagctgataaaggtatgcggctaccctatccatcagaagccactgggaatacatttgcagaggctgaaacaaagttaggtgtcatgagggtgttatggggctcgaacagagtttttccattgcggtctgaaatctgaatgagtttaattatgctttcatttgctgcagcagctgctattcctctgctacctgctgcaaactgttgtcaatcttacttgtggttccctgaatgcacatattttctatttccataaacactgaagggatactagatgacttagttgagaaatcatctttacttgatagaaaagagttcagtaagggacgggtagaaagtagaagtcgataattatggagaaaactagggcgatttcgcaatgaaagatagtttagtttagggtataaacaagaggcatagcggcagaaaaaaatggttgtagggtcttgtacaaaatttgtttctcagaaagaattttccctgccgcctggcaattgaaaa

SEQ ID NO: 174 - DNA, 738 bp, Phaseolus vulgaris
aggttttggttttggtttggtttggtttgaagatgaaatgatatgctaacagtagaaagagaagaaagaagaatagtagcggtggtgccactggtgcagaggacaaagagaacaaagaagaagaagaagaagaataagaagaataagaagaaacagcacttcatggatgtctggcgcaacatcatcttccctgtcaggcgtgtctggcttgctctctctgctcgcctcaaggctcgcaaaaacggagcaggactgctgaagcttcaggatgatgtacagacttgtggatatgaagatgtacaagtgatgtgggaaatgctacaaagaaccgaaagcgatgttgtagaaagccaccataagcgtaagcaattgccattctggaggatctttgtatggtccaaccacagtgaagtttcatcagaatctgcaaatcacacttgaaaccagacacgggttttcagtttacaaataaaacctccaccgatgtattgcagtatgcatctggcaagccaccgttctttttatctccccattgccagcacggcggaggcatggttcttggccgctaaaaccaagtacatgtcactgtcataacaaaatcatttgaggtttctcttttacaacccaaactgtactacgtatgacaatagtatgtaaatatgccagtagtttctcaaaagtcacacacgggtttctctaacggcaaaccaagtaaatttcacttgtcaatgactataa

SEQ ID NO: 175 - DNA, 3841 bp, Phaseolus vulgaris
tttctgtttcacttctaacatggaccaacacatcgtcgatcctccgcgttcgttctcttcactctgaagcccgatcctcattttgattcccacccatcaaagtaatcacgaaacccaccaataaagttgaagctttttccttggttcaactctcagaactcagttactgaatcctgtaacccgaaaataaaagaaaaaaacaaaccttgttcttttgtggttttggattcgaaactgttcagactagagcggttttgaaccggttttgagtttgttcgttctcttattgcgtttgtttgtttttttgaagttaagcttttctgtgcggtgtaatggtgagtgacagttacagtaagatgatatctgatgtgacaattcgatcgatgatgaagaacggtgaatactgcggtgaagatttgggggttctgagggagagggaactcgctcggttgcgtagtgggtcggcccctccaacggtggaggggtcgttgatggctgtgggagggttgtttgaggggtcaccggctgctgtggggtatggtggcataaggggttttggaagcgaggaagagcttcgggctgatcccaattacgctaattattattactctaatgtgaatctgaacccacgtctgcctcctccgctggcctcgaaggaggactggcggttcgtgcagcggttgaggggtggttctaaggtggggggtgtcggggacaggaggatggccagtgatgacggtggaattgaaggtggccatagcaactctttgttctctgtgcaccctgctgggtttggtgtgaaggaggaaggtggtttgaagcaccgcaaagggggtgctgaatggagtggcgaggatgggttgatcgggttgccggcattaggcctagggagtaggcagcagaggagcattgcggaactgtttcatgatgaaaggaataatgcatcatctgcatccaagcaccctcataatctacctagcagtaacttatttgatgatattgctgaaaaatctgaaacccgtgttgcttatgtgcatcaagaactgaatgccctgcggtctggtggaaataagcagggtatatctgctgcccaaaattttgttggttctggacctcaaagttatgcttctgccttaggagcctccctatcaaggagcagcacccctgactctcagcttctaccaagagctgctagtccttgccttccacccattggtgatggcaggtccagttctgctgataaaaaaatttctaatggtcaaaatttactcaatgctgtctcatctaatttaaatgactctgcagatctggcgtctgctttggctagtatgaatttatcaacgaaagatataatagatgatgagaaacattcccagtcatctaggcacaacgagttagattatactcacagttttaaacagcagccttacttaaacagtcctgattccttggcttatcaacgtcattctgctacccaatcccatttaaaagtgaataagggcagcagttttggattggatctgaataaatcaccaggatatgcagatgaacagctagaaccccataaggctggtggagtttctgttaacacgcatttgaaaggaccttctacaccaacttttactaacagaggtagttcacctgctcactatcagaatgttgaagatatctcatatccaaactatggcatgactggatatagtgttaatccttcatcaccatccatgatggcaagccagcttgggagtgggaatttgcctcctttctttgaaaatgctgctgttgctgcatctgcactaggattgaatgctatggactctagagcactgggaagaggtgtagctttaggacctttattggctgcaactgaattacaaaattctagtaggcttggaagtcatgctgccggtagcactcaacagttgcccttgatggaccctttgtatcttcagtatctgaggtcgggggatgttgcttctgctgcacagattgctgcgcttaaggaatcagtgataaatagggaatgcacagatttacttggcctccaaaaggcttatgttgagtctttgattgccccccaaaattcacatttcaatgttccataccttagtaaatcagctaccttgagccctaattcttttggaaatccatcatatggtctggctacatcatatccaggaagcccactggctggttcccttttccctaactccctctatggaccaggtagtcctatgaaccaaagtgaacgaaatatgcgtttgtctgggatgaggaatgctgctgggggtttcatgggagcttggcattcagacacagttggtggcttagaagagaattttccatcttccttgcttgatgaattcaaaagtaataagaccaaatgttttgaactttcagaaattgccgggcatgttgttgaattcagtgctgatcagtacggaagccgatttatccaacagaaacttgagactgcctcaatggatgagaaaaacatggttttccatgaaatcatgccacaagcactttctctaatgactgatgtcttcggtaattatgtgattcagaagttttttgaacatggaacagcagcacaaataagagaacttgctgatcagcttacgggtcatgtgctgaccctaagtcttcaaatgtacggctgtcgggttatccagaaggctattgaagttgttgacatggatcagcagactaaaatggttacagagttggatggtcatattatgcgttgtgtacgtgatcaaaatggaaatcatgtcatccagaaatgtattgaatgtgtgccagaggatgcaatccattttattgtttcaacgttttatgaccaggttgtgacattgtcaactcatccttatggttgccgtgttatacagagagtcttggagtactgccatgatctcaaaacacaacagattatgatggatgaaattttgctgtctgtgtgtatgttagcacaagaccaatatggaaattatgttgtacagcatgtgctggagcatggcaagccttatgaacggtcagctataatcaaagaattaactgggcaaatagtgcagatgagtcagcagaagtttgcctctaatgttatagaaaagtgcctttcctttggaacacctactgagcgtcaagtccttgtgaatgagatgcttggctccacttatgaaaacgagcccctgcagattatgatgaaggatcagtttgcaaactacgttgtacagaaagtgctggaaacctgtgatgaccagcagcttgagctaatccttaatcgaataaaggttcacctgaatgccttgaagaagtatacctatgggaagcacattgttgcccgtgtagagaaattggtcgctgctggggagaggaggattagtattctgactctaaatcctgcacagatggtatagagaatgtacagctaactgaagataatagaagcacctgctcttttttcttttcatatgtggtattgctaatggccctgtctgtattcaggtagttaagtaataaattagttgtacttgaaattgtacatttgttagtgtgaggataatacagctagaatcaggttagccgaggcttggtactattaatggccttgccctgcctgattctctctcatgcggcagggatatataatattatttatgagctagttttcatgttgtaaagggaggtgatgactgtacaaattttactaggttatcagagtctttgtattcgggatcaccaaatgttttgacatatgaggctttactttttgccctatgttaaccttttcttttatctccccacgttttttttatctcacttctttctcttgttttta

SEQ ID NO: 176 - DNA, 1563 bp, Phaseolus vulgaris
agtgttcacaaaccctaccctataaaccaaattcgcaatccattattctgaacacttctcttctcattccaatttggagaacaagtttttcgaattagggttatctcttttcttcaattcatcatggacgctcagagagctttgctcgacgaactcatgggtgcagcccgcaacttgacggaggaagagagaaaggggtataaggaagttacttgggacgataaggaagtgtgtggattctacatggtgcgcttttgccctcacgatctcttcgtcaacacgcgcagtgatcttggtccttgcccgagaattcacgacccaaaattgaaagaaagttttgagaaatctccaagacatgatgcatatgtacccaaatttgaagccgaactttctcaattttgtgagaaattggtgatggacttagatagaagagtaagacgtggacgagaacgccttgctcaagaggttgagccagcaccacccccacctctgacagctgaaaaatccgagcagttatctgttgtggaggagaaaataaagaaccttcttgaacaagttgaatctcttggcgaagctgggaaagttgatgaagctgaagctcttatgaggaaggtggagacacttaatgctgagaagacagctttaacacaacctcaaaatgataaggtgttgatgcttggtcaggagaagaagatggcactatgtgaaatttgtggttcttttcttgtggcaaatgatgctgcagaaaggacacagtcacatgtaacaggaaagcaacatgttggttatggcatggttcgtgacttcataactgagtataagactgctaaggagaaagctgatgatgaggaaaagttagctcgggaaaaagagaccgaagaacggaagaaacaaagggagaaggaatctgagaggaggagacgaagtgattcaagtgatagggataggcatcgtgataaagatcacaatagggagcgggatagatatagggatagagactcggagcgtgaaaggtctcgggaacatgatggtagaggctatcgagatgggggaaggggagtggattataggttgaggaatggacgaaatggaggtagagacaggtaccgtgatcggagcagatcacgttctcctgttaagcatggctacagaaggtcttcttgaagtcccgtttgctcaaattagaggaatttcttgatagatgtcagaatttgaatttaaaagaggtagtctttaatatcccaagacttatatgaatatgtgcttttggagtcttgagtttctttttgtcatcatcaagggtgaatttacacttttgccatctcagagctttgttgagactatacaatctccgtttcatcaaatattattaatggagaaaagggttgaggtaggtatttcactgttgtaacttctcttacaatttgttttgcaccttgatttaagttatttatgatgattcatctctgaagcattgtgtgtagtctttcttttctctcatttctgggaatcaattgattgatttaagatgtcagacacaaaattacatgaatgaatgtcatt

SEQ ID NO: 177 - DNA, 1326 bp, Phaseolus vulgaris
aagatcacagaaagagaataataatacatctttctttctttgcaaacagcagctgaaaatttttctcaaaaggaagaagaacaagaagaagaagaaggcatgaatagaggtgttcttcagagctcaccagtgcaacaaatgatcactggaaaccctaactggtggaacatcaatatcaatagcatgcctccacaagctcctcctttcttctccaccactccttcaaactttcccatcccttatgctcccacttctcttccctttccttcttggaatgagaatcaagagcttcctgaatcatggagccagctactcatgagtggggtggtggatgaacaaggtaaggttgggatgggccagtttcagagcaagaagttggagaactgggaggatcaaatgctagctcaggctccaaacgcttctcttgttgatgttaaacaagaaaattcagctaacagctacgtatatggccatggaaacgaagagcttcagtcatcaaaaccatcttggtctccaaaatcatgtgtcacaagtttcagtagcagcatgttagatttctctaacagcaacacagatgcaaggcatccaccaccagatcgatcttctgagtgcaatagcagtgcagctggtggggcactgaagaaagctagggttcaaccctctggcacaacacaggccacattcaaggtcaggaaggagaagttaggtgacagaattactgcccttcatcagctcgtttccccatttgggaagactgacacagcctctgtcttgttagaagctattgggtatatcagattccttcagagtcaaattgaggcccttagcttaccatacttgagtggtggaccagggaatgggaggcagcagaattctgttcaaggagagaagaattgtatattccctgaagaccctggtcagctgctgaatgagaactgcttgaaaaggaaagcagcaggagaaccggatactcaggaagaacaacagaaggggctgaggagtagagggttgtgtctggttcctgtgtcatgcacactgcaagttgggagtgacaatggagcagactattgggcccctgccctaggagggggctttcgttaggacaactttacaattagggcagcatttacatatagatatggtagcatgcagagagataaattcatggaaatgatataacatcatgagcagtcaatctgctaaaaaaaaaatctaaggctgattgctcatgatgctatacttcattcctgaataaagtgtgtgctagctagcactgacaagtatttgccagcccttagaagacttcataattcatgcaaatcaagc

SEQ ID NO: 178 - DNA, 821 bp, Phaseolus vulgaris
gtatatgatttgaagaagtagaaggtatataaagaatttgattattgaaggtggcgtttgagaatcaatgggggagagtgacagagggaaagggaatgtgagcttggagggagagaaggtgatattggtcccttacatggaggaccatgtccccaaatatcaccaatggatgaaggacccttctctccttcaagccactgcctcagagcctcttaccctccaagaggagtaccgcatgcagctctcctggttccaggaccctaccaaggagaccttcattgtactggacaaggacttggttgttggacaattctcgcacggacaaccccaccttgaagccatggttggtgatgtgaatctattcatgaatgatttggatgatcctcatgtggcagaggttgaaataatgatagcagaaccaaagagccgtaggaagggacttgggaaggagtctgttctgatgatgatcacctttgctatcgagaagttaggaattaatatctttcggactaaaattggggactcaaatggagcatcccttgatctgttccaaaaattgggatttgtgcaaacttcatatagcagcaccttcaaggaggtcactttggagttgcagataacacagcccaagaaagaggagatacttggtttaatcaaaatggtaatcaaacatacataaccgtagcaatatcacttacagtttatttattggtaatctgtaactatattaacgggagacatgtttagcgtgtttatgtttttctttttagaaggaacaatagacacgatgcacaggagaaaatgcttctgaactggttatg

SEQ ID NO: 179 - DNA, 2033 bp, Phaseolus vulgaris
agtgttgggttgagtgtctccctctccgtcgcagcaacggagtaattaaacgtcgccgttttgaatttcgccattcacgccttcgtgcaacccaggcttcagtgggagcacatggcttccatgcattccaatttcgtccccaatttgtccttcaatcgcttccagacaccaccatcatcgtaccttgttggtgctggtattgtgcaacgtggagttattttgagcaattattgtagaaggagggttccttgcataaagtgtgaaaagaaagatgaggaggagcacattaagcatgtgtcggtggagcgtccaccctatcacagttactttgactccacctctggccagctcgagccggcctccggcgcccgagcgagtattcccagtcaagagtattggcctgagggaactgctagtcgtgtgagggcggcaagggcaccggctccaactgctgaatcaacaacctctccatcttatggagccaagcctggaagtaggaggaagaactacaaggcatctgttcctgctgctgcttcttcttcgtctcagtccactgtggaattttctggtgctggctctggctcttctgagcttttggttgaatcctccgaagaatctcaggatcactcgtctgagtttgttgtttatcagtctgaacccgaggaggaagaattgagtgaatatgagttcaataagagagttggactttctcatccgtttgttgatccaaagactaaaaggccgatagagggggtgcttcccaatgaggagctgtggtggaattggaaagagtcggacaaagaacaatggtccaggtggcaaaggaggaaacctgatgttgaaacggttttcctgaaagctatggcagaaactggacaaataaagcttcacggtgaagagccaacattaacagaaactgccctttatcgagcaaggcgtgaaatttataaagaagaaaggctgcaggctgagcaagagagactggaaagagatggtccaattgcatactattcagaatgggtgaaagcatggaaaagggacacatctcgcgaagcaattcagaagcattttgaagagactggagaagatgaaaatgcacaactagttgaaatgttttgccaccaaactgaccgagagtatcgggtgatgatggggactgattatcgaattcaaagggaccctttagcaatgcgaatgagggaggatcagataaagcaaatatggggtggagatccagtttacccgactgtgaactatattcaagatccaaatgaagtgattgactacagggggccaaattttcatgaaccaacgccaaatatggtggcttatctgaaggagcatggaaaactcacttcaagggatgaatttgacaagactatggccgaggaaaagactgaacttgttgagatgacggacatggatgaagctatggccaaagctgttgacattggggagaatgatgatgaagaggatagtgatgttgaggaggtagaggaagggggagaggaagagaagcttagtgattattggagtgtgttgaaaagtacccctgagcttcgcaagtcaaagccacagccaaagccaaagaaaaatggtgctatgtcactggacgaagctgtagaggattcagaaaacttgactgatttcctcatggactttgaagaagaagaatgacatgcatcctctgttgcatctcaagtggagtattgtattgctttgtagacagaatagaaggtttggttgttaatcttcttatgtcaatttctataccctctaagtaaattctaggtaggcacagccacagtggatgtgtgtccaatgcgataattattagagtgcgattctgattcaagggtgggttctagtttctgttaagcacttgttccctaaacatgtctacattaacaattttgaaatccctcttcatacggaacctagcagataaatttactagggaagtgaccattccaatatattaaacatattggtgcatattgtagttttttggtgcaaaatagatgttaagtcac

SEQ ID NO: 180 - DNA, 878 bp, Phaseolus vulgaris
agaaaccatctcatcactttttttctttcatcaagaactatataaaactattgcaaacctttgaatgtgagcaaataggttaataattatagatcattatagagattaagacactggttttcactcacagtttcataacacagtacaatgggttctcttatggcaggatggggctctacccatgtggatcctaagtcagccacacttaagaggaaccgttcactgacaaaagatgaaattgatgcttattggaaatcaaagaagaagattgaggaagaacacctcactgctatttccagttctccacacactcttctgaatgaagatggcagcaggagcactgaaaagaagtttcagaaatcaataagcatgccagtgacacgtgtacgtgaaagcttaaatattaaccttgttgatacaagtttggagcagcttataaagaaaaatggctggtggacgaagagtagctgggcatttctgaatgagcctccagtgaatgaagctgcatcctataagtacacatcacagtttcatgtcaccaacatgccttcatccaaaaataaaattactgcttgatttatataaatatacatcaatactatataatatataatatgtgtagtgctcaaactatatattagtggatttagttggtgctgttcatgttaagtgaactatatattatatagattatgagagaatttggtgtgtgtttggtgtggaaaatttgaaggcatggagaaagaacttgtggtgttggttattcaatgtaacttttttgggttttcttagctttgttggttcaatttgtgttgtagtgtgtggttttgtttgaagagggtaatggaataataatctgaacaaggtgctaattattt

SEQ ID NO: 181 - DNA, 744 bp, Phaseolus vulgaris
cagaaatctttgtgttgtttgtgtttgggtgttgtttaaggtagcaatggcaaagaaagagatggatgttgtgaagggtttggacttgcaaaggtacatgggtcgatggtacgagattgcttcattcccttcgttttttcagccaaggaatggtgagaacaccagagccacatatacccttaacagcagtgagggcactgttcatgtactgaacgagacatggagtgatggaaagagaagcttcatagagggtagtgctttcaaggctgaccctaaaagtgatgaagccaagttgaaggtgaaattttatgttccacccttcttgcccatcatccctgtcactggcaactactgggtcctctttgttgatgatgattatcagtatgctttggttggcgaaccaaccaggaaaaacctttggattctaagcaggaatacccaaatagatgaggagatctacaagcagcttgttgagagagccaaggaagaaggatatgatgtgagcaaactccacaagactccacagagtgatcctcctccactaggggaagaaggacccagagacaccaaaggcatttggtggatcaaatccatttttgggaaatagacttcaactttatatatatatatgtaacttatttctgttcaaatgtatttcaatctcatgtaatgtgtatgtagactgattaagaatgttcaaatctctataaagcatggatgtgtgtatgcttgctctatcatctg

SEQ ID NO: 182 - DNA, 1330 bp, Phaseolus vulgaris
aaagccctaaacccaggttttatgaagaacgcaatattgttgatgttcctctgcaactctgacctgcagtctatagacacccaacttcaatggagagcagtgcggccatggatgttgaggagcaaccttcacccaaccccactaacgtaaaacgcttcggccttaaaaactctattcaaactaacttcggcgacgactatgttttccaaattgtcccaaaggatgattggagtgcaatggcggtttcactgtcaacgaacgcagtgaaactatattcacctatggcgggtcaatatttcggagagtgcaagggtcacaccgcaaccatcaatcagattttattttcgggtacttcacatcaccaagttttgtgttcgtgttcttctgatggcactgtcagagcttgggacacacgcacatttcagcaggtttcttgcatcaatgctggttcttcgcaggaggttttcagcttctctcttggaggaactagtgggaatttagttgctgccgggtgtaaatcgcagatactgttctgggattggagaaatatgaagcaaattgcatgcctggaagactcccatgtggaagatgtcactcaggttcattttgtccccaacgaacaaggaaagcttatttctgcttcagtagatgggttgatctgcacatttgatactactggagatatcaatgatgatgatcatctagattcagtgattaatatggggacttcaattgcaaaggtggggatttttggagagagttaccagaagctttggtgtttaacacatattgaaaccctgggtatctggaactggaaagatggtagaaatgaaggaaacttctcagatgcacgtactttagcttccgaaagttggaatttggatcatgtagactatttcattgattgtcactactacagagaatctgaaaaactatgggtgattggtggcactaatgctggtactatgggctactttcctgtaaattacaaaggagtggcaacaattggagctgcagaagccattcttgaaggtgggcacacaagtgttgttaggagtgttttacccatgtcaaaaattcattctaatagtcctacccaagacatttttggatggactggtggggaagatggtcgactatgttgttggctctctgatcattcctctgaatcaaatcgatcttggatttcaagcacattgattacgaggccagaaaaaactcgcaagaaaaatcgtcatcaaccctactagcagaatccgttaactctaatagttcgataccgaaggagcaattttgtgttatttgccaatagttagttttattttcactg

SEQ ID NO: 183 - DNA, 1050 bp, Phaseolus vulgaris
acactgggttgtgttgtgtttataccaaacttcgaaaatggctactatagaatctgccctcaccctgttcgcacctcaacgattttcggactatcgttcgtctgcaaaaccccctcactccattaagctccatgattccacttcccttattttctcttccaatgcctcctctttcaaaactgcaagactctgcttacggctatgctctgctctgcaagagctacccacaacagagaaaacacctggcccaacccaaccaactgacaacctcaccaagctctacgttgctaacttgtcttggtctctgtcgccggctgacatcaagggcatatttgcccaatgtggaaccgtaacagacgtcgagataataaggaacagaaaagggaggcacatgggatatgccttcgttactatggattccggggaagaggctcaggttgctgttgataaatttgactcatctgagttatcaggacggataataagggtagagcttgcaaagacattcaagaaacctcctcctcctcctcctccacctcctccacctcctcaacctagagagacacgtcatgtactttatgtatccaaccttgcatggaaagcaagatctacccatctcaggcaagtcttcaccgaaaatttcaaaacaccagtttctgctagggttgtctttgatagccctgctaaacgatcagctgggtacggatttgtttcttttcttactaaggaggatgcagaggctgccatttctaatgtggatgggaaggagataatgggacgaccgcttcgcctaagctttagtgaaaagaaagataatgaagctggaagtgaaaaagaggaagaccaaattaaagatgctgaaagtgaagatgaagaccaaggttctgttgctcaaccagaagagtcataaattttggatattcatttacttgtctttgttcgtggtatgggattctacgagcttaagttacaccatgttgtaaaaaaactatgatgcatgaatttttgtattcacaatatttttcactaaggtcgagtttattattcctc

SEQ ID NO: 184 - DNA, 1618 bp, Phaseolus vulgaris
cctatcttgtcccacaccctatataaacattcagtttcattcagtctcatacatatcaacaccacaatcccaaccctttaatagatacaccatctcacagacatggctcttcaaggttcaatgtcttttgctgctttcactcttttcttggtcctcacaacagtctctcatggcagaaatatcaaccctcccgtgtatggtatatgttcctcttctgtcattctgcatggatacaagtgccaagaacacgaggttacaaccaatgatggatatattctgagtgtgcaaaggatcccagaaggtcgtgctaatggcagtggtagcagaaccaggaaacaaccagtgatcatacaacacggagttctagtggatggtatgacatggcttctgaaccctccagagcaagacctacctttgattttagctgataatggctttgacgtttggattgctaacagcagaggaaccagatttagccgccgacacatctcattggacccctctagcccggccttttggaattggtcttgggatgaacttgtctcctatgatctaccagccatctttaattatgtattcacccaaacgcagcagaagatcaattacgttggccattccttgggaactttgacagctttagcatccttttccgaagggaaattggttaaccagctgaaatcagcagccttgttgagccctatagcgtatttaagccacatgaacacagcacttggtgttattgcagctaagtccttcgttggtgaggtcactaccctcttcggtctggcagaattcaatccaaaagggttaactgttgatgccttcctcaagtctctctgcgcttaccctgggatagactgctatgacttgatgactgaaataactggtaaaaattgctgcctcaattcttcaactgttgatatattcttgaggaatgaacctcagtcaacatcaacaaagaatatggtgcacttggctcagactgtaagacgtggggtgttgacaaaatttaattatgtgagaccagattataatattatgcattacggagacgtattccctcctatctacaacctttccaatatccctcatgaccttcctctcttcattagctatggtggcagagatgcactttcagatgctcgtgatgttcagaatttacttgataacctcaagttccatgatgtggacaagctcagtgtccagttcatcaaggaatatgctcacgctgactacgtgatggggttcaatgccaaggactttgtatacaatgctgttatttcatttttcaatcatcaagttaacacttgatgccaagcaaactacgtcatagaaagaaccacgtggcttcatacgctagtgatcactgagatcaatcaaaagttatctagtgaagattaagtaatgaccaattacaaaagtaatgaagtatcactacaccagtgatttgctttggtgtttcaatggctgtgtatctattgtaatgcagaagaaattggctattggcctcaactatgtaacatggaaacacgtggatgagatttatcaaaagaactataaactaagctagatgcatatgtgtatgtatgcaaattactcgccgctatttacattctta

SEQ ID NO: 185 - DNA, 1138 bp, Phaseolus vulgaris
tgaccttatattgtttatgttcctagaaaactcagaccttgaattttgggtgcttacaaggcttcaaaagttgaagcctttaggaatctgagggatgggtttctcagtggcagcttcgttgggtactcatattgcactgagaaacactcacgaagcaagaatcaagtgccactttttgtacaaaagacaagagagcaatataattggtttcaagttctcaaagcccaaggcccttcaaagaaagatttctctaagcaagcaagagttcagtgacttggatgagaggaagagcccagatgaggttagagaagagattaaaaaatgttatgaactcatacacagattagggagaggagctgtgtatctgggttcttcaaggatgggacccagtcattcacattatgtgcagacacaagagctggctaaagagatagcaaatcttttggactgcacttcttggtcaggggctggaccagggctaatggacgctgttactcaaggtgccatgctagcaggaaaaccagtcggtggattcaagataggaaaagaagctggtgaatggacagcatctaactttcatccatacttaccatcagaaaattacctcacctgcaggtttttctctgcaaggaagcatgggctggtggatgctgtagtgaggaacaactcatttgataagactgccgtggttgcccttcctggtgggattggtactttagatgaggtgtttgagatgatggcattgattcagctggaacggattggatcaaagtttcctgttcccttgctcttgatgaactatgattcattttattcaaagctgcttgatttcttaaatgactgtgagggttggggaactgtctctaaaggagaggttgcatcattgtggaaggtttgtaacagcaactcagaagctttggcgtacctagaagaattctatggcatttcttctattgacaaaagtaagagtgtaactaaattttgtagcacgtatgaatcaccctcctcgtgagattttttactttccttttcttcctgaactattgcaatattaccaggtttttgttgacatttgacatgtgcactagcaagttctgattgtacatgaaaggtatcctatgattcacccataacacat

SEQ ID NO: 186 - DNA, 2471 bp, Phaseolus vulgaris
aagctggatgcttcaatccaaactgaaccgatcggttcaaaccggcggcatttttgtcagtataaacatactcgcagaaggtgaagaagaagaagcaaacacactagcttatagcttacaacaatggaattgaaggtgctgacacagatgcaagtgaccctgctgctgctgctgattgtgttgacaagaacaggaactgcagcagatgaccaagacctgctcggctgcccgaacaagtgcggagatgtttcgattccatacccctttggcgtaggtgtgtcagatatcacgggaaagaactgttacttggagaaaaacttggaactcaattgcactgactccattctatacgcaggtaacgtcgaagttcagaacataaccctcgtcggtcaaatggagatgaatttcttcgtctccagtatctgcaaaatcaacatttctaacggaaaaaataaatccaacacacccacactccaaactgcatccttcactatttccagcacggacaacaagttcgtgagtataggctgcgacacgtacgggtatctcaacagttacgtcgaccaagctaaatactcaacagggtgcttgacaagatgtgacaagaatgacccgaatgtgaaaaatatgcagagaaatgatgggaaatgttcgggcatagggtgctgccaggtggatatacctcctggaatgaagaacatcagtatacaagcatcctcctttgatgatttcaaatccttttcgggtaacagctgcagcgtttcgtttgtggtgaaaaatggcgggtacagtttcaagatggatcatttgaaacacatcccattcgataaggctcccatggtggttgattggactgttggagatggtgcctgtaacgtttccaagaataacgacaactatgcgtgcaccagtaatcatagcgtttgcgaggacccaccctatgccaatcgaaatggctaccaatgcaaatgtaaacaaggttttgtgggcaacccttaccttcgcactggttgcacagactttttggaatgtacaacgggcaatcacaattgcgcaagagatgagtattgtcatgatattcctggctcttttgaatgtttatgtcctgttggactaaccggaaaagcaacaaacggaggtggaggatgccaaccaaaaaaggaggatgatgcatttaccaagatcgtcattggatcaggtgtaggattaattgctctatttgtgggggtttcttggctgtacttgatgcaccagaaaaggagactgctcaaattgaaggaaaagttctttcagcagaatgggggcatcattctaagacagaaactctctgcaagaggagaaacgtctcaatccgccacaattttcagtgttgaggaactaaagaaagccaccaacaattttgatgagagtttaatcattggtagaggaggttttggaacagttttcaaaggagttctcttaaataacgaagttgtggccatcaaaaagtccaaaataatggactcgagccaagtggagcaattcatcaacgaggtcattatactgtcacaaattaatcacaggaatgtggttaaactctttggttgttgtttagagacagaagttcctttattggtctatgaatttgttgaaaatggcaccctttttgattatttgcataagcaaggccaggtgcctaatgtaagttggaaaacgcgtttaaggattgctacagaagcagctggagctttgtcatatctacactcggaagcttccatacccatcatccacagagatgtgaaaactgctaacatactcttagatgaaagtaacacagccaaagtgtctgactttggagcttcacgattggttccacttgaccaaactgaaatagccacaattgtgcaaggaacctttggctatttagacccagagtacatgcaatcaggccaattgactgaaaaaagtgatgtttatagctttggggtagtgcttgtagaacttctaagtggggaggaacctttctcttctcacaagacagaagagaaacgaagtctcacatttcattttcttagtagcttggaaaaggattccctgattgatgttcttgagaatgatattctggatgaagaaaataagcaggagattatggaggttgctattcttgctgccaggtgcttgaaacttagaggggaggaaaggcctagcatgaaggaagtgacaatggaattggagggaataaggcatatggacaaacacccttggaccaatacaagccaagattttgaggagagtcaatacttgctttctgagccacaaagcactcctgaacatggttacagtagtggccaacaaagtactggatttgatagcttgagagaacttgaattaattaactttggtaatgggagatgacacaccacaccaacaatatcaattcccacttcactattttagttttctttatttattgttaagttagtctcattata

SEQ ID NO: 187 - DNA, 3253 bp, Phaseolus vulgaris
aaaaacgttaccattttattttcttcgcttcacttcacttgccgtctctttcttcttacaatggaggtctcagacgacgacgacggtggccacgttttccttgtttgtactaacaccgattcaatccaagcagccgaaaccctaaacaatgagattctcgtgtccacaaccgatatcctcgcttgggatctcccaacgattctcacttttccgacgattaaagttcaggcacatcccaataggctcattgaacaatctttgtatttccgcggcctcctcagcgggaacttcagtgaatcatgcttgggctctatctctatcaattggaatgtgagcgaatttttgcaaattcttaagcatatgtgtgactgcgttttggatattacgttggataatttcttccctctttatgagggtgcgctttattttggagtggagtcacttctcttgaagtgtgaggtgtggctttctgaggtgctctcacccgaaggatttcaatctactcaaataaaaatggaggacttgatccaaatttggaaatttggttcagatcgcgcaagcgactatgtcctgcacttatgtatgggctacctagcaagaaattttatgtgggcaaagcatagcaatttttttgttaaacttccatttgacctgctgttatcttctgtaaagcaccctcatttgactgttgacagtgaactgcatctttctgatgcacttcttctctggcttgaaagtaacttggaaaatttggagaggccaagcaaaactgaagacaattgcaacggaattttgaaacaaattcgtgtgggccttttgcctttgtggtttgctctaggaaaaagaaactctttttattttagacagctggctgaggaaagccttgattcaattttcagactactgaatattgttcctatgggttcactagatactttcaagtatagtgacttgcatcatctcaggattaggttgacagaatattcaaagaaaatggacctttctggttgcccgcaaataacatctaccatacttcgtctgtcactcatccctcaatcatatttaacagttcccatgcaaaagaagattatagaaaatttatttattaattgtgaacatcctgtaagagataaatgggtgttcccccaaaatctgtcagaagaaaccttgagctttgaagcagttcaggaggtggatatgtctaagtgtcaaaaattgtgtgttgaacatgctgttgattgcttccgcaagtcctttccttctttaagaacattgaaagcaggttatcttttgaatattgggacaatcagtttccttcaattattggagaaatgtcccttggtttctgaaattgacttgactgttgatattaccccactgataccagcatcagttacagttttatcctctagtcctgctgagatacaaccaataccagagaagacttcgagtgttaaatatcaagcagtgcaaatcatgttatttaatgaatttggacctcctctttctaatgttacaaagctcacattggaaggaagaactgatgtcagtgatttgggcctccagtacatctccaaattatgtgtttcattgtgtcacctgaatattaaaggatgcatttctgtcactgatattggcatatcagatctcatatccacgagtaaaaaacttaattcaattgtggtttgtgatacttcatttggggtaaattcagttcaagctctttgctcagctatttctgatagtggcaacatctctctgcattctagagataagcgtttgaattcagcggtgtctaattttgaaacattgcatattggtggctgccagggtgtttctaagtcatctctaatagagcttatgtctcaaacacaagttttgaagagtttatgcctgagaggaactgacctgattgaccaggcactgtataactatgtaggttcttccttggagatgcttgatatttcaaatacaaagatttctagggctgcattagcttatgttattcaaggaaatccaagtttaaagtgtctgaaagcaagagactgtcgaaatttgtttcctggagacaattgtgctgaaaaaagagaatctgattttccctctttgcatgaaaaactacacgctgagttaggaaaaatgtatagattggaagagattgagtttgggtggggcttttcttccttctctttcatttctctggaacctgcactgatgtcattaaaggccatcaatataggtttaggtggaatgctaggtgaagatgctttgaaacggttacctgcaatctgtcccttgctagaaacaataatccttcattttcaggtcatatctgatataattgtgatgaactttgttgcatccttgaaaaacttgcaagtattagctatgtgctattgttttggtgatatatccatgtcaagcttcaaattcccgatgcaaaatcttagaaagctgaggcttgaaagagtaaccccatggatgacgaatgatgatttggttgttctaactcaaaactgcagaaatttggctgagctttcattgctagggtgttctcttcttgacgcagactctctaccgataatttcgtgtggatggccaggcttggtttctatccatttagaggactgtggagaagtaacagctaatggggcttctgctcttcttgactgcaaagctcttgaagatatcctgctgagacataatggccctgggctatgcagaaacttcgtttgttatgctacttcagagatgccattgcttcgaaaattgtcactggatatatgcgatgcaagggaaggtgattttgacattccaaattatgcaggcagatactctttgagtaccttaaacatagctagatgcaaatctaaaaaatgtgcatttaatctcccagcgtctacctcaggggctcgcagtagatccgtgcatatcgaaacgctggtgctcgtgtggaacaacagagatctaatcagaacagtggtgaaggaaagactttagtaaatacatgtctgggcattaatttgtgaggggtatcatcatccttttctcgaagatgattagttagtttttaaacaagtggtttggtggcaggaagtaaaatgcttagtgattaagatggtcacttgtgacgctaaaaagaagatcgtcatttgttagttaattagtaaaacaagaggcaaaacgatggttatgttgtgtgagagataactgtccttgttatgtttctctcatttgttttaattttttgagc

SEQ ID NO: 188 - DNA, 1562 bp, Phaseolus vulgaris
caatatgaacattccaagccactatagttgctactcagtttctttatctttacgctaaccacacatcaaaatacaagaaatgaacacatatatataaaccatctctgcaaagcttcgaatgcagattttatctcagccatgaaagttctgaatgggaaggggaagtatgcacaaggaaacctaaaccttctcaagagtgttgttatccttcttccattcaccctgcttattctcatgttgccgttttctcttacgataaactctagtttttcctctcctaatgaggtgtatgttagtagaagcagctatgattttaacgtgacagagataaaacgatgcaacgtgttttctggggagtgggttccgtacagtaaaggagcttactatgacaatgagacctgtgatttgataatagaccagcaaaactgcatgaagtttgggagacctgacagagagttcctcaaatggaggtggaaacctgatgaatgcgagcttccactcttcgatgcaacccttttcttagagattgtcagaggaaagtccatggcctttgttggagactccgtgggaagaaatcaaatgaattctttgttgtgcctcctaaatcctgttgctcgtcctgaggatatttcaagtagatatgctacagatcccatatatttcagaaggtggttctatgcggattacaactttacagttgtaacactatggtccccatttttggttagaagcagcgatgtccacagcagcctcacgaatctgtatctagataaggcagatgaatcgtggagtggagaggtgaaaaacttcgattttgtcattatctcagctgggcagtggttctttcggacagcattgttctacgaaaaaggacaagttgtagggtgccacaagtgtgagcaaagcaacatcacagagctgagtcactactatggatacagaaaagcattccgaactgcactgagaaccatagtaaagatgaaagggtacaagggggtgacatttttgagaacattctcccctgcacatttcgagaattctgagtggaacaaaggagggagttgtgagaggagaaagccttatgggaaggaggaaatgaagtttgatggttacatttttgagacgtacaaggttcaagtggaggagttcagaggagcgagaagggaaggaaggaagaggggtttgaagtttttgatgttgaacacaactgaaatgatgctgcgtaggcctgatggacatcccaataaccatgtgtggggacatgaaatgaagaacacgcacagtgattgtgttcattggtgcttgcctggccctattgacacatggaatgagcttttgttctatcagttgaaaactcatcacaaatcttttatttcatcgtagggatttgtgtaggatacattagatttacaaaaaggtatattatttctcatagccttcgatcatggagatgtctcgaattcggcttttgcttcctggacaatatcactttgcaacatacactatataacatagataaaatgacagaaaccttcataagtcttttcaaaaaaattctccta

SEQ ID NO: 189 - DNA, 2868 bp, Phaseolus vulgaris
ttcttccatcaccaaccacaaacacattatccaagcacagatcaaaatctgcaggcacgtctatgctgtaatggcagacagtgtagtttcctttgttttggatcacttatctgagcttgtggcacgtgaagctaacttgctgtatggcgtgaaggacagggtccagtccctccagaacgagcttcaaatgatcaacgaacttctcaatacctcaaagagaaagaaaggaatttcaaatacagtggtgaaccaaatcagagatgtggcccacctagctgaggatgtcatcgacactttcgtagccaaagttgccatttacaagaggagaaccatgctcgggaggatgcttcatggctttggccaagtaaggttgctccatgacgtagccgacaaagtagacaagatgaaaaccactctcaacgaaatacgcgacaacaaggacaaatatgatgctttcaaagaaatcaataatcaatctgcagcagaagaggaggaggagaaggaaagggcgcaatcattacacaagctaagaagagatgtagaggaagaaaatgtggttggctttgtcgatgactccaaggatatcatcaaacgaatcttggaaggtggttcaaatcgtaaagttgtctctatcattggcatggggggattgggcaagaccacccttgctcggaaggtctataacagcagcgaggtgcagcaacacttcgagtgtcgagcgtgggtttatgtgtcaaacgagtgcagagttagggagcttttgcttggccttcttaagcatttgatgccaaattttgaacaacaatgcagaggcaagaagaaaggaaagaaaagcactcaagacaatagtagcttgagtgaggaggagctgaagaaactggtgcgaaacagcttggagagtagaacatatcttgtggtggtagatgacctgtggaaaaggcaagattgggacgaggtgcaagatgtttttccggacaacaacagaggcagcagagtattgatcactagtcgtttgaaagaggtggcactgcatacttcccatgatcttccttactatctgcagttcctgagtgaagaagaaagttgggagttgttttgcaggaaagtgtttaggggtgaagactacccttctgatttggaggctcttggaaagcaaatggttcaaagttgtcgtggtttgccgctctccatcattgtcttagcaggactgctagcctacaaggaaaaatcacacagagaatggtcaaaagtggtgggtcatgttaattggtatctcactcgagatcatacccaagtgaaggatatagttctcaaactcagctatgacaacttgccaaggagattaaaaccatgctttctctatcttgggatatttcctgaagactttcaaatccctgttacgccattattgcaaaaatgggttgccgagggttttatacaagatacagggaatagagatccagatgaagttgctgaagactacttgtatgagctcatcgatcgtagtttggtccaagtagcaaaagggaagactaatagagatgttcacgttcatgatcttcttcgagacctctgcatatcagagagtaaagaggacaaagtttttgaaatttgcacagacaataacattctaatcccgacaaaacctcgtagactatccattcactgtaaggtgggtcattacatttcttcgagcaacaatgatcattcatgtatccgatccctgttcttatttggccaagatgactttggtactgggaagcagtggaaatggctttcaaaagacttcaaattggttcgagtgttggagcttggaccaacctggcttagcaccctttctaatttagggaactttatccacttaaggtacttgagaattgaagcaacatctgattttacatttgttccatcttcaatacttcacctttggaatctacaaatcatagacctaagtaattggaggtatgtgactgaaatttctttcccagtcgaaatgtggaaacttaaacatttaaggcatttgaatgcacgagggcctatcaagctacgaggcaattgttcaggatcagatgagaagatgtggaatcttcaaaccatctctgacctcgtagtcaacagacaagcaacatctctgataaagaaaggaacattccccaatcttaagatgataaggttgtgtgtgacttctgaatacaaagatgatgaaataaccaaattgttgcaaagcctacaacaatcaagtcatttgagtaagttagagattgtcctctgggatatttatgacaaaggttgcaagccgaaagaactgttgcaaagcctagggcagttcaattgtataactttcttaattattgaaaatgtttttgaccttctgacttgtgcattcacatttcctccaaacgttatggagttagagttgtcagagattaaccgcattactgatgaggggatgaatggtttgggaaatctcaccaaactcaaaattttggaactttggggacctctatataagggggattcctttgacctgaattgtgtggaaggcagcttcccaaaattggaagtttttgaaatggcatatttgagtcttgaaaagtggaaattaggcaatggtggaatgtcaaggcttcaaagtttgatcatctacaattgtgaaagcttagatgatctcccaaatgaactttggtctttgagtggcttgagaagagtaaatgtaagggaatgctcgaaacaaatgtatgacacgctacggaatttagaaacaaacaatggggttgaactcatcctagaggaagatcgtgatactttattgtaataaatagctttgttgatgatataagaaatatataatatttgaggttcttattt

SEQ ID NO: 190 - DNA, 1189 bp, Phaseolus vulgaris
gaattgggtggacgagactgaaacgacaaggaacgcatcagctctctcacattctcagaatgctaaccctcaatcacaatgctatttcttcttcgttctcaactgttccatttcatgccaattatgcactctctactccaactcaatttttattttcttccaatcttaattactcctttgctacaacagcaaccagaaagctcaagtcttttcagctcaaggctggattttgggaatcaattaaatctgggttgatgaagaataactcaatgcaagtcattgatccaccctctatagatgaagaagatgaagaacctctgcctcaagagtttgtccttgtggaaaagaccgaacctgatggaacaattgagcaaatagtattctcttcaggtggagatattgatgtttatgatcttcaggccctctgtgacaaggtagggtggccacgcagaccactgtcaaaattagctgcggctttgaaaaatagctatatagtggcctcacttcattctataagaaagtctcctggatcagagggggatgaacagaagagattaattggcatggcccgtgctacgtctgaccatgccttcaatgccacaatttgggatgttctagttgatcctagttaccagggccaaggtcttggtaaagctcttatagagaaactgattagagctcttctgcaaagggacattggcaatataactctgtttgcagatagtcaagttgtggaattttatcgcaatttaggctttgaagctgaccctgagggcataaaaggcatgttttggtacccgaatcactaattgcaacccccacaaagcttgctttttctgatgttaacgtttcaatttgcaaccacaaagtatataaaagagaagcagtggcaaatttacctattacttgtaccattaaggtgcaaagattggacaccaatcctgtgattgattattgcgttaggtgttagcaagttttttttaaaaagttttactacttttgattatagtatgtctgctttatattttaaaaaactgaaaaccatcactcattatcacttagtgattgtgattttttttactttttatgtttgttcattttggatgaattgtattgtataaagatagtagttttcttctgttgtttggacgttgagtttaatacacgggtactgttaatgaaatttttt

SEQ ID NO: 191 - DNA, 3471 bp, Phaseolus vulgaris
gatcgatgaactcataaagtcgtaaagaatatctatttatttatatttatcatcaaagtttagttggtggtgatatcaaattccagctgttcttgttgtttatcgaaacccgcgaaggaatcgaaattgaaatccaagtgtgaacagaacagaagaacagaacacaacacagaggttgatttgtttgttccaatcggtgttgtcgggggcatggagagtgtgaatgatctgatccaagaggccaagctccgcactctctggtgggccctctgtatatttgccgtttcctatttcctaactcatacaagtaaatcaatgtggatgaatctacccatgtcgatcatatttgttgcggggctgcgtattctttttaatagggtggagttccgttggaaggttcaagagcctaaaccgctgacctatttatcacatttggagaaaaaacagttgtctctgaaggattcacgcctcactagtttacctccccctgcgaaatggaagagaaaaatcgattcccctgctgtggaggctgcaatgagagagttcattgataagattttgaaggatttcgtggttgatttgtggtactcagatattactcctgataaggagtttccggagcagattcgggcaataatcatggatgttctagctgaaatatctggaagggttaaagagataaatctggttgacttgctgacaagggatgtagtagatttaataggtgatcatttagaacttttcagaagaaatcaagctgctataggtgttgatgttatgaaaacattatcttctgaggagagggatgacagattaaaattccatctattgaattctaaggagctacatccagcactaatatctcctgagagtgagtacaaggttcttcagcagctaatgagtgcagttttagctacagtactaagacaacgggaagctcagtgtcctgtgattcgttctatagctcgagaattattaacttgcttggtaatgcagcctattatgaatttggcaagccctgggtatattaatgaactgattgaagctcttattcttctccttaatgatgatggtacggaaggtatgggcagtaatcagtcaactaatgtagcaggtcaccatcatggacattctgttgtcagtgagggtggacacaacaatctcacaccctctaataagaatccatcattaaatcaaggaactgagatgatattggctaaaacgagtgatcaaggagggacatcattgcaaggtaacaatctccatcaagaatcttcacaggccaggcctgctgattgggcacgaatgttggaggttgcaactcagaggagaactgaaattctcatgcctgagaatcttgagaatatgtggacaaagggaaggaattacaaaaggaaagagaacaaaattatcaaagttggctttcaggatcttcctgctaagagcccctctacagacagtttgcctcctagaaaattggctcaggaaacatcagcaagtaaacgtggaaaatatgaagatgcagaggggaattctcctcttccaaaatttaatgccttgggttcagatcccctacaaaatgttgcaactgcaaaaatttcagaatcttctcaaaatcccgaaaaggaattatcttttgcgaaagatcttgctactgatggttatgaaagtccactgaagaggtccaatagtgcttcttccttaggaatcctaactaacaaaggaggctccataatttcagagttttataaccccgaacttgagaggcacagtgaaggatttcggggaaaaagttcttctgacatggttgtcaggaaagaaaggccgttggtttctaagctccggtgccgggtgttgggagcgtattttgagaaaattggctccacatgttttgctgtttattcaattgcagtgactgatgcacaaaataaaacttggtttgtaaaaagaagattcagaaattttgagcgattgcatcggcatcttaaagatattcccaattacacattgcatttgccacctaaaaggatattttcctcaaacacagatgacgcttttgtacatcaacgttgcgttcaacttgataaatatctccaggatctcctatcaatagctaatgttgctgaacaacatgaagtatgggatttctttagtgttacctcaaagaactactcatttgggaaatctccttcggtgatgaagaccttggcagtcaatgtagatgatgcaatggatgatattgtacgccagtttaaaggggtttcagatgggttgaggcgaaaagtcgttggttcatcatccctcatgagtgagggatctgttacatcttctaccacatggaacttgtccttgaattcagatgaaattgacaaaatcattccaaggcaaggtacttcagaaagtgtgttaagctccgatgaggaaggtgaaaagaacaacaattttgatgatgagaatattgttagcgaagtagcacaagttagtggattgcattttgacaatgcattgatcttaaagggttactcatctccattaaacaaccgtgatgaagagtccaacaacttggattttgatagaaagcatgatatggtggtggaagctagggttggcaatgatgttcctgctacgaatttcattctgattcctgataatttggaggatccagttggagggccacctgagtggtccccacctaatgttagtgtccctattttggatttggttgacaacatatttcagcttaagaaaagaggctggataagaagacaagtctattggatgtcaaaacagatattacaactagtgatggaagatgcaattgatgattggctcctgagacagatacattggctccggagagaggaaacagtagcccaggggattcgatgggtccaagatgttctctggccagatggtacgtttttcttaagagtagggattcctcggatgataagtagcgatgatgatcaaatgccttctcaaacaacaagcagatcaggcggaagcaacatcaagaaatctgagtcaggctcttttgaggaacagcttgaggctgctcgtagagcaagtgacatcaagaaactgttgtttgatggagctccaacaacattagtgagcctaatcggccataagcaatacagacgttgtgcccgggatgtatactactttagtcagtctaatacatgcgtgaagcaacttgcttatgcaattttggaacttgtacttgtatccatcttccctgagatgcggaatgttgtgttgagtgttcaccaacacgtcaagagttcttcttctatatgacataacacgttttatggctttgctggtgttgctggtgggatcatgaatgtccaactgtataaaacataggtttagggcgtgtacatacatacatagatacccattgtgatggggattttgtattgttacagactccagaaatgcatctactcaatattctttattcgttca

SEQ ID NO: 192 - DNA, 1419 bp, Phaseolus vulgaris
acttcgcattcaaatacttcgattgattacaattccgaatctaaatcactgttgttgcgtgctgcgcaatctgccaccgttcgtgaatttttcatccaatcaattttgaaggaataccgctggagattcagaataatgtccgaaacgataagagaaaacgatgccagattaacgtcccaaacgtcgacaagctccaggttctggcctcgttggattcccacttccattgatcatatcatcgctgccgagaagcgtcttctctccgtcgtcaaaaccggttatgttcaagagcatgttaacataggttctggtcctcctggttccaaagtgagatggttccgttcagctagtaacgagccgcggtttattcacaccgtcacgtttgacagtaaacctggttctcctacgcttgtgatgattcatggttatgctgcttcccaggggttcttctttcgcaattttgatgtgcttgcctctcgatttagagtcattgttattgatcaacttggatggggtggatcaagcagacctgattttacatgcaaaagcactgaagaaactgaggcatggttcattgattcttttgaggaatggagaaaagccaaaaacttgaccaattttatactacttggacattcttttggtggttatgttgcttctaaatattcgctcaagcaccctgaacatgtacaacacttgattctggttggatctgctggattttcatcagactcagatgcaaagtctgagcggattacaaggtttcgagcaacatggaagggagcacttttgaatcatctatgggaatctaattttacacctcaaaaacttgtcagaggtttaggtccttggggtcccaacatagttcgcaagtatacaagggctaggtttggcacacattctactggggaaatactgacagaagaggaatcaacattgttgacagattatgtttaccacacattggcggccaaagctagtggggagctgtgcttaaaatatattttttcatttggagcatttgccaggatgccccttcttctcagtgcctccaagtggaaggtgcccaccactttcatatatggtttcgaagactggatgaattatcaaggtgcccaagaagctcgtaagcttatgaaggttccatgcgaaatcatcagggttcctcagggcggacactttgtgttcattgacaacccaactgccttccattcagctgttttttatgcttgtcgaagattttttacacttgatccggacaatgaacctcttcctgaaggtttaaccttggcatagtttaggtcttattgacaatcattcctatatgtgtatgtattgtttcactgaagtagaatttacagagactaatttataattgtaatttcaacggaaaaaaaaataactagttgtattttattc

SEQ ID NO: 193 - DNA, 1043 bp, Phaseolus vulgaris
tgcagaagcaactgtcttcccttttcctcgtcacaaaccgtcgtcgtttgatgtgatgtcttaggttcccttccgttttcgccagcaaatatcgcagtctttcaaattcgtcgtgaaatctgaacctttttaccatctctgcgaaattgctcccaaacagttgactcagggaaaaacaaggagccagaatccatggaaacacagtatgaggaactcgcgagagaagactctattcccgacagttcctcagaagatgaggaggaggagatagagaaggagttagctgatgtaacgtttgaggagctgcagaaagcacgttcgaatggggcacatgcttttttccagaaacccaaagaagacaaaaagttaaaaagggctaacaagaataggcctatggaggccagtagcaagaagccggtttctgcttttagagaggccatccaagctccaaagaaggttatacgtgatccacgatttgaatctctttgtggtacacttgaccctgaagggtttaggaagaggtataatttcttatatgaaaacgatcttcctgctgaaagacaggctctgaagaaggaattgaaaaagtataaagatccaaagcgcataagtgaaatagaagaacatatatcatggattgataaacaaatgaaatctgattcaaggaagaatattgatacgcaaatattggctaagcataaaaagaaagagagagaagcagcaaaggaggggaaacgtcctttttatataaaaaaatctgaaatacggaagcaaaggctgattgagaaatataataatctcaagtcatctggcaaacttgaagcatttgttgagaaaagaaggagaaggaatgctgccaaggaccacagatacatgccgtatcgtagatctggtgatgtggaataaattttgtacctttaagactctttcttaagctataattataatagaatgtagcaccaaaaagaaaagtaatttatgtttttggctgccagttttggggattaaatattgacgtttgttgattatgtttgttgtgtgac

SEQ ID NO: 194 - DNA, 2560 bp, Phaseolus vulgaris
ctcagtaaagaaaaccaagaccaaaaggaataaaaaaaagtgggagagagagggagaagtagagaacagaagagaaaaagataagactagtaagctagcatttgttggtggtgttgttcaggctcagtactcaaagggaaaggatttaggaaagagatctggtatatggttgtgtgtgtgaataatagagtgcttgaggttgtggtgttggtgaagaatatttgtggagatgtcaggaggaggatgcagcatagtgtggtttaggagagatctgagggtagaggataacccggcactggctgcaggagtgcgagctggagctgtgattgctgttttcatatgggctccagaagaagagggtcaatactacccaggtagggtctctaggtggtggctcaaacaaagtttggctcaccttgattcctctttgagaagccttggcactcccctaatcaccaagcgctccactaatagtgtttcttctctattggaggtcattaagtcaacaggggctactcaactctttttcaaccatttatatgatccattgtcacttgtgagggatcaccgaacaaaggaggttctgactgctcaaggcattaccgtacgttcattcaactcagatttattgtatgaaccatgggatgtgaatgatgctcatggccaaccattcacaactttttctgctttttgggaaagatgcctcagcatgccttatgacccacaagcacctcttctcccacctaagagaattattccaggtgatgcttcaaggtgcccttgtgatacattggtgtttgaagacgaattagagaaggcaagcaatgcgcttctttctcgagcatggtcaccggggtggagcaatgctgacaaggcattggctgcattcgtaaatggtcctctgattgaatactcaaagaatcgtaggaaggctgatagtgccacaacctcatttctctctccacatttgcactttggtgaggtgagtgtaaagaaagtgttccatcttgtccgcattaagcaagtgttttgggccaatgaagggaacaaggctggtgaagagagtgtgaacttgtttctcaagtctattggtcttagagagtattcgaggtatatcagtttcaaccacccctacagtcatgagaggccccttctgggccaccttaagtttttcccttgggtggtgaatgaagggtacttcaaggcttggagacaaggcagaacagggtaccctttggtggatgctggaatgagagagttgtgggcaactggttggttgcatgatcggatacgtgttgtggtttcaagtttctttgtgaaggtgctgcagcttccctggagatggggaatgaagtatttctgggatacccttttggatgcagatcttgagagtgatgcccttggttggcagtacatatctggtactctccctgatggtcgcgaatttgatcgaatagataatccacagtttgaggggtataaatgtgacccaaatggagaatatgttcgacgctggcttcctgaacttgctagattaccaactgaatggatacaccatccgtggaatgcaccagagtatgtactgcaagctgctggaattgaacttggttcaaattatcctcttcccattgtgggaatagatgctgcaaaagttagattacaagaagcacttatacaaacgtggcaacaagaagcagcttcaagagctgcaattgaaaatggaaccgaggaagggcttggagactcatctgaatcagcccctattgcttttccccaagacacactcatggaagaaaggcctgctgaacctgttaggaacaacccacctcatggtactcggcgctatgaggatcagatggtcccaagtatgacttcttcccatgtgagagtggaagaggaagaaacatcttcagaccttcgaaattcagcagcagacaacagagcagaagttcctacaaatgtgaccacacaacaaaatgcaagagagacagtgaatcaaggagagctgctgaatgtaaatagaaacactcgagtacagaataatgctacaatgtggctgagaaatgcagctgaagattccacagcagaatcttcaattagtactaggagagaaagggatggaggtgtagttccagtttggtctcccccagcatctaacttttcagaacaatatgcagatgatgaaaatggtattggagccagttcatcttacttgcagaggcagcatcctcagtctcatcaattgatgaactggacgcggctacctcagactgggtaattcagaggtagaacgtgctgattagtatcagggagatggaaaatgcagtctcccctcatcttttgggaaaagtgggatggcgaatctcgtattggacctacatgtgatcatttcctacatccttaaacatgtcttgacacatgattaacggctgaccacgatgtgcatgaaaatttcagttcatgcgggtagtagtttcatctgcagtgccttttgctctcttgtacaaaatttttaggcctactgtatagtataatttgtgttgtggaggagaaagagcca

SEQ ID NO: 195 - DNA, 1924 bp, Phaseolus vulgaris
aacgacgcggaaactgggcgaaatatagcccacgccaccgtgtttgggtcagtcgtcatggaagtctcaaaagatcctaactcaaacccgggtcacttcgaagattcagattccgaactcgaactctacaccatcccaagctcttcaagatggttcgcgtgggacgaaattcacgaaaccgagagaacagcgttcaaggaatttttcgatgcgagctcgatttcgagaacccccaaaatatacaaagaatacagagacttcatcatcaacaagtacagggaagaaccttccaggaggctcacattcaccgaggtgagaaaatcgctggttggtgacgtcacgtttctgcacaaggcgttcctcttcctagagaattggggtttgatcaactacggcgcgccctctgctgcagacgtggagaaggaagaggaggaggaggaaccgtgcaaggttcgcctcgaagaaggaacccccaatgggattcgcgtggtggccacgccgaactcgttgaagccgatattggtgcctcgcggtgcgaagactggtggaaatgcgaccgcggcttctctcaaattgccaccgctcgcctcctattcggatatttatggggatttgattaggcagaaagaggggaactgtgggctttgcggtggcaaatgtggttcaggacattacctatgtactcaggataatatcattatttgtgcaaattgtttcaaaagtgggaattatggggagaaaaggtcttcagaggatttcgtattgagtgagtcaagtgaaaatagtggcaaacatgacactgtctggactgagggagaaattcttctccttttggaatctgttttgaagcatggagatgactgggagcttgttgctcaaaatgttcaaaccaagactaaacttgattgtatctcaaaactcattgagctgccttttggggagctcatgttgggccctgctcacagaaatgtcaacattaatagtgctaatggcgttgtggtgaacaatgccaaacaagttcagtcatcttcgtctgacaaccaagaaatttcaaagacaaaggatcaacctcctgagcctacaaatgaaaatgagcagaatggggatgctgtgaaggaaagtccttcaaaaagacagcgtgttactcccctgtcagattccagttgttcactaatgaatcaggtgggactgatctctaatgtggttgaccctcatatcacagctgccgcagctgatgctgctgtttcagctctttgtgatgagaatttgtgtccaagggatatatttgatgttgaagaagattcagcaagagatcttgagggtgaaggtttagagatggagaggtcctctctatcagaaatacctttgccactgcgtgtaagagctgccactgcaactgctcttggagctgcagctgctcgagcaaagttgttggctgaccaggaagtcagagagattgaacatttagtagcaactataattgaagctcagatcaataaattgctgtacaaggttaaacattttgacgatctggagctgttgatggaaaaggaacatgctgaaatggaaaatataaaagattctatcttgactgaacggattgatgtgttaaggagaacatttagatctggaatcactagatggaaggattattcttatgtaaaatcttagaccatgtatagttttggtactcgatgggtacgattggactgtcattttacctaagggccaacgaattactgtaagatttagtattcaatatcatttttcatcagtgccaatgtagtaatgtaaaattgattatttattacaccgtaatccagttatcagctaacagctttgaaaagttatatcttttatactatctaaacctttttgggtagcgcttacgtgccattgatatttctaattttggcttttgaat

SEQ ID NO: 196 - DNA, 969 bp, Phaseolus vulgaris
aggaactccaataagcaaaagccaattgatacttgcatatcacaaaacacacacacacactctctctcaaaaaaaaatctcctatcacctaactcacctatcctcaactcaaagccctttagtctcagcaagcagcaagtgagagtgttacacaacatggaatatacttattcagcagaggcagaaacttacaccagtagcagtaccaccccatcaagtgccatgagatcaaagaagaaagccaacaacaacacaagaaggttcagtgatgatcaaatcaaatcattggaaaccatgtttgagacagagtcaaggctagagcctagaaagaagttgcagctggcaagagatcttggattgcagccaagacaggttgctatatggtttcagaacaagagagctaggtggaagtcaaagcaactggagagagactatggtatactacaatccaattacaacagtttggcctcacgttttgatgctcttaagaaggaaaagcaaacattactaattcagttgcagaagctgaatcatctaatgcagaagccactggaagcaggtcagagtcgcacacaagatgaagcagcaaacagcatggacagtgaatcagaaaatggaggcaccatgaaatgtgaacatgaggaaaagccaagcccaacaatggaaagatcagaacatgtgcacggtgttctgtctgatgatgacgctagcataaaggtggaagactttggcctagaagatgaacatgatctcttgaactttgttgagcatgctgatgactccttgacttcaccggaagattggagtgcttttgaatccaatggtctcttaggccaaacgaccagtgattaccaatggtgggacttctggtcctgaatgaaacagaacaaccaaaattttgtggaggaatgtatacatattaatgcttcatgtttggttccatatttagcatgcaatttttcacattaa

SEQ ID NO: 197 - DNA, 2351 bp, Phaseolus vulgaris
gggtttagggtaggtggagttcaattcctgattatttgtgataacagtaattgcagtttaatttaggagaaaatcgttcgaatccctaattacaattgctgaaccaatgtcggaggagaagatgagcgagaaggattccactgaagctcagcagaatcccaatctggaggactgcttgaaactgctgaaaggagagcgagacgaacagcgtcttgcaggacttcttctcgtaaccaacttctgcaaagctcaggatcactcctctcttcggagggtctatgatgcggttggccctcgctttctctatcgccttctcagaactggtctcggaagttccctcaatgagaatcgcgatgcgtatttaagcctatccatcactgttcttgctgcattttgtcgcgttccagatatagcttcttcggacgacatgctttttaatattccacttgtgttggaagtaatacccaccctgtctggttcgtctcttcttcaagaatgctacgagtttttgtacttggtgtctgctgcttctgaaaatggaatcacgagattttgtgaatctggaggcatcaaggtactagcttctcaaatgactgttctgcaagacggttcatatctgatggaagtatcttttaaacttctgcaattgattctgggtaggatgtccttggacataatccagagtaatgacttatctgactttccagttattgtggcagcaatagcaaggcagtttgctgttttgcacaattccttgaaattcgaagctctccacttgctaaatgtcattcttacctcaaaagattcatcacaacttcgtgaggccttacagttacttcctcaagaaagctggtcgcacaatatccgcactggtataatggctgttctgcagaaccgtgttgctcctgctgaaaggttgcaggctctcattttagctgagtctatggtttccatgcatggagaagattggttggttagccaagtaaacacaaatgatgcacgagatccagcttcagctgacatgtgcctgttacttgtcttggagcagtcaagggttgaaattgctgttcttctgaatgagttggcatatttaaaatatgaagcccctcaggatacttcagctacttctgaagcaattttttcgaagcgacataatgtggctgttgcttactctttggttgagaagataataaaattaatatcaaatgttgaggaaaatggtggaaacctccttgatgaaggaacattaacaaaggtgattctccagcttaacgagacaattgctgttgtcctagagtatttggaagatgcaaaggaacatgggcaaaagaaaggggatgatttacttgcttcggtgcgaattattgggagctatcttgcagaagcacccttagcatgcaaggagaaggttcaagatcttttagggtatatgctttacattgaaggtgaagatgaacaaaggcccttctactctgtttgctttcttctacctttgctgtctcaaattactatgaagatcgagggatgcaaagctttggcttcatgcaaaggaattgaggctgttttagattgcttcaataaattagttgggtcaaatgcttttcttgaggataatggttgcatctttttggcgtgtgatacaatactgaacctactattgaagaaagacaaagtgcatacgatgttggatgagtcagctagtgttcgtcttcttaaagcattagcttattggacagataacactgatgaaatgtcaagtatgatgatggcttcaagcatttgtgcactggtatttgaatatacatcagaagaggctctcttgaatcgacctgatttcaactatagcactcttcgcagtctttatgtgctcattgctagatgtctgacttcatcagagcaggatactaaagaggatatggatcttttggagattgtctcttctggcttctctcgatgggctcatcggtacccccgtatccaagaagctgtcaagaactgattttgatcctcttaatctggattttaaacttcaaggtattctctgttgaaaagatgatgtgacaatacatgcaattggaagaagggttaccaatgagatgggatagggtcttcggatcacacggagaaatcagtgttaacttcatgaaaatccattggctaattgattattagagatagaaggtgatatgttaggctttgtatattttatttttcatatatatttgatttttcatatatgtttttcatatatgaaagtagttaactctagtcttaaatcatttgagctgtttcttcatgcaatttctagttaatttcaccatttttttcggatgaaaagataattttattct

SEQ ID NO: 198 - DNA, 1355 bp, Phaseolus vulgaris
gaacatagaaacacataattaaggagaatatctcaaatcgagataaagagagatataaaagaaaacaatggaagtatctcaggtactgtgcatgaacggtggcgttggagacgcaagctatgcaaacaactctcttgttcagcaaaaggtgattagtttgacaaagccaataagagaggaagccataactagcctctattgcagtaaactccccaaaagtttggcaattgcagatttgggttgctcttctggaccaaatactttgtttgttgtgtctgaactcatcgagactgtggagaagctttgccgacagctgaaccataaatctccagaatacaaggtgtttctgaatgatctccctgggaatgacttcaacaacatctttaagtccattgacagctttaaagagaaattgcaaaatgaaatggaaggtggtccatgctacttctctggggttcccggatctttctatggcagggttttcccaagtcgaagtttgcattttgtccactcctcttacagtcttcaatggctatctaaggttcctgagggtgtagacaacaacaagggaaatatctacctaggtagaacaagcccatcaagtgttgtgagagcttactatgaccaatttcaaagagatttcagtctttttctcaagtgtcgagcagaggaactagttgaaggaggtcgtatggctctgacatttttggggagaagacacgaggatccatgtagcaaggatggttgctacatttgggagcttatggcttcggctcttaatgatatggtttctcagggaatgataaaggaagagcaagtagatagttttaacatcccacaatacaccccatcaccatctgaagtgaaattggaagttcttaaagaaggatcattttctatcaatcgtctagaagtgtctgaagtgaactggaacgcttttgatgattggaacgctcttgagtttgaatctgaaaggtttgaatcagttggtgatggtggatacaatgttgcacagtgcatgagggctgtggcagaacctatgctggttagtcactttggtgaagacatcattgaagaggttttcacccgctaccaacaaatcttggctgatcgtatggccaaggagaaaactaagttcttcaatgttaccatacttttgactagaaaaacatgaacaacaactttgcgtctaaggagaaaattgagttcatcaatatcactgtatcattgactagaaaagaataagcaagaagtttgtatctgtatgtatggtttgctggtttggttttttggcaattatgtataactagcaaaaatattaagttggaatagaataaaattattgtgtttgttaa

SEQ ID NO: 199 - DNA, 1111 bp, Phaseolus vulgaris
ggcaaacgagggaggagaggaagcagagtgtgtcactgtaccccaatttcgtgtgttttttttgtgaagcatttggaaacacctatacactatgccttcagctcaagatccattctatgttgtgaaggaggagattcaagaatctattgataagctgcaatctacttttcgccaatgggaaaaagctgctgatgccggcgagcgatccaatctttcaaaggaagttcttactagctgtgaaagcattgattggcaggtagatgaattggacaaagcgatatctgtggcatctagagatccttctttgtatggcattgatgaagtggagcttgagaaccggaggaggtggaccagtgaagctcgtagccaggtgagcacagcaaagaaagcagtggaagcaggaaaacgctcaaatataacaaacaatgctagtctaaatgggatgcacagggaattaatgaggcttcctaattctcaccaaactgcgtctggccaatatcctacccaggataatgatgatttcatggaatcagaatcggacaggcagatgcttcttataaagagacaggatgaggagttggacgagcttactgtaagtatacaaagaattggaggtgttggacttactatacacgaagagctccttgcacaggagaagattgttgatgaactgggtaatgagatggacagtacatctaatcgtctagattttgtccaaaaaaaagtagcaatggtcatgaaaaaggctagcgcaaagggccagatcatgatgatcctgggtttgctggctctgttcattttcctctttatcttggtattcttcacctagtcattgagacgaaagctgtcaatgctcttgtttgtacatgaaaaaggatctaaagcttctgtgaagttacaagattattgggacatccaatatgtttagaaatctagtggaagcctctttggtttgttgaaggcagtgaaattttttatcatgatgaaaagggaagcaatgtgcttgaaaatattactagaggatttggtttcttgcagtatgactgctaatgtgatttaaatgagttgtattcgtttttaagatgatatgctcgagcatgcaatcatcagc

SEQ ID NO: 200 - DNA, 4431 bp, Phaseolus vulgaris
gttgtgtttgtttagcctttctctctctctctctctctctctttctctcactctgccttcctccttcaaccaccacctcttaaatattttcattccataaaacaccacaatttcccattttttcacctccatcgtttcaccttcggaatcgccatgtttgcttcctgaaacaattgattccgcacacaataggacccagggaatggtgaattacgatattttaattcttgattggtagcatgttttggctggaatttggataattgcttttcattgtcagaggtagaaggaaacaatacctggaaagtagatagatgtcttcttcttcttcttcaatggctgctcccagtgaaaagtggattgatcgtcttcagttctcctcattgttctggcctcccccgccagatggtcaacaaagaaaggatcaaattgctgcatatgttgaatacttcattcagtttacatcagaacaatttactgacgatattgctgagttgattcgtaaccgttatccgtccaaggagattcttctctttgatgatgttctggccacatttgtccttcatcatccagagcatggacatgccgttgtgcttccaattatttcatgtattattgatgggacactagtctatgataaggctagtcctccatttgcttctttcatatcttcagtctgcccaaaagttgagaatgaatactcagaacaatgggctctggcatgtggtgaaattttgcgtattttaactcattataatcgccctatttacaaaatagaaagacaatatggtgaaacagaaagaagcagtagtggcagtcatgccacaactagtgaacctattgatgggaaatctgtgcataattctttgacaaatcaggagaagaaacctataaggccattgtctccctggattactgatatattgttggcttcaccagtaggcattagaagtgactatttccggtggtgcagtggtgttatgggtaaatatgctgcaggagaactcaaacctccatcaactgcttcttctcgtggttctgggaagcatcctcaacttgtaccttcaactccaagatgggctgttgccaatggtgctggtgtaatattaagtgtttgtgatgatgaagttgctcgcaatgagactgctactttaacagcagctgctgttcctgcacttttgcttcctcctccaacaactgctcttgatgagcatctagttgctggattaccagctttggaaccatatgctcgtttatttcatagatattatgcaattgctactccaagtgctacacaaagacttcttcttggactcttagaagcacctccatcgtgggccccagatgcacttgatgccgctgtgcagcttgtggagcttcttcgagctgctgaagattatgcatctggcataaggcttcctagaaattggatgcatttgcatttcttgcgtgcaatagggactgcaatgtccatgagagctggcatagctgctgatgctgcagctgctctgcttttccgtatactttcacagcctgcattactttttcctcctcttagacacgttgatggagttgaagttcaacatgaacctttgggtggttatatttcttcctataaaaagcagatagaagttcctgcggctgaagcctccattgaagctactgcccaaggcattgcatcaatgctttgtgctcatggtccagaggttgaatggagaatttgcaccatctgggaagctgcttatggcctgattcctacaagttcctcggctgttgatcttccagaaattatagttgcaaccccactacaacctcccatactgtcatggaatttgtacatacccctacttaaggtcctggaatatcttcctcgtggaagcccatcagaggcatgtcttatgaaaatatttgctgctacagtggaagctattcttcaaaggacatttccacctgagtccactagagaacaaagcagaaagtctaaatacctgtctatcattggctctgcctctaaaaaccttgctgtggcagaacttcgtactatggttcattccctcttcttagaatcatgtgcatctgtagagcttgcttcacgcctactttttgttgttttaactgtctgtgttagtcatgaagctcaattcagtggaagcaagaggccaagaggtgaagataactatccagctgaggaaattattgaggacttacaaacatctgaaaaccagaaagaatcaaaaaataggaaaatgaagaagcaaggtcctgtagcagcatttgattcttatgttctggctgctgtttgtgctcttgcctgtgagcttcagttgttccccttgatttcacgagggagtaataatttagtttccaacaatgctcaagttatagccaagcctgctaaactgaatggatcttcccatagacagaatggatcttcccatattagacaaaatggatcttcccatattagacaaaatggatcttcccatgacttgcgaaatgggttagattctgcagtacgtcatactcacagaattttagcaattttagaggcactattttcattgaagccatcttctgtcggcactccttggagttacagctcaaatgagattgttgcagcagctatggttgctgctcatgtttctgaactgtttaggaggtccaaagcttgcatgcatgctttgtctgttttaattcgttgcaagtgggacaatgaaattcactccagggcatcatcattgtataatctcatagacattcacagcaaagctgttgcatctatagtgaacaaggcagagcctttagaagcaaccttaattcatgcacctatttggagggattcccgtatttattgtggtaataaaaggcagaatcagtgtgaaagtaactgctttgaccctgggcagacatctattataccttcagcagattcattcccgtcaaaacctgtccatacttctaagaaaaccccttgttcaaatgaagcagcaggttgtaccttgggtaaaggtgtctctggttttccattggatgcttctgatctagccaactttctcacaatggacaggcatataggattgaattgcaatgcacaaatttttctaagatccatgctggcagagaaacaagaattatgtttctctgtagtttcgcttctatggcacaagttgattgcttctcctgagactcaaccttgtgcagaaagcacttctgcccaacagggatggagacaggttgttgatgccttatgcaatgttgtatcagcctcaccaacaaaagcagctactgccgtcgttcttcaggcggagagggaattgcagccctggattgccaaggatgatgatttaggtcagaagatgtggagaatcaatcagcggattgtaaaattgattgtagaacttatgaggaatgatgaaagtgcagaatcattggtaattgtggcaagttcatcggatttactactgcgagccacagatgggatgctggttgatggagaagcttgcactttaccacagctggagttattggaagcgacagccagagcggttcagccagtgctcgagtttggagaatctggattggctgtggcagatggcctttcaaaccttttaaagtgtcgtctctcagctacaatcagatgtctttctcatccaagcgcccatgtccgagctctgagtatatcagttcttcgtgacattttgcatactggttcaatcagatataatcttaaacctcggagaataaatggcacccacaacccttcttatcaatacttcaattcggatgccattgactggcaagctgacatagaaaaatgcttgacttgggaagctcacagccgactttcaaccagactgcctattaactttcttgataccgctgccaaagagttaggctgtaatatttccatgtgaaatggaatcaaactctgcaaccatccatcatagtctgtgacatttttttactagacttgtagaaaaaaacacacattattgatgcttatggaactaacgtgtttacaaaaataagcaacatcattatgctagtcctgttaaaagagtcacagtcacaattctagtatgtttatagaaagctcattttgtatcatgcatgtattgtagttaaactaagttttcacctacaacttggtcgtgactctggtctcaatagaacagacttgtacagtaacgatagacgaggctgtaaccaggtcctttttcttcatcatcgtctcattttgtgttatgtttatattgatttagcttgtaatgaaagccagtttcaattgtttggagtagtgtctgttctagcgggcggaagatttttgtatttttactattttccaattgaacatatttcattgagtatatttgaaataggtctgattaagtggttttggattttcactttattgtagctacaaccaatctt

SEQ ID NO: 201 - DNA, 1250 bp, Phaseolus vulgaris
ttctgaaatattctattaggctttcatctcagacagagtgttgtgagaaatgatagatctaagcacactcaatcccgcacagattactgtgatgggatctgcgttttgtgttatgctttccatgcatttcacatcgcagttattgtctcagcatctcttctattggaagaatccaaaagagcaaaaggctatactcatcatcattcttatggctcccctttatgcaactgtctcctttgtgggtctcttggatattagaggaagcaaggagtttttcacctttttggagtcagttaaagaatgttatgaagctttggtcattgccaagtttctggctttgatgtatagttacttgaacatatcaatcagtggaaacgttgtgcccgatgaaattaaaggcagggaaattcatcactcttttcccatgacactttttcagcctcatactgttcacctgaactaccgcaatttgaagcttctaaaatattggacatggcaatttgttgttatccgtccagtatgttccattctgatgatttcattacagttacttgggctgtatccaacttggttgagctggacattcaccatcatcctcaacatatctgtgtcgttagccttgtattctctggtggtcttttaccatgtgtttgctaaagaactggcaccacacacacctctagcgaaattcttgtgtatcaaagggattgttttcttctgcttttggcagggaatgttgctggaggttttagcaaaatttggcgtcattcaatctcgtcatttgcggttagatgtggaacacattgaggaagcaatgcagaatattttggtatgtgtagagatggttgtcttttctgttcttcaacagtatgcttatcatcctgcaccatatagtggagaagttgagaaaatgcttagacaaaacaagaaaaatgactaactatgatagctaaaaacatcaggctacagatatgtatttaagagttctctattgtggcgcttgaaacatgaaacattgatgccaagtgtatttgttccttttttaaggttattttactgtacaaggctgcccatccactagctgtgtattgttttctttttagttgtaatttcccaaccatactaaaagagattagtttttattaatttgctatctaccatgatggccatttgctcgggatgatgtttgtttctgattactgtgttacagtcagagatactttcatggtctggatagagggaatagctta

SEQ ID NO: 202 - DNA, 2995 bp, Phaseolus vulgaris
cactgtatcagttttcgtggtcgggatggagcaaaacgaacccgtaaccctaaccctgaccgctgaagcagagctcaagaaagaccatgctatatcggatcccgacgagaagatggaggaaaaccaatccctaaccgcagaagatgagcgcgacaacgacaaagccgtgtctgattccgatgactctgattcagaggacgaagctcagcagaatctcctacttcaatctctccacaccgagcttgctgctaacccctctaattacgatgctcatttgcaatatataacgcttctgaggagaaccggtgatgttgataaactgacaagagccagggaagctatgagtgaactctttccattgagccctgcactgtggcaacaatggatcaaagatgagctttctctcatccctgcttctcggcccgaggctttctctagaattctgaagctttacgaacgaggagtgtttgattatctgtctatctctctttggtgtgactacattaattttgtccaagagtttgatccaatggtacgccaatgtacgcctactggtatttccaaggcgagggatctgtttgagactgcccttactgcagctggtttgcatgttgctgaaggcagtaaaatatgggaagcatacaggcaatatgagcagtctatacttttatccaccaatgatactgatgcacaggccaaagaaaaacaagttcaacgcattcgtagtttatttcaccgccagttgtctgttccccttgctgacatgagttcaacacttactgcctataaggcttgggaggcggaacagagaaatcttcaagatgttgaatctgttgacttggttgatatttatcctcatgttccatcttcataccagaaggccttggagatgtacaatgctcgtattcatcttgaagagtacattttgagcccgaatatttctgattcagaaagaatacaacactacatgaactatttgaaatttgagcaatcttttggaatgccagccagaattcaagttctatttgaacgagctattactgactttcctatatcacctgatttctggattgattatactcgctatttggacaacactttgaaggttggtaatattgtcaccaatgtttattctagggcaactaagaactgcccttgggttggagaactttggattcggtatatgctttccttggagcgtggtcatacttctgagaaagacttgtctgaaatctttgagaagtccctgcattgtaccttatcaactgttgatgagtatcttgatttgtttcttacccgggtagatggcttaaggcgaagaatggcatccagcagtcaagaggatttggaatataaaataattagagagacctttcagcgtgcatcggaatatctgtcaccacacttgaagaacacagagggtttactacacttatatgtgtattgggctcgtttagaaacaaaacttgggaaagatgtaattgcagctcggggagtttgggagaattgcctcaagatatgtggttcaatattggagacatggactggttatatagcaatggaagtggaattgggtaacataaatgaagcaaggtccatatacaagagatgctacagtaaaagactttctgggactggttcagaggatatatgccattcatggttacgctttgagagggaatttggcaagttggaagattttgatcatgcattacacaaggttacccctcggctggaagagcttaagttatttaggatacagcaggaatccaagtctggagaggaaagtgaaaagcatcttaagagaaatgctcgtgaaaagagaaagctggggtcagatataactgaagaacagtctccatcaaagcgacttagagaaattggaaatccgaagaaagcacccgaggagaacaattatcaacagcataacacttctcaggtgacaaaagtggaaggggtcaattggaagaataataaaactgacgataacccaagcgagcaacagtctaaccacgaaaagaacagggcatactctgaccagtgcaccgcgtttatatcaaatcttcatcctacggcaaattatgagcatattcgtaatttcttcagtgatgttggtggaattattgccattcgcatcctacatgacaaattcacaggaaaatcaaggggattagcatatgtggacttttcggatgatgaacaccttgctgctgcagtagccaagaacaagcaaaagttaattggaaagaagttaagtattgcgcggtctgaaccaaagcgaggtggaagggaatcttctaatcccaaaacattgacagaacatgcacacacctctaatcattctggtagaaaaggttccgtttccaatgaaactgatgatgcttacaaaggagatgtaaaggatgcaaagttctcttctagaaaaccaggaaatgataacatccagcttagagggaagaatacttttgccgtgcctagaaatgtcagaccacttggttttactgtaaataaaccaatatcagaagagggggatgaaaagccaaaatccaatgaagaattcagaaagatgttcattaggtaaggattttgtgcctctaatatgttactccgaagatggcggttatctttcaaaaataggcaaaagtggacatgatgcaagttatttggctccagagtatggttgtgttgtgatttgcatgattaattacatcagtctagtagattaaccttcaggtagtcttttactttttacaattgacacaatctgttttggttgcgactctgtatagtgtacgtacataaaattttcgcagtaatcgacccgccaaacagattatctttggctgccgcttttgtaccccaagatttttcctccaatccatttatttgaaattcattctttcttttttataacaatccagcatggaaaattatttaatctattgtaattacaaattgtgtaaatggttgcatttagattctacaaatcagtaaa

SEQ ID NO: 203 - DNA, 1027 bp, Phaseolus vulgaris
attctagaaaagagaaaaaaagaaggaacacaccaacactgcaaattcaactttaacatcgaaaattcagccgcagaacaaccatgaagaattccgaagtgtatcacgaaaggcaaaaattacagttctgtcttgttcattctctcaactccctctttcagcaaaaggatgctttcactcgagaaaaattgaatggaatttctgaaaggctcgcacttgaagattccagcacagaaacgtggacaccgttctctgttctattcaaaccccatcacaatgttttcactggaaactatgatataaatgttctaattgcggctttggaagagaaaggaaagagtgtggtgtggcatgatcgtagaaagggggcatcttgcattgatctcgatgcacctgttttgatggggattgtgatcaatgtgtcagtgactaggtttggtgggatttggaaaagtaggcactggattgcattgaggaagattgatggggtttggtttaacttggacagtgaccttcctgcccctctaccttttcatgatgcacataaagtaagggagttcttggattttacattggcacaaggaggggagattttgatcgtcttgaatgagaaacagtcttgaaaatttgaagttaatgcttcatttcgagtcaaatttgggcatccatgtgtacagtaccaaactgattgcatttcaatggagaatgtagcctcactcatcctcgtgtctctgaagatttttagtgagtttgttgtgaataatggttgaaactgcttctagaggatgttctcaataggagatagtgtgttgtctgtaatacacttgtctctagtttccatgtgtgtctgtacttcttttgaaccattaggcaatacatgtgtttttctttcttgaactgttgcatatacaaaatttactatgcaattgttatagcagaaagagactgttgtgtgcgatgtacttcagcattaccaaagatactataaaggaaactaagttggaaacatccattgaaatttgattca

SEQ ID NO: 204 - DNA, 1613 bp, Phaseolus vulgaris
agattgcaaatacatagaacactccagaagacaacaaacccaacactcacactcattgatccacttctccggctatgcataactccggcggaggcggcggaagcggcggcgtatgccacttggtggctatgccgttcccgggcagaggccacatcaaccccatgatgaacctgtgcaagatcctggcatcgagaagacccaaggagattctcataaccttcgtggtcaccgaggagtggctcggctttataggctccgatcccaagccggaagccattcgcttcgccgccatccccaacgtcgtccctaacgagcgccacaaagccgccaattttcccgctttctacgaagccgtcatgacaaacatggaagcgcccttcgatcggctcctcgatcggctcgagccgccgccgaccgcgattctaggctgcgttgagctgcgctggcccatcgcccttgcaaatcggaggaatattcccgtggctgcgttttggaccatgtcggcgtcgttttactccatgctgcatcaccttgatgtctttgcacaacaacggcgtttgaacgttgacaaagatacgctggatggagaagtagagaacattcctggaatttcttcggctcatttggcagaccttcgaactgtgcttcatgaaaatgatcaacgggtcctgcagcttgcattggaatgtatttcgaaggttcccaaagcaaattatcttttactcaccacagtccatgaattagaagctgaaacaattgaatccttaaaagctatatttccatttccaatatatcctattggccctgctataccatatttagaattaggagaaaacccttcttcagtgaacaatgatcataaccctgactatataaaatggctagattctcagcctcctgaatcggtattgtacatttctttgggcagtttcctttcagtgtctagtgctcaaatggatcaaattgttgaggcactaaacagtagcaacgttcgttatctttgggtggctagagcggatgcttcttggttgaaagacaagtgtggagataagggtgtggtggtgccatggtgtgaccaattgaaggtgttgtctcattcttccgtaggtggattctggagccattgtggatggaattccactcttgaagctctctttgctggtgtaccaatgctcacattccctcttttcttggatcaagttccaaatagcagccaaattgtagatgagtggaggaatgggtgtaaggtggaacaagagaagttggacattgaagagattgtggcaaaagaaaagatagaaaagctggttaagaggtttatagatcatgaaagccaagagggaaagcagatcagaggcagggcaagggaaatcagggccacgtgtctcaaagccattggcacaggtgggtcctcagatgggaaccttgatgcatttattagagacatttcctaaaactgatgcattcataagctttgagtgacagattaaaacgaacttatctttatgtacggataatcttaattgtcgttacctgactttccatagtggatttaattttgggcttggtacaatgtcaagaagttattcttattcacaagagtctaaaaatga

SEQ ID NO: 205 - DNA, 2771 bp, Phaseolus vulgaris
ttgatttcttcccttcctttttctttttccttgtagactctgctaagcatctttgcctcctcacttttccattcttttatctgccttcccaatccttcattcctcttggaatttcttcttttctctatcagattaccttggtttcagttctattcctaacatgccattatatattgctaccccttctcccctaaattgctacttctttaggtgaattcttgcaggttttcattttctcactcacaaaagactgcttccttttgtctattttttctcaatattttaccctcccaatttcagaccatcctctctcaattagaaatctgcatgccctgatctcctttcagggtcccattgttcaccccagaaaaggccagaaaacaaaatccagttttggaacttcccctgatctaaaaatctgaactttctggtaatttttactagtgttttgaattctgcttctgggtttttgtttccatggggctgtgtcatggaaaacccgttgaaacctcacaaagtgaaggtgggcaccacgttttccccggcgggaaagaggtagtggtggcaccgagtcccaaaatcgctacaaaaggttcaaagtttccgttttacagtccaagcccgttgccgagcctgttcaagaactcgccggcgaactcgagtgtgagttcgacacctctgcggctcttcaagcggccctttccgcctccgtcgccggcgaagcacattcgcgccttactggcccgccgccatggctccgtcaagcccaatgaggcctccatccccgaagggagtgagtgcgaggttgggctcgacaagagcttcggcttctccaaccacttccacgctcactatgagcttggtcccgaagtgggccgtggccactttggctacacttgctctgccaagggaagaaaaggcaccttcaagggtcatgatgttgctgtcaaagtcattccaaagtccaagatgacaacagcaattgctatagaggatgtaaggagagaagtaaagatattgcgagctttgactgggcacaagaatctggtgcaattctatgaagcctatgaagacaatgataatgtttatatagttatggagttatgcaaaggaggtgaactgctagataagattctttccaggggtggaaagtactcagaagaagatgccagaattgttatgattcagatattaagtgtggtagctttctgtcatctgcagggtgttgttcaccgtgatctcaagccagagaattttctctatatttctacggaggaaaattccactctgaaggtcattgattttggactttctgactatgtgaagccagatgaaaggttgaatgatattgttggaagtgcatattatgtagctccagaagttttgcatagatcttatgggacagaagcagatatgtggagcattggtgtaattgcttatattcttttatgtggaagccgacccttttgggcaaggacagaatctggcatatttcgggctgtcctgaaggctgatccaagttttgatgaagctccttggccatctttatcagctgatgcagtagattttgtaaagagactgttgaataaagattatcggaaaaggctaactgcagctcaggctctcagtcatccatggctgacgagtcattgtgatgatgtgaagataccttttgatatgataatccacaagcttgttaaagcttatatatgctcatcttcattacgcaaatcggcattaggggctcttgcaaaaacattaacattagtgcagctagcatatctgagagaacaattcaacatgttagggccaaacaaaagtgggttaatctccatgcagaacttcaagacgggtattttaagaagtgtcaccgatgcctcaaaggattcaagggtcttagattatgtgaacatggttagttcaatccaatatcgtaaattagattttgaggaattttgtgctgctgctataagtgtccatcaactagagggaatggagagctgggagcaacatgcaaggcgtgcctatgagttgtttgaaaaggaaggaaataggccaattatgattgaagagcttgcctcggaacttggtcttagcccttcagtaccaattcatgtggtactccaagattggataagacactcagatgggaagcttagcttcttggggtttgttagactcctgcatggggtttcttctcgcacatttcagaaggcttgagagaaaacacacttgattgctattacttttttgtcacccttattgatcataaaccttttgaatgcatactccaacagcagcaggtttcttcatcttggttgcacacatggcttgagcaaaggcaaaagctatatctagaagggtggtgatatgcaacatctccctttgttaagttcctcctgatgcgttctagaaacacacaacactttgctccatccttgtagtccttcagattgattggtggtgctggagttaaggcttgtacagatgaaagtagagcacaggttgtacttagaaagtagtggaacttccataaagtgagttgtgttttggggtttatccgtctgtgtacccacccatcacacttgtcaataagctatttttacttatctgaactgctttttatttttacatctttttttcttctcaaaacaggaaaaccacatacattattgaagttgattaaaaaatggtaactttttgaatcttatattctatttaatgacgttttagattttaataaattttttcttatattcaagtatctatta

SEQ ID NO: 206 - DNA, 1424 bp, Phaseolus vulgaris
aaatagtaaatcgaggtaccctttttatgataaactttccttccatttttgttcctttagtgggtctagtatttccggcaattgcaatggcttctttatttcttcatgttcaaaaaaacaagattttttagatacggcggtcagtagggaaaaagattctagatatttttttgagaactggaagcaatttgatgaagtctccctaaagatttacatttaagtagcgccagttgatgaaaatgactttagaaacaagtcaaaaagaaacaaagaaaaacaaagtcaaattctggggttttttattccacaattctaattcttaataataaaaagaggaggtaatgagtatattgaaaaaacgatcaaaagaagtactgatatattctataacagagtcaaaaataagcaatatcttttcagccttgatcatttttttaggttcattggggttattgttggttgcaatttccagttatctcggtatggatcttttccttttttctgaggaaattagtaatttcccatttattccacaaggggccacgatggctttttatggaattgggggtctctttattagtttttatttgtggtggattcttttgtggaatataggtggtggttttgatatcttcgataaaaaaaataaaaaagtatgttttattcgttggggatttcctggaaaaaatcgtcgtattattctcaaaatacctatgaacgagattcaatctatcagaataatagcaggagttcaagaacgaggtattttgactcgtacccttacttatgagagtatcgtttatatggaaacaatagaacaggggtttattaccttgactcgtattgaagataatttgactccgccagaaattgcaaataaagctggcgaattagctttttttttaggtgtaccacttctgtattgatgagaattggactgaactagaaagaaacttgcacaaaaagtttcagaattgtcctatttatttggtgtaccgattgaaatattttgaaaaaaaagttttttttcaaaatatttcaatttttaaagatgggacgttatttgatttcgaaatctgaatattatagtcataactcgaagtgctccttggtgtatttctaaaaaggaatccttttttcttcgaatagtagcaattaatatccttttcctttcgaaacaatatttttttcttcattggaattgactgtgaattctttcgatttcttattcgatttatgtattcttttttctaaattaaacaaggcaaagactaactcccgaagtttaaataaaaaaaaatgataaaatacaatctagatttatctataagctctataacttgtaatgaagtttatacttgatagaaaggttattatcatatagagtttgacgaatgagatgaaattgagttcattaaagacga

SEQ ID NO: 207 - DNA, 1537 bp, Phaseolus vulgaris
gtcccatgtgacttctgcccccaacatattacccaataagcttggacaagttagggataagtataagccgtaaaagaaatgggtctaattccttcagaaaccacaccttcccacgttcttcttttcccgttcatgtctaaaggccacaccataccccttctccacttcgcgcatctcctccaccgtcgttccatatccgtcaccgtcgtcacaacccccgccaaccaccctttcatcacggattccctaaagggaaccgccgcctccgtggtcacgctttccttccccaccatcacaaacatccccgttggagttgagagcacggacaagcttccctccatgtccctcttctacgagttcgtcactgccacgtcagcaatgcaaccgcagttcgaacaactcctccagacccttccacgcgtaaacttcatggtcaccgacggcttcctctggtggaccctagactcggccactgcgtttggaatccccaggtttgtctactacggcatgaattgctatattaaagccgttttaattgaagcaatgagaaacgggattcttaagggctcccaacccgacaacgagttagtcgagttgactcggttcccgtggatccgagtctgcaaagaagattttgaccccaccttcagaaaccctcaccccagtggtgttgaatacacgttcaccatgaattcgatatcatcctcacaacgcagtcatggcatgttggttaatagcttctacgagcttgagtctacctttgttgattacgtgaacgcggattcctctcctaaaagttggtgcattggccctctctgtttggttaaatggacaccgaaggtttactctgatgaaggtctgaaacccaggtgggtgacgtggttggaccacaagcttgaagagaagtgtcgtgttctgtacgtggcgtttgggtcgcaagctgagatttcatctgagcaactggaagagatagcattagggttggaagaatcggaggtgagtttcctgtgggtgatgagaaaggaggagtggggtgttcctgatgggtttgaagaaagagtgaagggaagagggatggtggtgagagagtgggtggatcagatagagattctgatgcatgggagtgtggaagggtttgtgagccactgtgggtggaactcggttctggagagcgtgtgcgctggggttcctattctggcatggccaatgatggcagagcagtatttgaatgcgagaatggtggaagaggaggtgaaggtggggttgagggtggaaacatgtgatggttcagtgagagggtatgtgaaaagggaagggctgaagaaagcggtgatggagatgatggaaggggagaaggggagaaaagcaagagaaaaagtgagggaattggcggagatggccaaattggctacgcaagagggtggttcatcgtcgtcgacgttagagtcacttcttaatcaggcatgagcttgtcataaagactggcttaaaaatattattatattattataaattgttgttaaaggtatgtttttat

SEQ ID NO: 208 - DNA, 2000 bp, Phaseolus vulgaris
gcaccaaattcatatttctctcccttttcttcccaagctgttcatttgtgtttgttttactagtttcagctgaactcaatccaatcttactgcaaaaaattgctttattaacagtcacagaagtttgtcaatttttgttgtagtgtgttggtttccttgatggcagatcagaagaatgagaacccaaatcggggaagtgttaatgttgaatcagcaaaaggaaggaacaaacttccaaactttctgctatctgtgaggctgaagtatgtgaagcttgggtaccattacgtgatctccaatgctatgtaccttatgctcatacccctttttggcatagcctctactcatctaacaaccctttccatcaaggactttctccaactgtgggagaatctcaagttcaaccttgtctcagtcacagtgtgttccagcctcatggtgttccttgctaccctttacttcatgacccgtcccaggggcgtgtatttggtggattttgcatgctacaagcctcacgtggactgcacgtgcacaagggagacttttgtggagaagtctggtctgacagggtcgttctcggaggagaacttgtcctttcagaagaagattctggagaggtctggtttgggacagaagacttatctgcctccagcagtgttgagtttgccaccaaacccttgcatggctgaggctaggaaggaggctgaggaagtgatgtttggagccattgaccagctgctggcaaagactggtgtgaaggccaaggatattgggattctggtggtgaattgcagcttgttcaatcccacaccatctctctctgccatgattgtgaatcactacaagctcagagggaatgtcctcagttataatcttggtggcatgggttgcagtgctggccttatctccattgaccttgccaaacagctcctccaggttcatccgaactcttacgccttggtagtgagcatggagaacatcactctgaactggtactttggcaacaaccgatcaatgctggtgtcaaactgtctgttcagaatgggaggagcggcgatcctcctctcgaaccgctccggcgaccgccggcgggcgaaataccagctagtccacacagtgcgcacacacaagggagcagaggacaagtcgtacgggtgtgtgttccaagaagaggatgagacaaagagagttggtgtggccctctcaaaggacttgatggcagtggcaggagaggccctaaagacgaacatcacaacactaggacccctagtccttcccatgtcagaacagctccttttctttgggaccttggtggctaggaaagtgttgaagatgaagataaagccctacatacctgatttcaagttggcatttgagcacttttgcatccatgctggagggagggcagtgttggatgagctggagaagaaccttgagctaagtgagtggcacatggaaccttctagaatgaccctacacaggtttggaaacacttccagcagttccttgtggtatgagttggcctacactgaagggaagggaaggatcaaaaagggtgacaggacttggcagattgcatttggatcaggattcaagtgcaacagtgctgtttggagggctctcagaaccatcaatccagcaaaggagaagaatccttggatggatgagattcatcactttcctgttcatgtgcctaaagtggcaccaattgcttcctaaatcaaatcacacccttttctttttcttttcaaaaataatatattcacaatttggtccaatatacaacctttgatgatatgaaaaaaacacatttcatgagactaaaaataatgaggttgtatattagatgaagttgtcaatatatatatttttttttcatttttattatttttgggaaagctaagggttcaaattcaagaaacttttcttaataacactaaattaaaccctaaaccctttaatttattattcttgaggaagctgagggtctaaattaaaga

SEQ ID NO: 209 - DNA, 1826 bp, Phaseolus vulgaris
gttgattttggagaagaaaaaatgttgaagaaagtgtgagaaaatggtagtagtcacccctccaacagcgtctaacaaatggacacagttatcttctcttgcatctcagatagatgatcgcaaggcctctatgggaagagtcatggaaaaaccaacccaagatcttcttcagcagcagcaacaagccctcaagtgccctcgctgcgactcttcaaacaccaagttctgctactacaacaactacagtttgtcacagcctaggcacttctgcaaagcctgcaagcgatactggaccagaggtggaactctcagaaacgttcccgttggtggtggttgcagaaaaaacaagcgtgtcaaacgtccaaacggtgacgcttctgctaactcccccccttcttcctccactcctagctccaattcaaaccctccttcacggccccacatcccttctagttcaaccgcaaaccatgtcaatgtaaaccctttgttttatgggctacccaatagtaacggttgtgatgtcatggatgttcctttcccaaggtttaatcttcagtctcagctgaatgcccttgggttaggtttttcgtccggggttaacgttatctcaagtgaacctagtgataatgggtttagtactactactactacttcaaatactaacaactttctttcggcttataattccatatttggttcttcttcctcctcaacttgtgcaccctcaactcctgttatggcttccttgctgagttctactctcctgcagcagaagtttatcggtggtgctggggtgaagggtcatcatgatggcaatggtttccagggttttgcaccgcttcaagggttgcaaatggaagggagtaataatattagctcaaaagaagtgaaagctgaaggaccaaacaggttggagttggagtggagtaataataacaataacaatggtggtggtggtgcttgtcaaaaccagatggagcatgtgggcttgtctgatcctaattcactttattggaacactgcaacaggtttgagtgcttggagtgatcaacctaactttggtccttcagtcacgtctctgatctagaaagatgaagcatcgttttcaaagctatatatgaaatctctctccctcgtttaattaagggcatgtttttgttctttaggcttagttttgctacttttcttttggggtcaaagttggttggatttactacttacaccgaaaagaaaaaaaataaaaaaagaagatacttgagatgagaggagtttgggatcggagtgatcatgtcagctgcaagaatgctactacacttcagcctgttagttttatgtgtcaaggttgagaattggttaattgcgctgagaggaacctcggatcctcttctctcatcatagtctctgcacactgttttgtttcctgtggagatcaaaagaagatcctctggtgcaagttctccacagttgagtaagttggtccttttcatgaatgtatatacgatgcaatgacatgtcttcttttttccttttctactttctgatgtattgtgattagttagacgaggtggggtttaattactttgtataatatgatgctgagatattggtttcattttcgttaactttctcaacatttgtttaggaatatggcaagtggagagaagtagggtaattattattcggggtataatgatggtataggagagaggaagattaagtacttggatggggtgattaatgtatgtggggttggtttgggtcatgtactgtttggttttgtggttcatctctattggtaattcaagatagtttggtcctcaaaaaaa

SEQ ID NO: 210 - DNA, 702 bp, Phaseolus vulgaris
accatagcaatagaagtgacggtggtgacataagaaaacaagagaaagcagaaagaggatgggaagagtctttgtgatggagcttgagggaaggtcttatagatgcaagttttgtagaactcacttggcccttgcagatgatctcatttcaaggtcgtttcattgccggaggggaaaagcatacctattcaataacgttgtcaacttcacacttggaacaccagaagaaaggatgatgctttcaggattacatactgtggcagatatcttttgctgtagctgtggtcaaattattggctggaaatacgaatctgcacacgagaagagtcaaaagtataaagaagggaagtttgttcttgaaagaggaaggatagttgatgaagttgatttctctactgaattctacatcgacagtcgtggctgcatgagtgatggtgatgaggcttaaacatgtgctgctggacttgttggatcagaagaaaaaatacactacttctgtatatgatcaacaataaaggtgacccttgaaaaatgttcaaaactagtgaggtttattttgttttttatttacatgtggtatatatatgagaacgagagttgtgttatatgagaatgagagttgttaatggtgtgtaaattgtggagaaagaaaaagatgaaacgtggtagtctctgtgcaaaatacttggaaagaacttggct

SEQ ID NO: 211 - DNA, 1346 bp, Phaseolus vulgaris
aggaaagagatggaggacgccgtggcagttattccgggattcatgtcttgcacgtgcgatcacgtcggcggctgtaccgctcccggctccagatcctccggcgagatcgctcccgttcatttcttcggcgtttacgacggccatggtggctcacaggtggctaagttctgtgctaagcggatgcacgatgttatagcagaggagtggaaccgagaaatggcagatggagctgagtggcagagaagatgggaaaccgtatttgctaacagttttgagaggactgacaatgaaatcctatcagacgcagttgcacctgaaatggtaggatctactgcctctgtggttgttctatctggttgccaaattattgcatccaactgcggcgactcaagggtagttctctgccgcaggacacaaactatccccttgtcagtggatcaaaagccggatagacaagatgaattcttgagaattgaaggagaaggaggaaaagtcataaactggaatggagctagggtgtttggtgttcttgccatgtccagggccataggtgatcggtacttgagaccatggattattccggtgcccgagataactttcacagcaagaacagacgaggatgagtgcttagttttggcaagtgatggactctgggatgtaatgagcaatgaagaggttggagaagtggcacgccacattcttagaagacgccgcagatccttgtcaggggaggaaacatctcctgcacaagttgttgccgacagcctgactgaaattgcatatggtagaaatagtaaagataacatttcaatcatagttgttgatctgaaatccaagagaaaacgtcagcaaaggcctcctttaatttcctaagaatctaattctctttaatctttttcaatcttgaattgaaaaggagaaagagacggtaatgaagttgtagagttgatctataaacaaacctttttttttctatttttcatacgaccccattggtacttggtatcacttcaccttgtatctcctaaccttctgtacagagttgattgggaaaaaagaaactgcttcgtgacgagagacaactacctagggctggcttgttgtaatgaagtatatcgttcagtaagtactactttttcttctccatttggtcttcattcctgaacggttatgttgataacacaatcaaatgccatcaattgtattgtttgaatttcttttattggaaggaatggaataaagatgatgaactttattccatttcattgcattcaatatttgaaaatatttcctttattttatttgaaaatataggatgaaattagacctacgaagtaataactctt

SEQ ID NO: 212 - DNA, 1349 bp, Phaseolus vulgaris
accgaaactgaaaagcactgtttggatgatgagaataggaaaaaaacattttgtttgtggaacgaagagggagagaagaagatgaagaagcagcagacgcagaaaagcgagttcgagttctgcaaagcgtgcggcataaaccacgaccaaggtctccgccacaagtacttccctaaccacaagaaatccctctccaccttcctatctcgcttccgtaaaaaactctccgatgttcgctttttcctcaacgcccctatccctctcaatccccaactggcttctcgcaatcgcttctggtgtgtcttctgcgaccaagacatccacgaacactccagttcctttgcctgcgccaatgcgattcgccacctcgccagtgccctacacctgaagaatttgaagcacttcttctggaaatacggtgctgcggcggatcaattggacgcgtttatgttttccgatgatgatgtgaccaagtgggagaagaagtgcgtggcgcgaaaggatgaagcgaatgagggaagtcgcagaacggtggttggtccttcaagtgatgatcatatccataatcaactcaccagtggaaatagtaatagttttgaaacaaatgtttattcccattctgtgaagtcgtatccttcaaatcctgttttacctttaccaaactatacaaatgagtatcagatatctagttcaggactctctggaatcgccaatgttgctacctcgtcggaagcgcgccctgatgcaaaacctattgtttttcaagattttttgggtgtacaattgatcactcagatttcttctatgcctattgaaagtgctgagaaaaaagtttattctgaagcacctccaccatggattgacacaactgaggcagttcagatgcattctagttcaaacaagttagggaagtccaaaatgttgaatccaaatcgggtgggagcagcttgggttgaaaagagaaagattgaaatggagaaggagaaaaggggagagacgataaggaatggtcgtgatgccagctggcttcctaattttggtagagtctggcaatctggtagcagaagagaatccagaaaagaatttgagagggagaaacagttgcagaagttaaatgttgaaacagagtctgagatggcaatcaaaattcagccttatgtaagcaaaagaatgcggatggatagtgtaggtgataatgcaagcggatgaaatttcttgtcgcagtgatgtttttggggagtgtaatcaatataataaatatgcatactaacatctattgcattggaggggagaagactggaaaaagttcacataacgaaatgtcacgtttatgtcaatcctggaaaaaa

SEQ ID NO: 213 - DNA, 583 bp, Phaseolus vulgaris
ggcagtgtgaaatagagaatcagtttaactcagagagaaagagagataatggagggtgttgtgaagtttgcatgccttgttgggtttgtggtggtggtgagtattgcaggggtggatagtgctggggaatgtgggaaatcgactaccccagataatgaggcttttaagcttgctccatgttcctcagcagcacaagatgagaatgctagtgtttctcaaagttgctgcgcacaggtgaagaaaatagggcagaatcctagctgcctctgtgcagttctgctatctaacacagccaaaatggctggagtcaaccctcagattgctgtcaccatccccaagcgttgcaacctcgctaatcgccctgttggttacaagtgtggaccttacacacttccttaaaagagtgaaggttgtcacggaaatgaaagatgacagggcgtacatagagtatgggtgttagctgctacaaaattccatgtttgttgtattgtaactttgcagtgaataagacgaagcagctcactgtatgaataaaatatgtactttcggtgtttcctttcatgtgcccatttaactctttttt

SEQ ID NO: 214 - DNA, 2297 bp, Phaseolus vulgaris
agtaaccccgatgcaacaataatattaaaacgatgccactttcataattaacacaaaacccaaacaataacacgatgtggcgaaggagcttcagcagcagcacccccaccgccaccgccactctcaagggcaagaaatgggacgcgctgataatcggcggtggccacaacggcctcacagcggcggcttacctcgcgcgcggaggcctgtcagtggcagtcctggagcgccgccacgtgatcggaggcgccgccgtgacagaggagcttattccggggttcaagttttcgcggtgcagttacctccaaagccttttgagaccgtccgttataaaggagctggagttggggaagcacggcttgaagcttctgaagcgcaatccgtcgtcattcacgccctgcctcgacggacgctaccttctattaggacccgataagcagctcaaccactctgagatatccaaattctcgctcgcagatgctgaggcttatccaagatacgagagtcagcttgagaacttctgtaagttcatggatctagtgctggattcgcctccacctgaatctgtgcagcataaattgtctattaatgaaaagttgaagaataaaatacagaattcagtattttgggcgagttgtctgcggcatgtgtcttccatgggacaaaaggatatggtggacttcatggaccttctgttgtccccagcttctaaagtgttgaataactggtttgaggcagatgttctgaaggcaacccttgcaactgatgctgtgataggcagtacggccagtgtccacaccccaggaagtggctatgttctgctacatcatgtgatgggagaaactgatggggaacgtgggatttggtcatatgttgaaggtggaatgggctcaatatccaaggctattggtaatgctgctattgaagctggagcgcatgttgtaaccaatgctgaggtgtctcggttgttgattgaaaattctagcactgtctgtggggtgactctggctgatggtactgaagtgcattcttcaattgttttgtccaatgcaactccatataaaactttcatggaattagtgcctgacgatgtactccccaatgattttgtccgtgccattaagcactctgactacagttctgccactacaaaaataaatgtagctgttgataaattgcctgaatttcgctgttgcaagttggatcatcctcatgctggtccacagcacgtcggcacaattcatataggttcagaaagcatggaggagattcactccgcttgtcaagatgcagcaagtggaacaccatcgagaagaccggttattgagatgacaattccctccgtactggacaaaactatttctccacctggtaagcatgtaatcaacctgtttgtgcagtacacaccctacaaaccattggatggtgactggcaagatcacaaatacagagaatcgtttgcacaaaaatgcttcacgttgattgatgaatatgctcctggcttcagcacatcagtcatcggttatgacatgctgactccaccagaccttgaaagggtaatcggtttgacaggagggaatatattccatggggctatggggttggattcccttttcctcatgcgacctgcaaaggggtggtcaaactacaagactccgcttcaagggttatacttgtgcggaagtggagcacatcctggtggtggagttatgggagcacctggacgtaacgctgctcgtttagctcttcaagatattagagaaagaacttaaggggtgatagtgatactcaattatgactcgtccacattgttacttctgcaaactggcttggaaaaggatggctcttctgttggaattatatgcagtaactactgcaaagtttgcaacgcattagatataagaatgaagacaattatttatcaaattggatgaactgcataacaacgatgcagaagctataacatggatttcagaaaactagaacttgtgattctttaagatgatttttgacatctgtttcaatgcattgattccagtatcttgacacggttgataaagaaagtatttataagagctaaacacttcaagtcaatttaaatcaaacagattaactgaaattgagattcgttgggaacaataagtacacaacagtttgtttgatcaacattgggtaaggaatcaatcacaaatacaaacacaccaattgactaagcaatccgtgttagatcaatcgacacaagctttcatggtgaactcaactgtaattctggatgtcagtcgttgtatcagttagga

SEQ ID NO: 215 - DNA, 808 bp, Phaseolus vulgaris
acaccaaaccaaccatagtccaagccttatcttcattcttctttccaaattggcatggcttccacaatgttcacatatccttctcttcatcttcacatctactcacataaaacatcaaatccatcagagtattccattcacagtcaacccagaaagaacttttccattagatgcacatctctggagtccactcctcctgagggtgagtttctaaccccagaccctaccttcagcacagtgaacagtgaagagtcttttcccattgagaagagaaggaggtcagagatagtgagggagagaaggggaaagaaacttgtgcagcctgagcctccaaactttgaaattggatggaagaggaccaaagaaataaaccaagaggtgccagtagggtatgtcatagctgacttcttggagaagctagagaccctcatggagaaggagtttggatcaacagaactgctggcaaaggtgggggaaattgtggctgagagagcaagagaagaggcagaggttctgatggatgaagggaaagtggaggagagaatggtgacagaactgtttagagtgttgaagttgatggagatggatttggctatggtgaaggctgctgtcaaggaagagacattgggagagaggcttgagctggccaaggcaaggtgcaggcaagccatacttgttgcttattccttttgaactctttcatggggattctgtcacattggacagatacacaatgtcatagtgctgaagaacttgaaacaactgatatatacacaatgtcatattctgtgacatttggattactaaa

SEQ ID NO: 216 - DNA, 849 bp, Phaseolus vulgaris
acagaaccattctgttctctgttcaaacagagttcacacattgcattcacttcccctgtctcctttgtatccatgcttccaactgcagaagcttcttcactgttgtctgcaacatcacatacatattttattgccatagacaaatttttattcccttttgagtgaagcacatagcacgagttgttgttgttgtttgtttctgcatcaacccttcaagcaatggactccttcagtttcaataacctccaagcagagaaagccaacgccatcctcaaacaccgcaagcttcgaagggtggcgagcttgttacgtatcatcgaagtgtgtgcggttttggtcttggtttcaaggttctccatgcagctcccagttgcagtgagaaactctggcgagtacttcagagacttgtcactcttcatgaacagtcctcgctttgttttcctcattggaaacatcataatcatcgcactcttcgcccagttctccgctcagggcaacaacgttgttcaggagcctaatctctaccaagagttaattcaaaacacaacgaaaaaccaagaaacagttgtggcagagtatagcagaaagaaacagaggatgaaaacaggggaagcgaaaattagtttggaaaagggttatagaaggtgtgagagggagaaacgacgtggtgtgatgcgtaggtgtgagagtgagagtgaaaagggaaggaagaagattgagggtgttgctgtagaagaagtggcgcggcctgaagatgggatgagcaacgaggagtttcgccgcactgtggaggctttcattgctagggaacagaggattcgaagagaagaagattattatttactgtaa

SEQ ID NO: 217 - DNA, 1504 bp, Phaseolus vulgaris
tattacttaggcacaatattttaatatgtaacgtcataaaggtctaaattccactataaatagaacatggctgagagggttgagatatagagtaagcagtgtgtagtgaaaactgaaggtgtagattctgtttccatgcctcctgttcctatttctcctgtcaaagttgggcacattgatgatgtccaagagctaagaaaaactaagccaaggacaattcctcaaagatttgtacgagacatgacagaaagaccaacactttctactacacctctccccccatcaaatactcacatgcctgtcattgatttctctaagtttaccaatggaaacaaagaggaagttcttagtgaaattttcaatcttgcaactgcttgtgaagagtggggattttttcaggtaattaatcatgagattgatctcaatctggtagagagaatagagaacctgagcagggagtttttcatgctacctttggaagagaaacagaaataccctatggctcctggtactgttcaagggtatggacaagcttttgttttctcagaggaccagaagttggactggtgcaacatgtttgctcttggacttgaacctgaatatgttaggaacccaaatctatggccaaaaagaccagaaagattcagtgaaacggtggaggagtactcaggaaaaataaggaaactgtgctataatctgttaaagtatatagctctaggcctggatttgaaaggggatgtgtttgagaagatgtttggtgtatcagtgcaagctataaggatgaactactaccctccatgctccagacctgacctggttttgggtctgagtccccattcagatggaagtgccctcactgtgctgcagcaagcaaagggaggcccagtgggacttcagatactcaaagacaatacatgggttcctattcagccaattccaaatgctcttgtcattaacattggagacacaatagaagttcttacaaatggaaaatacaggagtgtggagcatagagcagtggctcatgaggagaaagatagactctcaattgtgacattttttgctcctagctatgatgtggagcttggtccaatgccagaatttgtggatgaaaaccacccatgcaagtatagaacatacaatcatggagagtacagtaaacactatgtaaccaacaagttacaagggaaaaagacactggactttgccaagatccaaaccaaaaacacaaactaggatggtccccaactagctaggagtactataattagactgactatgtgtgtgtatataattgtgttccacataaaagtgcatcatggtcaaatctctcaattctatttctgttgaaaaataggcaaaggaattagttggggtgatgtaggagagtgtgaatgtgggtcacatacacaagactcagtgtttcttattctaaatatgcatatgctatgctttcaatggaaaattatagtgacatcttattttataaagctttattgcccaa

SEQ ID NO: 218 - DNA, 2480 bp, Phaseolus vulgaris
gtctctggttaacaataatggttgtttgattaattttgaacacacagttacagtgacagcgtgctgatggtctctattggttcaaaagcattggtctcaagaagctcaatgggggaccacgattctgaatcccccaagcaagccaaaagtaagaggagaaagcataagaaaggaggagccgctcatgaattcgattccaatcccaaacacacaaactcaaactcaaactccaactccaacaccttcacttcccctcctcaactctcccgtgttaggaaacagcttgaccctgaaacaacccaatacttctcagaaattgctaatctttttgaaactgagggggtggaattggaggaacgatcacttatatgtgctaatgctctccaagaaactaaggggaaagaattcgaaatagcgtcggattatattgttagccacactttggagaccattctccagggttgtgatgtagaccacctttgtgatttccttcactcttctgctaacgacttcccctatattgcaatggatagatctggttctcatgtcgctgagaccgccatcaagtctctagccgttcatctccaacatgatgaggctcgccctctggttgaggaggctttaaccgtcatatgcaaggtgattgcagcaaattctgttgatgtaatgtgtaactgctatggttctcatgtgcttcggactcttctctgcctttgtagaggagtaccattagacaagtctgcatactatttatcaaaatcgactaccctgttagcagagcggttgaattcaaaggagttttcaaagaaagatgatgaaacaaattttgagcccggatttccaaatttacttaaagtacttgtgtctgatatgttaaagcatgctaaaaaacgtatcaagacactacaagttgaccaattcagtagtttggtttttcagacagtgctgagggtcttggcaggtgatgatgaagagttgctacatgtgattcctttccttcttggctgcaaggataagtataatgcagaggaaagttttataaacacgaaagtagtagcagatctcaagaatttgttaaaagaatctaaatttagccatctaatggaggtcattttggaagtgtcccctgaggcgttgttcaatgaattattcactaaagtattcaggagttccttgtttgagttatcatctcatcaacatgggaactttgttgtccaagcattaatttcttattcaagcaatcaagatctgatggagttgatatgggaagaacttgggccaaatttggaggatcttttcaaaatgggaaggtcaggggttattgcttcacttgttgctgccagtgaaaggcttcatgttaatgaacgcaagtgctgtcaagtccttgctgatgcagtatgtccaccagatgattctccgaaagggattgttccacgactcatgtttcttgacagctgtttctcatacgaagacaagtccaactggagctggcaaagtggtgctagaatgaatgtcatgggttctctgatcttacagacagtattccggtttagaagtgaatatatacaaccttatatcacaagtataacttccatggaggcaactcatgtacttgaagcagtgggagattcaagaggatcacatgttattgaggcttttctttgttcaggagcttctgggaaacagaagcgcagattggttatcaaactgaaagggcattttggggaggtcgcactcaactcatctggtgcttttaccattgataagtgcttcactgccagtaatctgtcactaagagaggctatagtgtctgaggtgttggctgtgcgaagtgatctttccaagacaaagcagggctcttacctaataaggaaactagatattgacggatttgctgcgaatcctgatcattggaggtcaaaacaagtatccaaagaatctacttataatgatttttacactatgtttggttccaatgatacaaagttgacgaaaaatgattcctttctgagtgacaccttgaataataaatctaatccaaaagctgtaaaggaaatgaggaaagaaattgaccaatctctaggttctggtgcatctttcttgagcttccaaaagaacccaaaaaaagaaaagcacaaaagtaagaaaaatgcttataatagtggagacgatgatgagtcgtctaataggaagaagaggtctaaaaaggaaaaggttgaaagtgggtttgatactgctgctactgcagcaaccgggaagacattgaagaaacgacgaagagatgacctttccgaggcttcccagaagaaagtgaaggcatagagttaaagacaattttccccctcaaagacgaagttattttaaagggaatggtgttaagcaggtctgcatggcccccatgatttaacgcttgaagatttgtatgatttcctctttgctagtaattttgtatcattttactatgtcacagactatgttac

SEQ ID NO: 219 - DNA, 2470 bp, Phaseolus vulgaris
tggaggtgtaaaccggatgttgagacttataatgctcttatcaacgcacgtggtcgagctggacagtggcgttgggctttgaatatcatggatgacatgctgcgtgcagctgtgtgtacttagcatttttcttccctagtcatatttaattccaccgagtagatatacctataacaacttgataaatgcttgtggatctagtgggaattggaaagaagcactcaacgtttgcaagaaaatgacagaacacggtgtcgggcctgatcttgttactcacaatattattctatctgcatttaaaagtggcgctcagtatttgaaagctctgtcatattttgaactaatgaagggaactcatattcgtcctgacacaacgacacttaatattattatccattgtctagtaaagcttcaacaatatgacaaagctattgatatttttaattccatgagggagaagaaatcagaatgtacccctgatgttgttacattcacaagtatcattcacttgtattctgtgtgtggacaagttgataattgtgaggctgcattcaatatgatgcttgcagaagggctgaaacctaatatagtctcatataatgcactaattggtgcatatgctgcttgtgggatggacaatgaggcacttttggttttcaatgagataaaaggaaatggttttcggcctgatgttgtatcttatacgtctctccttaatgcttatggaaggtcacaaaaaccccaaaaagcaagggaaatatttgatatgatgaagacaaacaagttgaagccaaaccttgtcagttacaattcactgatcgatgcctatggatctagtggttttctgacagatgcaattgaagtcttgcgagaaatggaacaagatggaattcaaccaaatgttgtttcaatatgcacactcttggctgcctgcggacgatgcagtcggaaggtgaagattgacacagtgctaacagcagctaagatgcgaggaattaagttaaacacagttgcttataattctgctatagggagctatatgaatgtaggggaatatgacaaagctataaacttgtataaatctatgaggaagaaaaaaattaaaactaattctgttacttacactgtgttgataagtggttgttgtaagatgtcaaaatatggtgaagccctatcttttatgaaagaaatgatgcatctaaaacttcctttgaccaaagagctctactcttctgtcatatgtgcctatagcaaacagggtcaaattgaagaagcagaatctacatttaacttgatgaaatcatctggttgttaccctgatgtggttacatacacctccatgcttgatgcctacagtgcagctggcaattgggagaaagcctatgcactctttgaagaaatggaagcaagtgacatcaagctagataccattgcctgtgcagctctaatgagatcttttaataaaggtggtcaaccgggaagggttcttaatcttgcagaaagcatgagagaaaaagaaattcctttcactgatactatattttttgaaatggtatcagcctgtagcatattacaagattggaggacagctgttgatttgatcaagtacatagagtcctcacttcctgtaatttcatccgggtgtttgaatcagttcctgcattctttaggaaaaagtggaaagattgaaactatgttgaagttattcttcaaaatcttggcatcgggtattgatgttaacttaaacacttactctattttattgaagaaccttttatcatctggaaattggaggaagtatttagaggtattgcaatggatggaggatgcaggaattcatccatcaaatgaaatgtaccacgatatatctgcgttttctcaaaaatgctgtgggcacgaaaatgctgctgttataaaagaaagacttgaatccttgaaaagaaaatctgaggatcaaatttctgccaaccgaccaggtgaaactcctgttcttagttgaccactgtcatggaatcacaattttttggcttagctgtgacacaccggtccaacttttgctgaacttctgcctgagattttgtgaagattgaagttggaactcaatgtgatggatcacacgctactcttgtataaagattaggaaaaatgctattaacacatttcattattgaatgaaattttgacgaaaaccacaagatctcattaaataagtgatatttacaaaaattgtgatatcaataaattttactgagtaatagaaaaatgttcagaagggtgtgtaaatgattgagttcctagcattttccaaagacattttgttcattttaggctgcaatttgtaaacaataccatgttttgctcctctatgtatactagtaatacgtttggactgtactgtaaatgtaagctccactgggatcactcttctagttcttccttcactcccatattttcttttccactcccataa

SEQ ID NO: 220 - DNA, 881 bp, Brassica napus
ggaaacctaagttgcaaccatgggtatttctcgtgactccatccacaagaggcgtgccactggaggcaagcagaagcaatggagaaagaagcgaaagtacgagatggggaggcagccagctaacaccaagctgtccagcaacaagacggtcagaagaatccgtgtccgtggaggcaacgtcaagtggcgtgcgttgaggctcgataccggtaactactcctggggaagtgaagctgttacccgcaagaccagagtccttgacgttgtctacaatgcctccaacaacgagcttgtccgtacaaagacacttgttaagagcgccattgtccaggttgatgccgctcctttcaagcagtggtacttgcagcactatggtgttgaggttggtcgcaagaagaagaatgctgctgcttctgccgccaagaaggaaggagaggatggtgaggatgctgcaccagctgctgctgctgcacctgaggaggtgaagaagagcaaccatgtgcagaggaagatcgagagccgtcaagaagggcgcactcttgattcccacattgaggaccagtttgcaagtggacggttgttggcatgcatctcctcaaggcccggccaatgtggacgtgctgatggatacattcttgaaggcaaagagcttgaattctaccagaagaagattcagaagaagaagggcaagggtgccgcttaaaactcgttgtctgcttgaaagctttatgttttttttcatgaaacatgtttgagttttcagtttagtgtctgagagcctatgttttggatttagcttttgcgatatggtatttcataaactcctgtcgttacaatgttatttgtctcgtaatttttgtttaatttaaaagcgtctttga

SEQ ID NO: 221 - DNA, 1218 bp, Brassica napus
aaactagaaggaagtcttcgaatcagagagattctctatcctttagatccggaagtttctctatcctttagatccggaagttgcttggcgagagaagatgacagtgatcgacattctaaccagagttgacacgatctgcaagaagtacgacaagtacgacgtcgacaaacagcgtgagtccaacatctccggcgacgatgcttttgctcgtctctacggagctttcgagactcaaatcgagacggctctcgagaaagctgagattgttaccaaggagaagaacagagcttctgctgttgcgatgaacgctgagatccgcaggaccaaggctagattgtcggaggaagttcccaagttgcagagacttgctctcaagcgggtgaagggccttacgactgaagagcttgctgcgagaaatgatttggtacttgcgcttccggcgaggattgaagctatacctgatgggacagcgggtggtcctaaaagcactagtgcttgggctccttctacaacgtctcgtcctgatattaagtttgattcagatgggcgttttgatgatgattactttcaagagtcacatgaatccagccagttcagacaggagtttgagatgcggaaaattaaacaggaccaaggtctggacatgatctccgaaggtttagatgctttgaagaacatggcgtctgacatgaacgaggagctggaccggcaagttcctctgatggatgaaatcgactcaaaggtggacagagcaacctcggatcttaagaacaccaatgttagactcaaagatactgtgaaccagctgaggtcaagcaggaacttctgcatcgatattgttttgttgtgtattgttctgggtatcgctgcatacttgtacaatgtactgaagtaatgagatgaacaagaaaggacccatcactactctctcttgccatctgctattaaagtttcttacccgagtcaatgtctgtgtgcttgtttctggtggtatttgtgtgatctttcaacgggagtttcttcttagtgtcaagactgttcaagttgtttcttctgttgagttgtttccatgttgttcatgtccattacatgatgaatatatataaccttgttaaatttaccaaatttatgtaattccattcattcgttgtccctgtcaatgtaccgtctagctagtcgtttactatgtgctgagtctgccttgtgtatgagagaatg

SEQ ID NO: 222 - DNA, 1671 bp, Brassica napus
aacaaaacacacttgggtaatagaaatctgtctttctttgggtgaaatggcactagcgatcaacgtttcttcatcttcttcttctgtgatctcaacctctagcttcccttccttagagctcaaagtttcggctccacggatcggttcattgaggttatccgatcgtgtcaatgtctcaacggcgtctctgagtctatccgggaaacaatcatcatcggtgaagcctctgaatgtgcagtcagttgcaaaggagtcgtttgttccttctcaagcagcgtccatggtgacttctgaggttacagagaaactagatgtggtggaagtggaagacttcgaggagctagcaaagagtctagagaccgcttctcctcttgagatcatggacaaggctcttgagaagttcggaaacgacatcgcaatcgcctttagtggagcagaagacgttgctctcattgagtacgctcacttaaccggaagacccttcagggtgttcagtttggacacagggagattgaaccccgaaacatacagactcttcgacaccgtggagaagcactacggtattcggatcgagtacatgtttccagacgctgttgaggtccaagctcttgtaaggaacaagggtttgttctctttctacgaagacggtcaccaggagtgttgccgcatcagaaaggttagaccattgaggcgtgcgttgaagggcttacgcgcttggatcactggacaaaggaaagatcaatccccagggacgagatcagagatccccgttgttcaagttgatccggtgtttgaagggttagacggaggagctggtagtttggtgaagtggaatccagttgccaacgtcgaagggaacgatgtttggaacttcttgaggactatggatgttcccgtcaacacgcttcacgctgcggggtatgtttcaatcgggtgtgagccgtgcacgagagcggttttgcctggtcagcacgagagagaagggagatggtggtgggaagacgccaaggctaaagagtgtggactccacaaagggaacatcaaggagaacagcaacgcaaacgcagcggctaatgtcaatgggacgtcatccacggttgctgatatcttcaaaagcgagaatgttgtgagcttgagcaggcaagggattgagaatctgatgaagctggggaatcgtaaagaggcttggatcgttgtgctttacgcgccttggtgcccgttttgtcaagcgatggaaggttcgtttgatgagttggcggataagttgggtgggagtggcgtgaaggtggctaagtttagagctgatggtgaccagaaggagtttgctaaaagggagttgcagcttgggagcttcccgacgatacttgtgttcccaaagaactcttcaagaccaatcaagtatccatcggagaagagagatgttgattctctgacatcgttcttgaatcttgttcggtaaaaagagcaaaaaatcagtcgactttgcaaaacaaaaccattcagtctagttctagagtgctagaacagatgaagtaagagcttgagattctctatttgaaagctttcacttttgtatagttgtggtctatccttttgtaaaacatttgcctttgtgatgatgatgatatgagcaagttttcaaacatcgattactcttatatggaattgatt

SEQ ID NO: 223 - DNA, 890 bp, Gossypium hirsutum
ggccaagatgagcattttggtattgttggttttttatattgttagctgaaaatggagaattgttacccttttagcttgcttgaacctccaaattgtgatggttgcaatgctgctgctataagcaatgagcctcctttcgtagttccatggccagtcgaacctcttttctcagcttctagctcggttcgttgccacgggtttacttcgccagcgatacctgataaagctacggtggcttccaagagccatagtgaagccgagaagcgtcggagggatcggattaactcgcagcttacagctttgaggaaattgattcccaagtctaacaagatggacaaggcagccttattaggaagtgcaatagagcaagtcaaggatctaaaacgaaaagcaacagaaatcggcaaagcttttgctataccgtccgaaaccgatgaagtatctgtcgattacaatgttcccgaagacaagacattcatcagggtttcgatttgttgcgatgatcggccggaagtgttttcggaactcatccgagtcctcaaagggctaaggcttagcattgtggaagctgaaatttcaagtgttggtggaagaaccaaaagcaatttgatcctttgcaatgagagtgataatagagaaggtgtttcaagcaatctaaaacaatctttgaatgtagttgtgaacaagattaatgctttatcatcggatgaatcgaaatcgaattatcggataaggagtaagagacaaaggttgttcttgtcttcttagtttactccgtaataaacaaggtgaatattaaatacattgtcagtgtaggtgtttttgtccgtgagcaaaaacagatcgctttgtatttagtaaaataaaaaataatggagggcttacaaata

SEQ ID NO: 224 - DNA, 1053 bp, Gossypium hirsutum
gggtttatctttttactcactctgttggctaagctgcttttctagggttcatttatctttcgcctccctctctttcttttttcaatcccctccttctttcaggtaaaatgcaacgggcagttcgagctttttcggtgcacggaaatactgtgaaaaatgcgatcttgcatcgcattcgggttgtcaatccggttatacgacccgttatgttttccagatcacttacatctgctagtatggaagaacatggcttcgagagcaccactatttcagacgttttgaaagccaaaggcaaaggtgcagatggatcctggctttggtgcactacggatgactctgtgtacgatgctgtgaaatcgatgactcaacacaatgttggtgctctggtggttgttaaacctggagagcagaaatcaattgcgggtatcatcacagagagagattatcttaggaagataatagtacatggaagatcatccaagtcaactaaagttggggacatcatgactgaagagaacaagctcatcacggtcacacctgagaccaaagttctgcaagcaatgcaattgatgacagataaccgaatcagacacattccagtgatcaatgagaaggaaatggtaggcatggtttccattggagatgtggttcgtgctgtggtgagcgagcaccgtgcagagctggaccgcttgaatgcttacatacagggaggttactagatgatgatgatgatgatgatgatggaatatagtgtatgtttcacttgttggacctaagcaagcaagcaaggggagagcttgcaaatatgctatgttttcgtggtttttctgtgaagatgcaagtgatgttggaataattaccatgtggactaagtgtttgacaataatcattctcattttgcttccttcctatttgactaggaaagtggcaaaagcaaccttggatcagtttgatttctgtttttctaattattgaacgcattaactcggcgagtcacgattgagccctttgcataggtatcaactaaaaaataaattaattaaaatctgcctt

SEQ ID NO: 225 - DNA, 621 bp, Gossypium hirsutum
tctcactactgttcaagaaaagttacttaaagaaaggaaaaccatggctcctagatcaaaacccagcccgattagcccgaatcccgacccgaattctaaggagatccgctaccgcggcgttaggaagcgcccatggggccgttacgcagccgagatccgagacccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcccgtgttcttccctccctgtgacggcgcagcgtccggtttacttcttcgatgccttcgctactggcggttcgggttgccccgcatccggattcgctcaaagcgactccgattcgtcgtcgtctgttgtagattttgaaggaggagtgcggcggagagtgtttgatcttgatcttaaccagttgccagctgaaatggattgatttgcctccttttttcaatatgtcgttttcagcttcaattctcagcg

SEQ ID NO: 226 - DNA, 1280 bp, Gossypium hirsutum
gtaaaaaaagcgcaacattctccttatctctccacagtcgttctccctaattttcctccaccgctatgcatccgtccaaaccactcaatctcttttttattttaacggtcatgatccgtctctgcttcgccgatctaccttcttttcgggaggcaccggcatttcgaaacggcagagaatgtccacaaacaacatggtcctccctcgacaaagagatccacaatccctccattatccacatcgctatgacattagacactgcttacctccggggctccgtcgctggagtcttctccgttctccaccacgccacttgtccggaaaacatcgtgttccattttgtcaccacgcaccgacacggagctaaactcacgcgcgccattacctccactttcccttacctcaacttccatctctactacttcaacactaacctcgtcaaaggaaagatctcgtcttccatccgacgcgccttggatcaaccattgaattacgcgcgtatgtacctagctgatctgttgccagctggggtccggcgtataatctactttgactctgatcttatcgtcgttgatgacgtcatcaatctatggagcatcaacttgagaagccacgtgttgggcgctcccgagtactgtcatgccaacttcaccaactacttcacttctaaattctggtccaacccggctttttcggcgtcgtttaaaggaagaccaaggaatccgtgctatttcaacactggcgttatggtaatcgatttatggaaatggagagaaggtaaatacacggagaaattagaaaactggatgaggattcagaaaaggtatcgtatctacgagcttggttctttgcctccatttttgttagttttcgccggagatgtggaggggatggagcaccggtggaaccaacatgggctcggtggtgacaacttggaaggcttatgcagggctctgcaccccggtccggttagcttgttgcattggagcggtaaaggaaagccatggctgagaatcgactctaagagaccctgtccgttggattccttgtgggctccttacgatctgttccgccatccgtctttgttctccaatagctaaaatacggtggagagagttcatcggatttcgtaggagaataaggacacgtgtaaaaaaaggaaagcaccttgcaacttgcttcgccagtgaaaatatggagttaccgcgggtataagttgcctgttaaccgcgctggttttcatgttttcattctgttttgtttgttcatataggaaagtg

SEQ ID NO: 227 - DNA, 888 bp, Gossypium hirsutum
cccttatgagatcgtaaaatattcgagaatccccctgtaaaatttatatatctaattatcgctttgtctttgattttatttggggttgttttgagttaattaatatggggagtgaagttttacgacctcaggattgtttgatcgaacggattcggttacctccgacggcgtgtcctcgccggagatacggaaacggtagctttaatcctagttattatcataactacaacaataacaatggaaatggtagatctaacaggaaacccgttcagaggaagcggatcggatcggagcaggggatttcgaagaaatacagctccgccgatgacttgaagacggtgaggaacaatgttatggtggagaaggttacgattatgagacgaggtgagtcgttggattcgaagatcaagatcgacaatggcggtggtggaagggaagggggtttggttgttatgggtacggatcgtttgggtccggatccggaaatggtccctaaacagatcaaaatcgtggatgctaagtcttcggtgaccgtaaaatccgacgtgtatgccggatcggctttctccgtttctccggcaccgagctcacttcctttacctactttctcgaagaagaaacaggttccggtcgatgattcagctacaagggatctcaggcgtttgctacggcttgatctctgagacccgaaaatttagatttggatccaaataagccttcgtctctttttatctccatctctctcttgatacgtttcgtctctatttagatatctccggaattttcaagatccgatgccctccgtgatattttttgaagacggtggacggatttgaaaatctggaaaattttaggggcgattagataatattccctgcttatcagttt

SEQ ID NO: 228 - DNA, 1661 bp, Gossypium hirsutum
aataattttttaaggaaaaaaccagagctcactcttgtaattttgcttagggttttcttttaatcaaaactaatctgattctcctttctactccaaaatcaccaaaagcccagatttcgtttagaaattagaaaactccatcgtttataccgctgttaaatacctccataaacatcatcccctcagaaaaatagaagcttctctctcccattaaccctaactacacaacaaataaaattacttcaaaacaataggatggcagaagcagaggtaggatctggtgaaggaaagccccaagagatgtcgttgaaggataaagggaatgagtttttcaaggctgggaactaccttaaagctgctgctctttacactcaggccattaaacaagacccttcaaatcccactctttatagcaatcgagcagcagcgtttctacatttggttaaacttaacaaagcgctggctgatgctgagacaacaattactttgaaacctcagtgggaaaagggatattttcgaaaaggatgcattttagaggctatggaacgatatgacgatgctttagctgccttccaaatagctttgcagtacaacccacaaagtgcagaagtctcaagaaaaattaagagactttcacagcttgcaaaagataaaaagcgagctcaagaagtgcaaaacttgcgatccaatgtagatatagcaaaaagcttggaaacattgaaatctgaaatgtctgaaaagtacaaatcggaagatagttggaaagagatgttttcttttcttattgagacaatggaaacagctgtaaaatcatggcatgagacttccaaagtggatcctagagtctacttccttcttgataaggagaagagccaagccgataaatatgctccagttgtcaatattgacaaggcttttgaatcgcctcatacgcacagcagttgtttttcatttcttaggcaatatgctgaagattctttctctagagcagcttgtttagttgctcctaaaagtatcatagcttatccacaggtctggaaaggtcagggttcaaggaagtggaagcatgggcaacatgatggtttctttgttcaattcgagtcaccactcttgcgaaaactatggtttatttcgagttccaatgagatggggaagacactgtgcagggatccagaggttctagatataggtgcacatgaagtacttccacgccttttcaaagaaaagctatccagttcctcatgagctttatcttaggctgaaggaaattgctaggcatgccggtggactttgattgcgaggtttacatatgaaaaaaggtaccaacaacatagcgtgcttgcttgttacttcgagctggatatgaatttccttttatatgtgaaaactcgccaactaggtacactttttcgagtcacatagcactcattttcttggttttgaaaaattttctaaagaagtttacaagccttttttgagtgattacattttatgggtgtttgttaaaactgctttcttgccttaagtgattcgcgggtttcggttcttgagttggttatatgttggaagaacagtaaagctagttggtgtagaacttattctcttgttttctgttgtaattatatgtagaaagttatcgataagggctgatgtagttttgt

SEQ ID NO: 229 - DNA, 2235 bp, Gossypium hirsutum
aatatcgtgttagattcacccactgactcagccgcgttttttttaatttttatcgttgtgaaaattttctgggttttttttcgagttaagacctctcaaacaagaagatgatgatgatgaacaagaactggaagtttgtaagactaagacaagagtttcaagttggtgttttgctgcttttattatgtcaaagtttggcttgttggtcgttgaatgaagaaggatttgctttgttgagactaagagagagagtggtgaatgatccatttggtgctttgtgggcttggaaggaagaagatggagagattaaccattgttcttggtttggtgtcgagtgctgtgatggcaaagttattgctttgaatttgaaagatctttgtcttgaaggaacactggcacctgagcttggaactctaattcatattaagtctattatcttgcggaacaactcttttaccggaactatccccgaagggatcagcaaactgaaggaattagaggtattagacttgggatacaataatttcaatgaatcgcttccatctggactcagcaacgatctctccctaacaatccagaacagtgaccgatctgaaggtgcagtgctaaggagattgctgcaagaaacggcaaacacttctgcaaagtcaccaaaagcaccccctttaaattatagtatgcctccatctcctcgtacatctagagctccaactcatcctgcatcttctgaaccatccacaaatagtacatatttaaggggtgctcctgttccacgacctccctctgctcctgcttctaaaccttctggaaatgatacagtacctaatacttctgctccatcaccatcgggaagcaatccttctattcctgactctaagtcaagtcatcaagcagcaatactagtcggaagcatagggggtggtacatttcttctaatattaataatcattgcctatctcttgaaaacttacaaggtatctactgtgaaaccttgggccacagggctaagtggacaacttcagaaagcatttgtaactggtgtaccaaagctgaagcgatcagagcttgaagcagcctgcgaagatttcagcaatgtaattggttctacaacgattgggacggtgttcaaagggacactgtctaatggagttgaaatagctgtggtctctgttccagttgaatctaccaaagattggtcaaagaatttagaaacacaattcaggaagaagattgacacattatcaaaggtcaaccacaaaaattttgttaaccttcttggatattgtgaggaagataatcctttcactaggatgttggtttttgaatatgctccaaatggcactctctttgagcatttacactttaaagaatctgagcatttggactgggctatgaggttgagaattataatgggcatggcttactgcctcgagcacatgcaccagctaaacccacccgtaccccataacaacctgtcatcctcagctgtcagtctaacagaagattatgcagccaaaatctcagatccgtgtttctggaatgagttgactgcatcagacagggaaggagacagaataaacctttcggataccacaatggcaagcctagaaagtaacgtatatacctttggcgtattattatttgaaatagtaacgggtaggatgccttacttggtggataatggttcatctgaggacatggcatcagactatttgagaagggagcaagccctcgtagagatggtcgatcctactctaaactctttcgacaaggaccaatttgacctgattggggaggtcataaaatcttgcatcgaccctgagcctggacacagaccggatatgagaggagtcagtgcaagattgagagagattactgcaatcactcctgataatgcgatccccaaactttctcctctttggtgggcagagcttgagatcatgtctagtgaagcaagctagaggatgaacttgacgctgtaagtaagaaacttggatgtttttttcttgttcttcatgtcagtggagaggcaaaaataagtttgcctgtaggttggtaccgtttgtatttatttcaagatattggaaagtttgttgtatatattcgagagagaaaatgtggtcctttgttttgggccatcagtgtgaaaatacataacagaaaggcataatggcaatcctcttgatttctaattgttcattgttaccaccattttttgcagcgatgaatcaattt

SEQ ID NO: 230 - DNA, 999 bp, Gossypium hirsutum
actttgttttagttgccataacgtcaccttccaatacaacccacaatgaggcaacaatatgtcttcactactctcacgttgctcatcctgttttccctcagttgttcaacaacattagcccaatctccggcactggccccggcaccttctggtccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtgcagctggtgcaattccacatcgtcccaacatacctcacctcgtctcagttccaaaccattagcaaccctttgagaacccaagctggtgatagtggcgatggcaagttccctctcaatgtcaccacttcggggaactctgtgaatataacaacagggttgacaaacaccagtgtttccggcactatttacactgatggtcagcttgctgtttatcaaatcgatcaagttcttcaaccattgcaaatatttgcacctaggcctccagctcccgcaccggcaccggcaaagtcgaagaataagaaggctaccactgttgctgatagccccgatgttaccccagctgataactccaaagcggccaccttgcaaaatgttggtttgtttggagttgctgctctagttattgcactttctttgtgaccatgaaaatggagaaaagaagaagacagtgattttgatggtggtgatcaagatggcgagtgttttttaatttttcaataattatcatttaaaaaatttatgttctgtatgaagattgaattttgagttcgtgttgttgatttcatttatttttgttttgaaattttctttgttatctcttacttctcaattgtaattgtgaattttgtgtcactttcttca

SEQ ID NO: 231 - DNA, 1107 bp, Gossypium hirsutum
ggctttcgagcggccgcccgggcaggtacgcgggatctcatcttcatcttcatttcaaactacctgcttctagctctccttttgaatcaatctccatttttagttttcgtaaagtgaaaggatgttaggcattttcaagaaagaattaatgaatccaccaaaggagctgcatagcccagcttcactcacttcatcaaacaagaccaagcttcccaatcaaatcatcaaccatttcctttcttcaaatcccaacaatgctttctcaatggggttcggatcctcagcttgctttgcttatgctcccacagagaatcgtttccccaatcatcaaaggttgttctgtggagtggatgaaatatactgcatattcttgggggatttgaataatttgagcagcctgctaaagcagtatgggctgtcaaagggcaccaatgaagccatgtttatcatcgaagcatatcggaccctccgcgaccgtggtccgtacccggctgaccaggtccttaaggatcttgaaggcagctatggatttgtggtgtatgatagcaaagctggaagtgtatttgctgcactgggtgcagatgaaagggttaaactctattggggtgtagcagctgatggatcagtagttgtttcagataacttgaagcttataaaagaaagctgtgctaaatcatttgcaccatttccacctgggtgtatgttccacagtgagcaaggattgacgagttttgagcatccgaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattatgtttttttttgttggggggggttatttcctcgtttatgaaatcgtaaaatgccttgtaaaaggcatgtttgataaataaaatgaaaaaaaattagaaaagaaatcctagcatggcttgataactgaaatgcctggaagagttttatcatctaataaatgatgcagcttagcatttgatcaaaaa

SEQ ID NO: 232 - DNA, 2073 bp, Gossypium hirsutum
cataatcaattattagatctcctccataaatattatcgatatcgaccttcaacaagaaacagcacatccccaataataccgaggaagaggaagttgaaaacccttgggctgtcccttggtgggtgtttctttaggttttcttggtcgcgacgattttcagtggcttgtaaatggcagcgtataggctcctgattttctccctctttttggccctagttttcaccaagattggagccgatgcctcaactgaaccgctgattgaatcggacgccgccgattcttctgctcttaagatggagttggatcaactgaagtctaagatccgtcttcttgaatcaaatgttgaggagaaaattcgagaattgaaaaccaaggatgagatgataaagcagaaagataaaattatagaagaaaaatctgacaccatggcatcgttgcactctgaattatcatctcttcagaaaaaaggaaccccagatgctgaggaacgggtgggaaaagctcatgcgaaagctcttgaattgcagaaacaggttgatagacttaaaactgaactagaagcaaaattgaaggaaaaagattatttagaatcccgtgcaactaaagctgagaacaagttgaatgaattgaatttgcagctagagaatcttcaaaagatcaataaggaacaggagaacaaactagcaaaaactgagcgagctctaaatattgcagaggaagaactgataaaggcaaagtttgatgccacttcaaaggcaaatgagttgatggaggttcacagcgcatggcttccaccttggcttgctacacagttaattcgtggtcaggccttcattcagacacattggaatcagcatggaaaaccaaacatggatatggtgatccagaaggctctagagaaaaaggccttagctaaaaagtgggctgaaccccacatggaagcaattaaaaccaaatgggttccagctgctaaggatcagtgggtggcggtaactacatatgctgaaccacatgtgcaatcgctaactgcaaaaactgttgaaatttatgaggtatcgaaggctacaataactcctcatattatcaaagttcaagaaacagttgatccttacttccaggaagccaagaagttcagtaagccatatattgatcaggttgctactttagcaaagcctcatgttgataaaatttctgtggtgatgaagccctatacaaaggaggtagttaaagcttatgggaggtttttggaatcagcaacaacataccatcaacaggttcaagcctctgtgcaagaaactttgaagaagcatgagctgacaagacctcttgcaaccaaagagcttgagtggttttcggcatctgctctattggctctacctattattattttgttcagaatattttcagcaattttctgcaaaaagacaaagaagcgtgttcgacatactaatgcagtccaccatggtcgtcgtaagggcaaaagggggcacacagacaagtagactgcgtgtatttaggttttggtctctgaatgttgggaaatattagaggctaactggacgtatgtttttactttttaggggctctaggtgatcatgttgggtagggagctgtggtgttgcaattgggaagtatttaatcttctcttacccctcaaggtccctggttttaatattattattattttttggggagggtgtggaattagaaaaagttaagaaccctagtgacgctacaaggttgaaatcttgagattcctagttgtagtaggagttgtgtattttatttatgttagtgtaatttttttttttcttctggattcacaaacgaaacaactcagtctctgtttcagaaatcatcatactttttaagttgagacatccaaggggttttatactctatcttgtctttgtctccaaggattactgtttgtttattgcctactttagctagtctctggatgggatcccatgggagagcgttgcaatttcaactttccaccgactctatatgcatagacatagcccattctaatttctaagggattggcatgactagccaggccatctgctt

SEQ ID NO: 233 - DNA, 1043 bp, Gossypium hirsutum
gatcattccagttgctctcatttttctttgggagcaagagatatggcaagcacattctcttataattcttttggattccttctcattcttgtcgcctttagttccttgataaatataagttcagctggtaggcaaattgcccctaaaactagcattgagtttatcagaacatcttgtagttcaacgacttaccctaaactttgttacgaatctctcttaacacaggctagcatgatccaaacaagcccccaactcatcgcccatgtagccctaaacgtgaccctttcaaccgccaagtcaacctcggccatgatggtgaagcttgccaaaagccaaggattgaagcctacagaggtgggcgccatgcaagattgcgtggaggaattggaggacacgatagatgagctgagaaagtcaatcagcgagatgggtcagattaaaggctccaattttggactaatgattaacgatatacagacatgggttagcgctgctttgacggatgagaacacctgcgccgacgggtttggagggaaaaacatgaacggcagtataaagactgctgtgagatccaagattgtcacaatcgctcatttgacaagtaatgccttggctttggtcaacagctatgcttcatttcatggttagctatttaatcaactgtacaggggaaatttagtcattatttacggtagcaattgtatttatggatttttagaaactacttctgttttcctggtaaatgtaaaatatatatgtggtccaaagaagggaatggagatgtgtgtgtgtgtgtgtgtgatcttggtgtcttaatgaaaatgaacggagtgatctatattatgtgcacacgttgtatctgtacaataaattgctttttgtgaacatagtaaaagtaaagttgatgaagcctctgttgcagcatacaagcagaggttttagtttgttgcaagtacatctggtcttgattttgtatagacatagtagtattattttgatctcatatttttgtaactcatttaagactacttaataactttact

SEQ ID NO: 234 - DNA, 1097 bp, Gossypium hirsutum
gggggggaaaaaaaagacagcaagggaaatacgaatcacaagcgctgatgaacaatctggaagagtgcaaagccgacaacccacaacatctacaacaagaagagatggcagcttccgcgggggcgatggatggcttggctgcatccgctctccgctccgttctccagagagtccaccagaccgccgagcggtgtggtcgtgaatcgcagcggatccgtgtggttgccgtcagtaaaaccaaacccgtctccgtcattcgccaagtgtacgacgctggccatcgctgtttcggtgaaaactatgtccaggaaatcgtcaaaaaagctcctcagcttccggatgacatagagtggcattttattgggaacttgcagagcaataaagtgaagcctttgattgctggtgtgccaaaccttgccatggtggaaactgtagatgatgagaagattgcaaatcatcttaatcgtgttgttggaagctttgaaagaaagcctttaaaagtattagtccaggtgaataccagtggcgaggaatcaaaatctggtgtagagccttcaggttgtgtggaacttgtaaaacatgttagtctgaattgtccgaaccttcaattttgtggactgatgacaatagggatgcctgattatacatcaacaccagagaatttcaagacattagcaaattgcagaagtgaggtctgcaaggctcttggaatacctgaagaacaatgtgaactatcaatgggaatgtctagtgattttgagctagctattgaaatgggcagtacgaatgtcagagttggatcaaccatctttggagcaagggaatatcccaagaaaaactgaaacaaagcttatgaagtagaggggcttaatctttagatcttcattgcgttgtttattaaaagagttgtaggcaaacacaatcctcggtctgttgttctcgtacgtgaagagaaagaaaaggtgaaaagatactgacctatcttatcatccatggaacttgtttattccatcaaaattatgctaataaatgtaatgatttgatcttatatttaattcttactgttccattggaaaattattaatataatatttggt

SEQ ID NO: 235 - DNA, 1690 bp, Gossypium hirsutum
cttttctctctctttttctcagtctcccgttagacccggtctatccatctatatcttatttatccaacccatatttcatctcctctttttattttttggggaaccaaatctatctttagggttttgattcaatcattcattgttctttcacaaaggaatgacgactactaaaaaaaacatgttacctcctggtttggttaacaatctccaggaagttcttcttagcagaaaaggcggaaactccaacaccaataacgatgaacaacaacaaaaacccgacgccgttactgattctactgagacatctacttctgcttctgatgaaaacgacaactccaagcctgtcgttttggttaccaacggtgaagggatttattcacttggccttgtttatctcgttcaagctttggtccgttctggcctctacaatgtccatgtttgcgcccctcaatcggacaaatctgtgtctagtcattccgtgactgttcgagaaacaattactgttactccggcagaaatcgatggtgccactgcttatgaagtttcagggactcctgtagattgtgtatccttagcattgtctggggcgttgttctcgtggtctaagcccctgctggtaattagtggaattaaccggggatcaagctgtggtcatcatatgttttactcgggtgttgtgggtggagctagagaagcactagtttctggtgtaccatctttgtcaatatcactgaactggaagagggaagaaagccaagaaagtgattttaaggatgcggttgctgtttgtttacctttaataaccgcagccatcagagatatcgaaaagggtgttttccccaaaagttgctttctaagtatagaaattcctacttctccttcagcaaacaagggttttaaattgaccaagcaaagtatgtggagatccgcaccaaattggcttgctgtttcagctaatcggcatccttcttctgctgctcatttcatgtctaatcaacaaagccttgggctccaacttgcacagcttagccgagatgcatctgctgctggtgctgctcgccgcatatctgcgcaaaggcagaatgtggaagtagagtcggttggggctgttaaatccgatacaaataaagtgaaaaagtactttcgactggagtttataaataaagaacaggaagaagcagaagaggatttggatttcaaggcccttgacaacggatttgttgcagtaactcccttctcactttgtcctcaaattgaggtggacattcaaaccgctgcatcagattggatctccggtgcacttcaggtggagcaatagaaccctgggaaggccaacaaaaaaaattcttaaatcaatcaatttgtatacatccgcaggaggcattacatttagtcatcaattgagttgtgcttctattaatttccattgaaatgcttgttctgtattttccctgttcatttttcttctaggggttcccaaaatatcaataactcgggtgtttgtcttttgttctagctgtttgttgatacaaggaaatagcatggtctaaattaaatatgaccatggtctttctgcaaattcttcatgttgttgttgtgggggcttttcatgtaatatggtcttttgatttgtttcaaatttatgtgaatgtttctaggcctaaatgaatattgttgttcttcaaaaaga

SEQ ID NO: 236 - DNA, 2160 bp, Gossypium hirsutum
ttgttgaagaagaatttaaaagaaaaaaaagagctgctgttttttgactaagattgtgattgtcaaaattgatgctgaggatcaaacagattgtgtttttggttaacgagtgattttgcttgatcgagtgattgtttgctgttagaagacgaaggtgttactagtattatcaacgaattctatcgaaaatcgagcgctttattgataagtggggttcggtttagatgcaaacgtctcagaaacaccaaactcgggtcaatatccacagattgtatcaccaacctgctaaggatgttgatcaattttgcttgcctcatattcagatattagagaacaatgcatgttcggatgtcggcagtcaaggacccagtgtgtcctatcaagcctacaaggaccagatttttactctggaatcatccacggcgactgctagtttcgttgcttatgattccccttctgctataagtgtctcgtcgagcaggagtcctttctccccacaaggttcccaatcgtggatgtctgatcctcatcattcccccgacaatacacatggatcaccgttcagtggatcttctgttgttgatgatagcaacggattgaagcacaagttacgagagctggaagtctcgttgttggggcctgaatcggatattatagacagctgcaattgttgctttactagtggagctcaccaagctgcttcaatggcaggcttgaaccacgagcaactggtggacatgattcctagattagacttgaaggaggtgcttattgcttgtggtcaagcgctttacgacaatgacatgtcgagagtggcaggtttaatgcatgtattggagaaaatggtttcagtatgtggggaaccactccaacgattgggcgcttatgttcttgaagggcttagagcgaggttggaatcatcggggagtaatatctacaaagccttaaaatgtcaagaacctacaagctcggaactaatgtcttacatgcatattctctttcgaatctgcccgtactacaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcccccatttatccgtgtaactggtattgatgattctcagtcaaatcatgctcgaggcgggggacttagtattgtggggcagaaactatcagaatttgctaagtcgtacaatgtgccattcgagtttcatgatactagcgtgtctacttccgagattcaagtacagaatctcaacatttgtcccggggaagccctagccgtgaatttcccttatgtattgcatcacatgccagacgagagcgtaaccatctcgaaccacagagaccgattgttgagattggtgaagagtttgtcccccaaagttgtcacacttgttgagcaagagtctaacaccaacacatccccctttttttctcggtacatcgagacacttgattattacacagctatgttcgaatccatagacgtagcttgtccaagagatgacaagcaaaggatcagtgcggaacagcattgcgtggctcgggatattgtgaatatgattgcttgtgaagggcaagaaagggtggaaagacacgaacttctcggaaaatggaggtcgagatttatgatggccggcttttctccatatccgttgagttctttggtcacattagcggtacgagatatgttaaaagaatataacaacaactatagacttgtagagagagaagggtctctctatctagggtggataaacagagccatggcaacctcttctgcatggaggtgaaaaaagcatggaggaatctgtaaattctacccaaatacccttttttttctcttaatttatagcatcaacctttagtgtgtgtgctgtaaatttatagaaaaatatgagcttagctttgtgttgtttttttaggcaaagggactgaattgcaaaaatcacagtgtacatttcttatgaaacagctttgagcagattttagtcactttgtggacattggctcacatcaatcagtgaatcagttcatatactatcacctgtttttaataggaaatgactgtgacgaattttt

SEQ ID NO: 237 - DNA, 859 bp, Gossypium hirsutum
ccacgctaatgtagaagctcctgccacgtctccgtgtcagaaaccatggccatctctcatgttccgtattacttgtcaaaattgccttctccattgttcacttgccgtttggcggccaagaaaatctcagaattttccatggagaatccgcaacatcctgaaggcaaagaagcatgtgaatccaatccaaccaacgtgaagcgtgtatccgatgatataatgcctcaccttcttaacttatatggatctcgtgtcacaccacgcgactttgaaatatacgccgcggacgcttcttttgaagaccctctcatgtgtgctcatggagtgaaacaaatcaaatcatcattttattcactttctaaggtttttagtgaatcaagaatcgttgaatatagcatcaacgaaaaagaaatttcagctggaaagcatgagatattagttgacaacaaacaacaatacaagttcttgggaagaaacatagatatgatatcattgatcaggttgtttgtcaaggacggaaaggttgttcgtcacgaagattggtgggataagaagcctcttcggaatagagaaacagttaagcttccatgtgtcggccgaatgattgaactgactcgcaggggttcgatgttcgtaactcatgctttaatggggttcggaaaggatcctcctaccggatgatgctacaagtcgactgtatgcaagtctgtctcggtgtcatattcttagttatattcatatcaaatctcatattgttaaacttttttttattctgatcatgtgtaaatcttgaaattttaattagccgttaaaaaaataagaatcaaattgataaaaaatataaacattatgaactaaa

SEQ ID NO: 238 - DNA, 969 bp, Gossypium hirsutum
actggcaggtgtaagcgatggaaggagtcatttagcgagtcaaagacgtggcaaatgggattctgaaggtaaaaaaatccttaggcaactcagtgaagaaattattgagatttgagatcaaacatcacatagatttcagagattttcaatggcagccgaagaaggcaaaacagcagatgcacagtttttccacctcctttccaatctactccatcaggtagaagcattgactaaccaggaagaagttgaactgcgttcgaaaatcgaagcccttggattggaggttacaaaagttccttccatgtctacacacagccttgatgagctggaaattgcgagagagttggacaagttatcggctaagttagacggtgtggatgagatgatatcctcagccatggcagcagacccgcaggtgcgatcccttttgagtggcactgctgatttatggatgccggttattactgccaatgctgatgagcgacgcaatttggctgcatcaatcagtactgataataacccgcttggcaacaatgaagacgacatcaaacccgacaattgatgtttcaccggtcagtcacctccgccatactttgttctaatactaatttgttttcgggtttttggggatatgtcatatgactagaatataccattgcattaatcattttgttttgtctattggggaacaaaaagtaagtttcttattctgttgtatccgtagttacattgggtctcattattttaaactcgaattgggttagacgcaagacggagaaagctcttataaagtgtttatttttacttattctctatccacaaaactcaaaaccgataccttgttttagaggcttcgaacttcaaaaacaatagtgttgctcatgttggaactaatggctgctcttcttcttcctcttgatgctgttgatgacgatgatgatgatgaccagcttcattggtttttttacc

SEQ ID NO: 239 - DNA, 1624 bp, Medicago truncatula
ccttatcatcgttatttcccctgaaactcaccgtttcgttcatcgttcttacaacaaattcctctgatttttcttccgtacaatcatggagatggaacgcatggctgaattctctcgcaattacatggatcgcccaccgagaaagagagcgcgattgggttgggacatccctgaaacccctaaggctcaggtaggattgttttgtggacaagaggttgagaatatttcaagctatgctccttcagaacataatatcactagttctctgtttaagggagttgctcgaaatggttctcccccatggcgagatgacgacaaagatggccattacatgtttgagcttggagataatttaacttctcgctatagagtccacggaaaaatgggtgaaggaacatttggacaggttttggagtgctgggacagagaaaggaaggagatggttgccattaaagttgttcgtgcgataaagaagtatcgagaggcagccatgattgaaattgaaatgctgcagcaacttgggaaacatgataaaggtggcaatcgttgtgtgcaaatacggaactggtttgactatcgtaatcatatctgtattgtgtttgagaaacttggaccaagcttatacgattttcttcggaaaaacaattatcgttcatttcccattgatcttgttcgcgagattggaagacaactattggaatgtgttgcattcatgcatgacttacacatgatccatactgatctgaagcctgaaaacattcttctggtttcatcagagtatcttaaaatccccgactacaagagttcatccagagcaccgtgctccttttacaaaagagtgcccaagtcaagtgccataaaagttattgattttggaagcactacttatgaacgagaaaaccagaattacattgtatcaacacgtcattatagggcacctgaagttatccttggacttgggtggagctatccatgcgatgtttggagtgtgggttgtatattagtcgaattatgcactggtgaagctctgtttcagactcacgaaaatttagagcatcttgccatgatggagagggtgcttggtcttttaccacagcagttgttgaagagagttgaccgacatgctgagaagtatgtccgaagggggagattggactggccagagggtgcaaattccagggagagtattaaagctgtaatgaagcttcctcgactgcagaaccttataatgcagcatgttgatcattctgctggagatcttatacatcttttacaggggctacttagatatgacccatttgaaagagttacagctagagatgctctgagacatccattctttatgagagatcaccttaggagatgattagccatttttagaggcctattgtctaagttgaatctgtcaaaagtgcaaatgcgtgtaaggagaaggaaagcttgtaaataaatatttatattatcagcttgtctgataagtgaagatgattatacaacagcaccttcccctccaaacctctatgacccaatccttatttattttaaaatttaatgaacatgtatttttacaaacgacagccgagtggaatgtatagaacaaatgtggaatgttttgaatacatta

SEQ ID NO: 240 - DNA, 3995 bp, Medicago truncatula
aaatgtccccttctctctctctctctctctataaatatagatttagaggagtttctagagagagaaagtgtagattagtccatatctgtgaggagagagaaagtgtttaagaatcttgaaactttgtgttgtgggtttggtactttggttacatattcggagttttctttgttgttgttgttgttctcatgttcggtctttgaagcaaagatctagttcagtattgcagattttagtgtggtgaagatgtcatctctgagtagggaattggtgttcttgatcttgcagtttctggatgaggaaaagttcaaagagactgttcacaagcttgagcaggagtcaggatttttctttaacatgaaatattttgaggatgaagttcataatgggaactgggatgaagttgaaaagtacttatctggtttcacaaaagtagatgataataggtattctatgaagatattttttgagataaggaagcaaaagtatcttgaggcattggataagcatgatcggtcgaaagctgtagagatattagtgaaggatttgaaagtgtttgccacgtttaatgaagaattgttcaaggaaatcacacagctactgacattggagaattttagggaaaatgaacagttgtcaaagtatggtgatactaagtctgcgcgggcaatcatgttggttgagcttaaaaagctcattgaagctaatccgttatttcgtgacaaattgcaatttcctaaccttaaaaactcaaggttaaggacactcatcaatcaaagcttgaattggcagcatcaactatgtaagaatccacgtccaaatcctgatataaaaactctttttgtggatcactcatgcggacaaccaaatggtgcacgtgctccttcgcctgctaacagtccgttattaggatccttaccgaaggctggtggatttcctcctcttggtgctcatgggccttttcaacctaatccggcagcagtgccaacacagctcgctggttggatgtcaaatcctaccactgtagcacatgctgcagtttctggtgctggagctataggtcttggtgctccatcaatgcctggtgctttgaagcatccgcgtactcctccaattaatccttctgttgactatccatctggtgattcagatcatgtggctaagagaacaaggcctatgggaataacagacgaggtaaatctacctgtcaatgtgttgtctggaacattcccaggccatggacatagtcaagcttttaatgcacctgatgacttgccattgccgaagactgtcacgcgaactctgaatcagggctcatctcctatgagcatggactttcatccagttcaacaatctttactgctagttggcacaaatgtggggggcattgccttatgggaagtgggttctagggagaagttggtctcaaggaactttaaagtttgggatcttagtgcatgttcaatgccatttcaggctgctcttgtcaaagatccaagtgtttctgttaaccgtgtgatttggagtcccgatggtgctttatttggtgttgcatactcaaggcacattgttcagatatactcttaccatactggtgatgatgttcggcagcacttagagattgatgctcatgttggtggagtaaatgatcttgcattttcccatccaaataagcaactgtgtgttataacctgtggtgatgataagaccattaaggtgtgggatgctgtatcgggagcaaagcaatatacatttgaaggtcacgaggctccggtttattctgtctgtccgcattataaagaaaacattcagttcatcttttcaacagcgctagacggcaaaataaaagcatggttgtatgacaatttgggatcacgtgttgattatgatgctcctggtcgatggtgcacaaccatggcttatagtgctgacggtacaaggctcttttcatgtggaacaagcaaagatggagaatcatctattgtggagtggaatgaaagtgaaggagctgtgaaaagaacttaccaaggatttcgtaaacgatctatgggcgttgtgcagtttgatactaccaaaaatcgatttttggctgccggcgatgatttctccattaagttctgggatatggacaatattcaacttttgactacagttgatgctgatgggggtctacctgcaagtccacgtattcgtttcaacaaggatggaactcttttagccgtttcagcaaatgacaatggaatcaaaattgtagccaatgctgatggtattcgtttattgcgtacattagagaataattctatgtatgatgcgtcgagagcatcagagatggcaaagcctacaataaactcaatgtcttctgctgccgccgcaactagtgctgctctagctgagagagcctcatctgtagcagctattgctggaatgaatggagatactcgaagcatgggcgatgttaaacctagaataagtgaagaagccaatgacaagtcaaagatatggaaactcactgaaatcaatgaaccatctcattgtagatccttgaagctaccagagaatgttagagtaaacaagatatcgaggttgatttatacaaattcaggaaatgctattctagcattagcatcaaatgccattcaccttctctggaaatggccgcgaaatgaacgtaactcatctggcaaggccaatgcttccgtgccagctcagttgtggcaaccatcgagcggcatcctgatgactaatgacatcgctgatagcaatcctgaagattctgttccatgctttgctctgtccaaaaatgattcgtatgtaatgtctgcatcaggagggaagatatccttgttcaacatgatgacttttaagacgatgacaactttcatgcctccgccacctgcggctacttttcttgctttccatcctcaggataacaatattattgctataggcatggatgattcctccattcagatatataatgtccgtgttgatgaggttaaaagtaaactcaaaggtcatacaaaaagaataaccggtcttgctttctctcatgtattgaatgttcttgtttcatctggagcggatgctcagatttgtgtgtggaacactgacggatgggaaaaacagaagactagattcttgcagctacctcctgggaggactccatcagcacagtcagatacacgtgtacagtttcaccaggatcagatacagttcttggtcgtacacgaaactcagctcgccatttttgaagcaactaaactagaatgtctaaagcagtgggccccacgggattcttctgcaccaatatcgcatgcaactttttcatgcgacagccagctgatatatgcaagctttttagatgctacagtctgtgtatttaatgcttcaaatctcagattgcggtgtcgtatcaatcctcctgcttatcttcctgcaagtgtcagcagcaattcaaacgtacaaccactagtaattgcagcacatccacatgaagcaaatcaatttgctgtaggactatcagatggtggagttcatgtgtttgagccacttgaatccgaaggcaaatggggcgtaccgcctccaaacgagaatggatcatctagcaataatgtagcagtagctacttcagttggactttcttcagaccaagcacaaagatgaaatgataaaatgaatccattttcagccaaaagacaagtttcttttacatacttggcttgttggtcattttgaagaactacatttatctctacttttgtttatgcagctggattctatccaaattagctgatccacttttctatatatttgttctaatgaagcatataattatgtcatgctggaacagctaatttggttgaaaccaaaactacattgtgatttgccaatagatgtgaattttttcattttttttattatagtttaatttaatgcaacagatgtagaaatgtttgaagctgtttcattatactggttaagcctaacttattacc

SEQ ID NO: 241 - DNA, 626 bp, Medicago truncatula
acacacagaaagatagtcatggctagcagcagcatggcatcagcagctactggatttttgttgtcacttaatgttgctgccaacagcacaacctcttcagcttcttcaaggagtaccatgttgatgttccctttaaagtccaacaatattggttcttcttcttctagacttgttgtcagggcaaccgatgaggctgccccggctgcacctgctgcccccgctgctccagctgctgatgcagctcctactcctaaacccaagccaccaccaattggccccaagagaggttctaaggtgaagattcttaggaaggaatcctactggtacaaaggcactggatcagttgttgctgttgatcaagaccccaagactcgctaccctgtcgtggttcgattccagaaagtgaactacgccaatgtatcgacaaataactatgctttggatgagattgaagaagttgtttaatgagacaaatttaattgtaatttcaactcttgttatgatattgaagttactagcctaaggttttttcatgtcaaaaatatttgtatcatattctgtctgatatctatcttcttcttgatctctagaaactacattcattgtgcagttgcccataatcttaa

SEQ ID NO: 242 - DNA, 1550 bp, Medicago truncatula
aagaaatcggtggtggaagaaatgacacgtgtaatataaattcctctattctatctatcgcttcaaaatcaaaataatatccaaaatccaatccaaacctattcctcttcttcaccaccatcaacaacgcgatttggttccgttgttgaactcgaaatggctattttctctgcaaccctaggttcctttggtgccatttccttcctctcatcttcacaatcacaacaacacgatccttcttcttcttccatcgtcaatcctttcaatttccctaaatgccctcacaagttaccaccaccttgccaatggcatcctcactatcgtcatcacaatcctaaaatcatggtatctagtagtagtagcagtaacaatactcatattgatgaattcgacagcggtcttcttcaacgcccttctgctcctgactcttatgatgctcttcgtcaagccaggagatcgtcagattggaaggctgcaaacgcatatagagacagtggactcatttacaatggtagggttgagggttttaatgctggaggcctgctggttcggttttactctatcatgggctttctcccgtacccacagctgagccccgtgcattcatgccaagaaccagatcaaactatcaaagaacgcgcaagagagttgatcggtgccatcttatcagtgaaggtaattatagtagacgaggagaaacggaaattggtcttatctgaaaaggaagcttcatggtttaaacattcaaaacatatcaacataggggacctttttgaaggaagagtcggttctgttgaggactatggggcttttgttcatctgcgcttccctgacggtctttatcaccttaccggactaatacatatctcagaagtgtcgtgggatctagttcaagatgtaagagacttcttaagagaaggtgaagaagtgagggtcaaagttatcagtattgatactgtaaaaatgaggcttacactgtcaattaaacagctagaagaagatccactgctagaaactctggacaaagtaatacgtcaggatggttcaggtgttcccaattctatcagcagtactactagcagtcccatcgatcccctaccggggctggatacaatacttgaagagctattgcaggaagatggcataaacgaggcaagaatcagccgtcaggggtttgaaaaacgagtggtctcacaagacttgcagctttggctttctaatgcacctccgatggaccaaaggtttactctccttgctcgagctggaagacaggttcaggagatacatctgaaaacttcccttgaccaggaaggtataaaaaaggcaatacaacgagtattggagcgtgttccttgaatctgattgattacacttccctctcaataataatcacaagattttgtacagctttcacatttatttaatggtttcagaaagacaaatgccaagtagtgattcatttaacctatcgcaaaagtttccaattgtaataactccgtttattgtcaatttactttaattcaaaaatgccagcactctttagattctaa

SEQ ID NO: 243 - DNA, 1483 bp, Medicago truncatula
ccatttccatggaaacaatgtgaggggagcaaagcatgaatactctctccctccacttctacaccccccactccttcctctccctcaaaccaaaaccccaacctcgtatccaatgttgttctaccaacaacaacataatcgacgacatcgacatggtaaaaaccaaacaaggaacctacgaacaaaaacagaacaaagtctgtgtcctctgggacctcgacaacaaaccaccacgcggaccaccctacaacgccgccgtatctctcaaaaacctcgccgaacgtttcggcgacgtaaccgacatctccgcttacgccaaccgccacgctttcattcatctccctcaatgggttctcaaccaacgccgtgaacgtaaaaacctcgacatcctcgaacgcaaaggtatcatcaatccacctgaaccgtatgtatgttctgtctgtggtagaaaatgtaaaactaacgtagatcttaagaaacacttcaaacagcttcatcaacgtgagagacagaagaagctgaaccgtttgaattctttgaaggggaagaagaggcagaagtataaggagaggtttgtgagtggtgatgacaagtataatgatgctgttagggagattttgaaaccgaaagttgggtatggtttggcttcggagttgaggagagcgggggtgtttgtgaagactgtggaggataaaccacaggctgctgattgggctttgaagaagcagatgatgcactctatgagtagagggattgattggttgtttttggtttccgatgattccgattttagtgagatgttgaggaaggctagagaggctaatttaggtactgttgttgttggggatgttgatagggctttagggaggcatgctgatttgtgggtgccgtggaatgctgttgagaatggtgaggttatggatatggatttgattcctaggaatagagatagaagaagaacaaattcaacatccacaacaatggatgattttggtgatgtgttgttttttcacgagggcgaggaaatggaagacgattttatgttggagtatagtgatgatgacgattttgatgaggattctgatgaagaagatgaagatggattttatatttattgattcttttgtaaatgaagctaaggttgatgtgaaatcgaggtataagaatcaattactactcaactagaggttgagtgatgttaaattgagctatgtagcactactacttcagattgaagacatgtctggtgaccggcactaattcttttgttttcttgaattattattgtgtcggtgcttcatagaaattgagggattgggttatactgtaatgttgtttcttatatatgaagtatattcgacttttaaggttttcattgttttgcagttttattcaccatcctggtaaagctagtactgcttgagattcaggattgccacagtacatctctcctatgaattatttcatttttgtttaactttgc

SEQ ID NO: 244 - DNA, 2175 bp, Medicago truncatula
gcgtgtttcttcttcgcattttcaccgaaaatacaattccggttagatacaatggtggaggaagctccgccttcttcactgattactctctgtatcgatcatctcgctaaccaactcctcttcggggaagatgaagttattgctattattccagttatatatgaacttccatcacatttgctagatgatttgatttcgcgtttaactcctcatgcattgtatcatttccaccttcacatgccatttcaggatgtaaatgaggaagatttttcgcgtgatgactcaacgaacaacaagagaaaacgttccagggattggaatctaaatacagcctggcagaagttgtttgagttgcggtggcctgatctcattaatcagattcaaccatccgactggcagaaagcatattgggaagcccatttgcaaaactgtctggatgaagcagcagagatagcactaatctcaccttttaaaggacgtcttgcggacataaatatttctgagagcatactgcgccatattggttttgtgagacttgcagagcatgaatatgataaatattcaaaactctcttatcattgcctacaatttggaagccatgtgagaatcatggcgacccaccgtgattttccaaaagctacactttgtagcttctgcaaaatcacagtggattgtcgtgagataccaaacatacaccaatttactgcttggtttggcggtggtgtaagaaaacgcacgtccagatgttgtctgagactgcagaatattctgtgctctgcagaaactactcgtttattgagagaatgcaagctgcagagtatggtggtaagatgtatccgatctgtggaacaagttaatggattatgcagactgatcaatcaacatagcaggacattaacgtccctggagtttattcactgcacactctacgaaaattttcttaatacactacttgattctgttgtcagaaagagcgtacataaatatgcgctccaaaaacacgggctccaacacctctcaatcgtctcctcaagtttcggaccatgcactggttctttacctactgggcttcaatcactcttgtcttcagcaaggtccatgtgctcattaaaactatgtggcagtcgccttggacggaattttgcaaaagctctttttgtgactcttctcagtgtttcctcatgcatatctgtccttgaccttgctgagaatgaaatatcgggatgcctttctcactttaacaggagagtaccaagttatttacgcgagtcacatattggaattggagagtccttgcaactcttgcgtgtactcaacctgagggggaacaatctacggaaagatgatgcagaaaatcttggatatgcttttgcatacatgcctaacttggaggacctagatataagtgacaatccaattgaggatgaaggactcaggtatttgatcccatattttgctggaacatctgaaatgtgctcccgcctggcttgtttgaaattagaggcttgtgacctgtcctgtgatgtagttaaccatctactagattcccttcccgtcctcaacggaacattgaagtctctttccattgctgaaaattgccttggaagcaaagtagcaggagctttaggaaggtttttgagcacacctatcgaagtacttgatgcatcaggcattgatttgcttccatctggttttctagagcttcaaaatatgctgacgatagaggaggagcttagtttggtgataattaatataagcaaaaaccgtggtgggatccaaactgccaggtttttgtcaaaactcttgccacaggctccacgacttgttgacgtgaatgcatcaagtaattgtatgcctattgaatcactgtccatcatctcctctgcattaaagtttgcaaaagctgcaggtaatgttctgaatttggacttgacgggacatgactgggactatacgccagagcttacttccctttgcactgaatttgtacataatggaaagcctatattgatgcttccagtatcatcggccactgctgctcctattgatcatgatccttagaaaacaattttctttgatttcaactagtgttcatgctcaaactggtttaaattaaataaattaaaactgtaggcagataaaaaaaaacttaaaaaaccgcacaaaaccacatta

SEQ ID NO: 245 - DNA, 1237 bp, Medicago truncatula
gaagatttgaggatgcggaggaatacgcaatggtgttgttttgtgtgaatcgtatttcgcatcattttcgagactgtgaacttctccattttggtgttggtttcagatttcatagttttcatctttctttcccacgctctctaaaaccctgtctccctggtaatgctatctccgttaccaatagaagcaacgaaaacaaatgctattcttctaagtattctggaggagcaggagaaattccccttcttttcgattcttctttcagccaacaagaagatgatcgtgaaattatatccgacgggatatctgcagttgcaggtggaattgtggcgctgggaaagtttgatgctctgcacatagggcatcgagaacttgcaattcaagcatcaagggctggacctccatttcttttatcatttgttggcatggcaaaagtatttggttgggaacatagagctcccatagtcgctaaatgtgatcgaaagcgcgttctttcatcttggtttccttattgtggtaacatggtcccagaagagtttgagattgagttttcaagcgtgcggcatctcagtccgcgacaatttgttgagaagttagcaaaagagcttagagtgcgtggagttgttgcaggtgagaactaccggtttggatataaagcagctggtgatgcatcagaattacaaaagctatgcgaggagtatgaaatggaagcttacataataaaatctgttatggacaagaaccaatactcaacaaatataaattccagtattggctccaaagagaggggtcaggtctcgtcaacccgtgtccgcgaagcgcttgctgtaggagacatgagatatgtctcagagcttttgggtagacaacatcgtcttgtattaatggccacagatcgagaaacgttcagctttagccagtataaggtgtctgctcctaaatcatgcttattgaatctagcaccaaaggaaggtctatatgagaagtgttcacttttacttggtcaagaaaatgttatgctatgtagggtaattattgacagcaagtttgtccatatagaaacagattacggcggttcgagtgatatttttggtactcacgatttgcagtacttgcttattgaatttggtgattccagtacttgattcagtttagataatgtttctatttaaattcttagtctacttaatcgcagatgattcttatatgtcccggatgaaaattctaagtcttaagc

SEQ ID NO: 246 - DNA, 1662 bp, Oryza sativa
gtcgacgcgacccagtgaccaacccaaatcaaagccgacgcgctcgaagccgctagaagaagaagcagccatccgagtcgtcatcggcggcggcggcggcggcggcgaggcgatgggggtggtgggggcgttgctgggaccggaggcggaggcgctggtgaggctgcgggcggcggcgtggcggctgcggagggaggtcgccgccgccaccgacgacgacgagcactgggccttcgcctactccatgctgcaccgcgtctcccgcagcttcgccatcgtcatccagcagctcggccccgacctccgcaatgccgtgtgcgtcttctacctcgtgcttcgggcgctcgacaccgtcgaagatgatactagcatccctactgagattaaggtgcccattcttcaggaattccaccgtcatatctataaccgggattggcatttctcatgtggaacaaaggactgcaagattctgatggataaattccactatgttttgacagctttcttggagcttggttcaggataccaagaggcaattgaagaaattaccaggagaatgggtgcaggaatggcaaagtttatatgcaaggaggttgaaactgttgatgattatgatgagtactgtcactatgtggcagggctagtcggcattggactttcaaggctctttcatgctgctgggttagaagatcttgctcccgaatcgctttctaattcaatgggtttatttttgcagaaagtcaatattactcgggattacctggaggacataaatgagataccaaaatcacgcatgttctggccacgagaaatatggagtaaatatgttgacaaacttgaggatctcaaatacgaaaataattcagtgaaggcagtaaaatgcttgaatgagatggtgactaatggtttaatacatactgaagattgccttcggtatatgtctgctctaaaggatattactattctccgtttttgtgcaataccccaggtaatggcacttgcaacctatgctctgtgctataacaatgtgaatgtatttcgaggagttgtgaagttgaggcgtgggctgactgcacgaataatcaatgaaacaaattctatggctgatgtgtacactgctttctatgaattctcttcactgcttgcagaaaagattgatgataatgatccaaatgcgtcgcttacacggaaacgtgtgaatgcaataaaggagacctgcaaatcatccggtttgctgaagataaggggatatgacttggataggccaaaaaggaaccctgctatgatcatgatgctactgctgctcttggtagctattttcttgggagctctgtataggaggtgatcgatcctctgtaatgaccacctacgtacctttctattcaacaatcttataacctatattgtttcagcccatgagaccaccataaacatatttttgtatcagtactgttgtataagtggaagactaacgttagatgttgtgctggttgctaatggtcaatttagcacgtcaagctatatctctgatagttcactatacctctggttacgttcctgtaaattaataactatattcatcccaatatctgttctgttgtgtgaattaggcagtagatacacagagcgtggtgtatatatagtttgaaactgttgcatatt

SEQ ID NO: 247 - DNA, 1280 bp, Oryza sativa
atcgtcatcatctcgtcccccctcttcccggcgcggcggttgctctccagccatggccgccgccgccgccgccgccgtcgcctgcggcatgtctacgtccttcctcatccgcctctcgccttcgccgccggcgtcttcccacgtgcctctccctcggtctccggcttcgtcggcgcgcccgcggcgagcgtcttccgtctccctctccaccgcgcctaggccgagggcacgcgccgccggctccgactctccctccaactttggaggtcaaacatcactgatgccaccattcagccttatgcttgatgaaggctctagatctaaaaagccatatagatggcaaagggtgttgcttaaagtaagtggggaggctcttgctggagatcacacagaaaatattgatccaaagatcacgatggcaattgcaagagaggttgcttctgtcaccagactaggtgtagaggttgctattgttgttggtggcggcaatatcttccgcggggcctcttgggctggatgtagtggactcgaccgctcatcagcagattacattggcatgttggctactgtgatgaatgccatatttcttcaagcaacaatggagagcattggaataccaacccgtgtccaaactgcatttcgtatgtcagaagttgcagaaccatacatacgccgaagagctgtcaggcatttagagaaaggaagagttgttatatttgctgctggtacagggaacccattctttacaactgatacagctgctgctcttcgttgtgcagaaatcaatgcagaggtagtacttaaggcaacaaatgttgacggtgtgtacgacgcagaccccaagcgtaacccaaatgcccgccttcttgaggctgtgagctaccatgaggtgcaaacaagagacctctcagtaatggacatgactgccattacgctatgccaagaaaacaacattcctgttgtcgtgtttaatttgcaaaaacctggaaatattgcgaaagctattgttggtgagaaggttggcacgtttataggctgcacaaaagatcaggaccagattgtggggaatgcactggatcaagaaagaagattggtgaacgagttatgatttcactggagctctctgtcgctagctgtgtagctgcattgcctattgcttggtaacatgtggatctctagagtttttaggctagaatagcttatccaaatcctggttccttgtacaacctttgagcaaaaataaaaaaaccaatggtaacagagattttccagctgatata

SEQ ID NO: 248 - DNA, 1347 bp, Glycine max
gaagaaatccaaattaggagggtagccctgcccagctgtaaccgtccaacctcaattcattcattctatgttgttgcctctcttcttctgtcgtcttcttcccctcactctttcaactttcacgtaacaccacacccttcttttcttactcttactcttatgcttttcaccttcttcacttcactaccctttacccttctctgtgacacacactctttctgcttcacgttttcaatggcttcatgtagtatagggaccccaaatattaaagtattgaacttgcactttggtggaaaaaaagttggcctctcacgacaatttggtacaagaagctggatcagtaggctgcagtatactagtttggttatgtcacgacagacagttaggtttttagcatcatccaatggcccatcgacagagatccaatttgctgcaaggtcagaaggttctgaagagattagatcttcaggtctgacaagtgagcttattcctaatattaatgaggtggagttcctgctcacaaaattatgcgacacaagttcaattggggagttagatttaaaacttgctggatttcacctgcatgtagtgagggatttgactgaaaaaactaaaactctacctcctctgattcctgcttctgtaagtataattaatgtcacagaaacacctaaaacaaatggatcagttcctacaacttcgttggctgtctcgaagccagtagacccagtaccttcttcagggtccatccagagattcctagacaaagctgctgatgaaggcttggtaataattcagtctccaaaggtgggtttctttaggagatcacggacgataaaggggaagcgtgctccaccatcatgtaaagagaagcaaaatgttgaggaggggcaagtgatttgttatattgaacagcttggtggtgagctgccaattgagtccgatgtgtcgggagaggtcatcaagatactacgacaggatggcgaccctgttggatatggtgatgcacttgttgcaatattgccatcatttcctggaataaagaagcttcaataactcgaatttatggaaaagagacattcttgccagccatgcagtaattgagtcatacatatatttcattatttttgagttcccgtggtccataggttatttgtttttagtattagttttgcgtagcaaagacaaatttgttttctcatactttcctgtttgtgttggtgttgtcacgctcacttggcacaaatagccgcctattcaagacacatgactaggaacaagtgattttcttaaaaaataaataaacactgattgatgatgtgtcatgtgctggaacgaaaaattatc

SEQ ID NO: 249 - DNA, 2961 bp, Glycine max
acttttaaaattttagggcttaagagcgtttccccgtaaaacccttttttcttgcgcggagcttcttcattcagctcgagagagagccatggcgaacgaagacttgggtagttggactgatctgctacattcctctacgaagcttctcgaacaagctgctccttctgctcagttccctccacttcagaggaacttagatcaattggaagcgttatccaagaagcttaaatccaagaccataaggactgaagcaccttctcaatctattgctgcaacaaggctccttgctcgtgaggggataaatgcagagcagcttgcaagggatctgaagtcatttgaactgaagacaacttttgaggatgtttttcctgttgaagcaacaagcgttgaagagtatctgcagcaggttcatgaaatggcaatggtctctgctgtccaggaagctcagaaggataatctcaggagtttcaatgattatatgatgaaagtattagaggaggattggcaaaaagaaaaacgtgatttccttcagagtttaagtcgaatttcaacattacctaggacaaacattgctgctaacagcaacgtgggtaccctcccgggtcagcttgcatttgtgtcttctacttcacaagtctcttctggtatgcctagcatggagattgttcctctgactggcagacctattgtggagaaaaaggcatctgtctatgctgaggtagtgaaaaaactgaataaagcaagggagtctgggtcaccatttaaacctgctgcagctttcaaaggtgcatatgaaaatttgggcattgatgctagtggtggaaagtcagtaacgatgcgaaagatatggcaccttgttcagatgctgatgggtgaggaatcagccgtgcaacgtgtttcaaaaaggatgtcattgattattggtgcaagacgccaccttgaatggggacatgagaaatacatcatggataccatacaaagtcatcctgcacaagctgctcttggtggtggtgttgggaatttgcaaagaatccgtgccttccttcggattcggttgagggattatggtgtactggattttgatgctggcgatgctcggcggcagcctcctgttgataccacatggcagcagatatatttttgcctgaggtctggttattacgatgaagcaagaaatgttgcccaatcttcacgtgcttcacatcaatttgctcctttgctgacagagtggattaataaaggagggatggtaccagaagagattgcagctgctgcatctgaggaatgtgaaagaatgttgagaactggtgaccgggtaggtcgaactgcatatgacaagaaaaagttacttctatatgccatcatatcaggttctcgaaggcatatcgatcgcctgcttagagatcagccaagtctctttagtacaatagaggatttcttgtggttcaaattgtcagctgtgcgggattgccctagtggaccttcatccattgttctaagtgatggtctgattccatacagtttggatgatttgcaaagttacctgaataaatttgagccctcatactatacaaaaaatggaaaagatcctttggtatatccctatatcttgctgttaagcattcaattgcttccagctgtattatacttgtctaaggaagcaggagatgaaggatataacattgatgctgcccacctttcaattgtgctagctgatcatggggtcctttctgaaggtgctggttctgggcaaaagttgggagtgatggatgcttatgcggaagtgtccaccattatcaggcagtatggatctatgtatttgcgtcttggtgatctccaaatggccctagaatactacgcacaagctgctgctgcagtgggtggggggcaattgtcgtggactggtagaggtaacgttgatcaacaaaggcagagaaatttgatgctgaagcagcttctaactgaactattgttaagggatggaggcatatatcttctacttggtgcaagaggtgcgggtgaagaaggtgaattgggacgttttgtgactgatccgaaagcaaggcaactatttttaattgaagctgcatgccactgtcaggaggctggaatgtatgacaagtctatagaaattcagaagagagtgggttccttctcaacggcactggataccatcaataagtgcctgtctgaagctatttgtgcccttttccgtggaagattagatggcgagagccggactgctggcctcatccattctggcaatgagattttggagacatacacttattacccagatgccagtcttcaagagagagaacatgttttggaacagcaaactgtgttacgacaacttgagtcaatattgtctattcacaaattagtaaggcttggacattatgttgatgcattaagggaggttgctaaacttccatttattcctttagacccccgaggccctgacattgctgttgatgtgcttgaaaatttatctcctcatgtccaagcttgtattccagatcttttgaaggctgctctcacttgtctggacaatgtgacagactctgacggatctcttcgtgccttgagggctaagattgcgagtttcattgcaaataatttaaagaggaattggcctcgtgatttatatgagagcgttgcgcagaggctgtgaaattaaatcatgtgatgttattgtaattacctttgaattacaacagaatgtttggttaaatgttttcagtagtagcgtaacacatgtaaagtagtctcaatgatatgtctgctgcacctatgcattggaaatatattagaggaactagaaaaaggaaatacgctgcttctgaatattctcttcaccttttctctttttgttttagctattggtaatggtaatgtactgttcattttgtatcaataagaacattactttcaagttttaatcgctccgcatatggcatg

SEQ ID NO: 250 - DNA, 2172 bp, Glycine max
gaggagactgagaaaacagaagaaaacaaaatggaagacacagtttctgcgttgaggtctttgatggtttctcactctccgccgctggatgccttagtggtgccctctgaagattatcacctgagcgaatatgtgtctgcacgagacaagcgccgcgaattcgtttccggcttcactggaagtgccggcttggcacttataacaaagaaagaagcactgctgtggacggatggacggtattttttgcaggctgagaaagaacttagtgctgggtggaagctaatgcgaattggtgaagatcctgctgtagatatctggatggccgataatttgccaaaagaagcatccgttggggttgatccctggtgcatttcaattgatactgctcaaagatgggagcgtgcttttgccgaaaaacagcagaagctggttccaacctcaaaaaatttggtggatgaagtttggataaatcgcccaccggcagagataaatgctgttattgtacatcctgtgaaatttgcaggtcgctctgttgcagataagttgaaagatttgagaaaaaagcttgtacatgagcaaacccgtgggattattttcacagcacttgatgaagttgcatggttgtataatattcgtggaagtgatgtggcctactgtcctgttgttcatgcatttgctattgtgacatccaattctgctttcatttatgtggacaaacaaaaggtttctgttgaggtacaaactcatttagtggagaatggaattgaaattcaagagtatacagccgtaagctctgatgcgacattgcttgcaactgatgagctagatgctgtatctactgccaaggctgctttagccgaaacagaggccagaaaaattcccagtgaaattgataagagtgtaaatggtgaacatcaagcagaagaaaatagtaatgacctcatatgggctgatccagtttcatgctgttatgcactgtatgcaaagttgaaccccgatacagttctcttgcagcaatcacctttagcccttgcaaaagctttaaagaactcggtggagttggatgggttaaaaaaggcacatattcgggatggtgcagcagttgtgcaatatcttgtctggctggataagaagatgcaggatatttatggagcttctggttactttttggagaaggattctgtgaaaaaggagaaacatttgcaatctttgaaattgactgaggtgactgtaagtgaccagcttgaaggttttcgagcatcaaaagagcatttcaaaggattgagtttccccactatttcttcagttggctcaaatgcagctataattcactattttccaaaggcagaaacatgtgctgaacttgatccagacaaaatttatctttttgattctggagcccagtatctagatggaacaacagatattacacgaacagttcattttggtaaaccttcgactcacgaaaaagcgtgttatacagcagtcctaaagggtcacattgctcttggaaatgctagatttcccaatgggacaaatgggcattctcttgatattcttgcccgaattcctttgtggaaggatggtcttgattatcgacatggtactggtcatggaattgggtcctatctgaatgttcatgaaggacctcacttaatcagtttcagacctcaggctcgaaatgtaccattgcaatcttcaatgactgttacagatgaacctggttactatgaggatggagagtttgggataagattggagaatgtgcttattgtcaaggaggctgatacaactttcaattttggtgatagaggttacttatcttttgaacacattacctgggcaccatatcagacgaagttgattgacctgaaccttctaagtcccgaggagataaattggctgaactcctatcacgccacatgtaggaatattctggcgccatatttggatgaagttgaaaatgcatggctgaagaaagccactgaacctgtaggtgcatgagctgtgtttggagttgaaaagttaaataacttaaagatggttcagcgtaattttagtgtcttccgtatccataatactgtaatctagattttagatatcattgggaatggttattccttcaaattactatgcacagcatatataatatatcaatattctgctgcatca

SEQ ID NO: 251 - DNA, 1186 bp, Glycine max
atctacggacaccggtttaggggggtgggggggattgccttatattgtacttcattataaagctgcagatagaagttttaatttggaaaagttgccactacttcttagatgtaaattggattcaccttagcacatgctgtttagttttaacattcctttaggaacttccttccagctttagtacagaataattgccagttgcataggctaaatcagcattgcttgctcgaacgtcagtcagattcaacagataatataatgcagactcaggaatattttctcccggataagatggtacttcctttggcagatgaggccattgatcctcatatgcgtgctccacttgcttctgcctttgatgcatatttacctccaggtgtgaggcagataacacccttcgaaagatttaatgtgcaaccctctgaggcttgccccaagaactttgttatctttgatcaaacagatcaacgaagcaggatcatgttccatcctgcaatgacctacaaatttaacagtcctggcttaaatgttcatgctactggttctcaagattttgagaaaaataaagccaatcaaatggaaagagaagtgtcatctccttttgaagaagatcctaatgacattgacgcattgttgagcataggagtggatgaactagatgactttgacgaggaagaagtcagcacagcaaggactcaagaaaattatgaaagtttatccgatacttgctccagttattgctcaaaatcaaggaagaggtcatcgtcatcttctgtacagaagtcgtctggggccgggggtttctgccacaatgaagggaagcactgggagatgaagaggatggtgaggatgttgagaaagattgtgccaggtggaggtaatcaaatggattctgttgctgttttagatgaagctgtaaaatacctcaagtctctcaaagttgaggttgaacaattcggggttgaaccatgaaaaatgtaagttggtcatatgctgctgcaacagttgactatttccccaactttgtttgttagcttctatgaatagcaccctttctcgcctcgctcaccatcctagttataacttttatgagaagaggccatgctacctgagtaataaactatgattgacattttacttattcaggttatgtaagaaaatattgtcataattgtactttttaggt

SEQ ID NO: 252 - DNA, 1280 bp, Glycine max
tagaacctcgttggtttctgagacagccagagccaccttcggatctgagagatcgccacgcacgcacgcacgcttcctttgattttgtcttccgcttcgtcatttcctattctcagcttccaattctcctcctccttcttctaattctacttcttttcgagggttttcgttcctctgtgcctgattgatccctaattcgataccatgcggaagaagctcgatacccgtttccccgctgctcggataaagaagataatgcaagcagatgaggatgtcggaaagatagcgttggcagttcctgttttagtttctaaagctctggagttatttttgcaagatctttgtgaccgcacttatgaagtaacccttcagagaggagcaaagaccatgaattcattgcatttgaaacattgtgtacaaagttatagtgtttttgactttctaagagacattgtcagcagagttcctgactatgggcatggccatggccatggccattcagaggctggagctgatgatcgtgcacttccaaagagaaggaaagctgttggtgacgacggcaatgacagtgatgaagaggctaagaggagtaagatgcgtgagctgggccacactggcactcctggtaggggaagaggccgaggtagaggaagaggccgtggccgaggggctcgaactattgaaagagatatctgtcatcagcaggttgaatccgagccttgcacctctattctgcaaagtagcaatgatattcctaacactagtgtgccaatagataatggtccacaatccaaggagttaccaaaggagaactttgtgatttctgaggaaagtactcaatctttccgcaacattgatctgaatgctaacttaaatgaaaacgaagacaaaaatgctggcacagctgttccggcttcattgcctgagcccacttccatggacactgccatggagattaaacatgaagaaattccaggctggtccctatctgatgtggacaagatgggcattgacactatgcagcttgcaaacctaggtagtcgactagaagaggacgaagaagattatgacgaggaagggtaaataacatacactttgggggattaactctgctggaagctcatggtaacagtagcagagtaagtacgtactagtgctatgatgactagcctctagtactgtatgtctcccatgcaaagtatctgataaccctctctcttctttgtctattctggtttgtatctgttctcatgtagctagcagatgtagcttttctctta

SEQ ID NO: 253 - DNA, 4131 bp, Glycine max
atccaaattctgaagataagagtaagtggttgttggagctggcagagtctaatcacacgcagtgactccattcctccaaaatggagtgtttgaaatcccccttcctcttctccacttcacttctccctccaccttctcatcaaccctactccattacgccaaacataaagaacaagaagaataagaaacctcgagttcccatcttcattcgctgcaccatccagcgcgacccgtggtccccgacttccggcgaccccacccgacccaagcctcggagtcggaacccgaagaagccgctgtccgacgacaacgcgaggcgcatcataaagggaaaggcggcgtaccagagcatcctgcggcggaaccagggcccgcaggctcagaccccgaggtggattaagaggacccccgagcagatggtgcggtacctgcaggatgaccgcaacggccaattgtacggcagacacgtcctcgccgcggttaagaaagtgcgctctctctctcagagagtcgacggcgactacgacatgaggatggtgatggcttcgtttgtgggcaagctcagcttcaaggagatgtgcgttgtgctcaaggagcagaaggggtggaggcaagtcagagacttctttgcttggatgaaattgcagctgagctaccgtccaagtgtaattgtctacacaatagttttgcgcctatatgggcaagttggaaagctgaaactggctgaggagatcttcttggagatgcttgatgtaggttgtgagccagatgaagttgcttgtggtaccatgctttgttcgtatgccagatggggacgtcataaggctatgctgtctttttattctgctataaaagaaaggggaataattctttctgttgctgtcttcaactttatgatgtcttctttgcaaaagaaatcactccatagagaggttgtacatgtgtggaaggatatgctaggaaaaggggtgatacctaataattttacttatacagtggccatcagctcattcgtcaaagaagggctgcacgaagatgctttcaagacttttgatgagatgaggaattatggagttgttcctgaggagttaacttatagtctgcttataaatttaaatgctaaaagtggcaacagagatgaagtgcaaagactgtatgaggacatgaggtttcgaggaataattcccagtaattacacttgtgcttctcttctatctttgtattacaaatatgaggattaccctagagccctctcccttttttcagaaatggtacgcaataaaatttccactgatgaagtcatatatggtttgcttataagaatttatggaaagcttggtttatacgaggatgctcacaaaacatttgaagagacaaagaaccgagggcagctcaccagtgagaaaacatatttggcaatggcacaagtccatcttacttcaggaaatgtagacaaggccttggaagttattgaactcatgaagtctagcaatctatggttctctcgatttgcttatattgtgctgctgcagtgttatgtgatgaaagaagatgtagcatctgctgaaggaacatttctagctctctccaagacaggaccacctgatgctggctcctgtaatgatatgctcagtctgtacatgggacttaatttgacgaataaggccaaggagttcattgtccaaataagggagaatgagacaaattttgacaaggagctttatagaacagttatgaaggtttattgtaaggagggaatgctgccagaagctgagcagttgacaaatcagatggttaagactgaatattttaaaaatgacaaattcttcatgacattttattggattctttgtgaacataagggggatatggaatctgatgatgaacttgtggccattgagcccattgacaaatttaacgctacagctcttgggctgatgctcagtttatatctggcaaatggcaacttcaacaagacaaaaatattactgaaactgttgttgggttatgctgctgggggatcaaaaattgttagtcagctcatcatcaacttgtctaaagaaggagaaatcagtaaagcagaattgcttaaccatcaattaactaagcttggctgcagaatggatgaagccactgtagcttctctaattagccattatggcaaacaacaaatgctgaaacaagctgaagatatttttgcagaatatataaattctcccacatctagtaaagtgctttataactctatgatcaatgcatatgccaaatgtggtaaacaagagaaagcatatttattatacaagcaagcaacaggggaaggacgtgatttgggtgctgttggaattagcatcgctgtaaattctttgaccaatggaggaaaacatcaggaggcagagaatattgtccaaaggagtcttgaagaaaacttggagcttgacactgtggcttacaatacctttatcaaagccatgcttgaagcaggcaaattgcattttgcatccagcatttttgagcacatgatttcctccggtgttgctccatcaattgaaacattcaacacaatgataagtgtctatggacaagaccaaaagttggatagagcagttgagatgttcaaccaagctagctcatgcagtgtccctttggatgaaaaaacatacatgaatttgattggctattatgggaaagctggtttgatgcttgaagcatcacagctgttcagtaaaatgcaggaaggaggtataaaacccggaaaggtcagttataatatcatgatcaatgtatatgctaatgctggagttcttcatgaaacggagaaacttttccataccatgcagaggcaaggttatttgcctgattctttcacgtatctttcccttgtccaagcatatacgaggagcctgaattattctaaagccgaggaaaccatacatgctatgcaaagcaaaggcattccaccatcttgtgtccattttaatattttactccacgctttcataaaagctggattgattcatgaagccaagagggtttatgaggatctatcaacttttggtttagttcctgatcttgtatgtcatcgaacaatgctgaatggttacctgaaatgtggatatgtggaagaaggaatcaacttttttgaaagtatatgtgaatcaacaaaaagtgacaggttcattatgagtgcagctgtgcatttttacaaatctgctggaaagggaaggcaagctaaagaaatattaaatttaatgaacaacatggggatcccattcctcaagaaacttgaagttggatcaggagagagagtgaaaactccatgagatatgaccttcttcagaaatacttgggtacttaaaaggcattatgataatggacaaaaaaatggtatagaacatataagtctgatcaacccggtaatgacaatggtggatattgcatgtatgtttactggcaatgatgattggactcttagttcagaaggacttttgctggttataaggtggacctgatccacgtttgatgcaatgcagcctttcgccttttgactgcttttaacttcttctccaaccttcctttaaaacatgtaactcttgtcagatgaacttgaagatattatatactttaagcacaaagacttcccaagcattgtatattccttcaggtaaacctttgctataactgatgagttgacagtcctcaaagctcaacggtgtaaggtagccactactctggctttcaaaatttcagcggcagagaattttatggatgaagctcaacagaaggaagcaattttgaatgaacatgttatcaggttgaagaaagaaataaaagattgtgagtctgacttgccatctcttcaagatgataagaagaaatgcattgcagaaactatagggtacaaaaaaatgtgaggaaagacaaatctcaaatggtggaagatgatagataagttcggcaagaatttcagcacaaccgcatcgttgctagaaattcctcaacttgtttattttttcttcaaacagccaaatttattatgtttcggaggctactgtatgataagtttactcaaatattacgtagattaacacttaaaatggaagacttgaaactactatactgttgagtctttta

SEQ ID NO: 254 - DNA, 2150 bp, Glycine max
acttcgaattagtataattttatttcccagcacagcaccatggaagcgttgcgcgtcgcccccacaaccccacctctcctccgccgccaccaccctctccgccaaatggcgcgccaccccctcacagcgcgcccccgccgcgcgcccctcatcgccgccaccctctccacgccgccggaggccgctcactcttccgtcgccgccgccgtcgccgaagatccctcggaggcggctcctcctccgcgcccccgcgtcttgccggattccctccagtacccgcccggcttcgtcggcgcgattcccgcccgctcccgctccgacggtggcggcggcgggattgatgccatgacttatttgacgaacattctctcttcgaaggtgtatgacgtggcgattgagtctcctctgcaattggcgccaaagctctctgcgagactcggggttaaggtttggctcaagagagaggatttgcaacctgttttctcatttaagcttcgtggagcttataatatgatggcaaagcttccgagggaattgttggaaaggggggttatatgctcgtctgctggcaatcatgctcaaggagttgcattggctgccaagaggttgaattgcagtgcggtgattgctatgcctgtcaccactccggaaatcaagtggaaatccgtggaggcgctgggtgctacagttgtgctcgtgggggattcatatgatgaagcacaagcgtatgctaagaagcggggggtagaggagggtaggacattcgtacctccttttgatcatcctgatgtcatcatgggtcagggaacagttgggatggaaattgtccgccaaatgcagggtccaatttttgcaatctttgtgcctgtgggaggaggtggtctcattgctggtattgctgcttatgtgaagagggttaatccggaggtgaagatttttggggtggaacccactgatgcgaatgcaatggcattgtcactccatcatgatcagagagtgattttggatcaggttggaggatttgcagatggtgtagctgttaaagaggttggtgaagaaacttttcgcatatgcaaggagttgatagatggcgttgttcttgtaagccgtgattcaatttgtgcgtcaataaaagatatgttcgaggagaaaaggaacatattagaaccagcaggtgcacttgcactagctggagctgaggcatactgcaagcatcatggggtccaggggaaagatattgtagtaataaccagtggagcaaacatgaattttgataaacttcgggttgtaactgaactcgctaacgttggccgtaaacaagaggctgtgctggcaactgttttgccagaggagccgggcagtttcaaacagttttgtgaattggtggggcagatgaacatcacagaattcaaatacagatataactccaatgagaaggctgttgtcctttacagtgttgggattcacacagtctccgaattaagagcaatgcaggagaggatggaatcttctcagctcaaaacttacaatctcacagaaagtgacttggtgaaagaccacttgcgttacttgatgggaggccgatcaaacattcagaatgaggttctctgtcgtttcacctttccagaaagacctggtgctttgatgaaatttttggaccccttcagtccacgttggaatatcagtttattccattaccgaggggagggtgaaactggagcaaatgtgctagttggaatacaggtacccaaaagtgagatggatgagttccacgatcgtgccaacaaacttggatatgattataaagtggtgaataatgatgatgacttccagcttctaatgcactgatgatggttttaggcacttgccattattgtgtattttagtcaacaagtttgccatatttaatatttccacggtcgtttctaaaagttggatggggaaaaaaggtggaaaggaagtggccttcagacatgtcattagttgattagaggaacaactagttctttttacctaatgcggcgtcttattacattttttataatctgtaatttatgtttttttgttgttgttaacattggaatcttataatgttgttgcctggtcttttgtgtctgtaatataagtgtcttcaaaaggttgtttgctaa

SEQ ID NO: 255 - DNA, 1461 bp, Glycine max
taataaacctgcaattattatatagcaacataaaaacggaaagacgaattattgcgtcaagttccactctatatccatcgtcaacagtgaagtgcgaatactcagcaactggagctggggaaccttgtctctactcgctctcgtccccgccggagatccaccatggccggcaaccccgccaccacttcctcctccgcattatctcccgagaaatttaatttcaatttctcccccgataacccctcccgaatcaccctcacttcggatcaggtcaaccactgcacccaagccctcaacattctgaaggagaagctccacgctcctaacgtgatcactcaggagttcgcacacttgcaggcgaacaggataacgccgagcgagatgaggagaagatgcaccgtcgcgtatgacgacgtcaatttgaggaaaaaccgatacaccgacgttctgccatttgacaagaacagggttgttctcaaatctagtactgattatagacctgaagcacaggggtatatcaatgcaagccttgtctcgacctcctcagctggaaacgtgtcccagtttatagccacgcaaggtccacttcaacatacttacgaggatttctgggaaatgatcatccaatatcactgccctgcaattatcatgcttactaggttggtggataattacaagatgacaaaatgtggagattattttcaagctgaggataggcctagagaagttggtaatatttctattattggtaaatgggagaacactactgaaacttcactcgtgctgcgccatttggaggtgaaccatagagaggtagaagatgcgccattatctgttttgcatattcagtatcctgaatggcctgaccatggagttcccaaagatacatttgctgtgcgtgaaattctgaaaagattataccatttaccaccaaactttggtccaatagtggtgcactgcagtgcaggtattggtagaactggaacatactgcacaattcacaacacaattcagagaatagttgctggtgatatgtctgctgtagatattgctaagacaatagctatgttcaggtcccagcgtattggaatggttcagacccaggatcagtacattttctgctataacgctatcatagatgaactggaagaccttgtatctcagcagcagtaggagtagaaggtgctggaacttggaaggatgttgaagctgcttgcctcattttgaagctaactatcaattcttcgaacgtttttatgttcctgcaatgctcatgttttccagcagctgaagtctgaaacattagcatctgggagattttatgaatttcaccgaattctgttattctcatgcttttttgtataattgcaggcagggaaagctgacaaatattaacatccttttgattatattgttagaattctattggggaacagaatggcataatgactacaataatgc

SEQ ID NO: 256 - DNA, 1208 bp, Glycine max
atgagtacttgtcaacttaaagatttgagcccgtctcttcaatatgctaattttaaatacagcgccgagtactggatcacaggcgacctcatcacccctccccagcaccgcgccaattcctttaccaaacgcgtcctggacccgcttctcgccgacgtcgttttcgtccccttcttcgccacgctcagcgccaacaaaggcgccttcagaaagaagcacgggaacgacgattacaagcggcagaggcaggtcgtggacgccgttaaatccacccaagtctggaaccgctccggcggacgtgaccacgtgtttgtgctaaccgcgttgtttggcagacccggtggcgattttggtggttggtccagaggtggtggtggttcaaactgtggcgagagtgatgtggttccgcacacgcaagtttctgtgattaaagatgtcattgtgccgtacatgcatctgctgcccagattggatttgtcggaaaacaaggtccggcaccagcttctgtattttaaaggagctaaacataggcaccggggaggtataatcagagagaagttatgggatctattggttagtgaacctggtgttataatggaggaaggcttccctaatgcaactgggcgagagcaatcaattaaagggatgagaacatcagagttttgcctgcatccagctggggatacacccacttcatgccgactttttgatgcaattcaaagtctttgtatacccgtcattgtcagcgacatcatcgagcttccatttgaaggtatggtggattatgcagaattttctgtttttccagcagttaatgatgcccggaaacctagctggctaggcaatcatcttcaaagcttttccaaagagcagaaagacaggttccgccaaaatatggctcaggtacagcccatctttgtctatgataatggccatccaggtggtattggaccaatacctgtggatggtgcagtgaatcatatatggaagaaagttcaccaaaaactgtcaatgataaaagaagccataattcgagagagaagaaaaccacctggtgcgtcagttccaaggcgttgtcattgtacttgaatttaagtagttctatatttttccagtttaaaaggggctgagatatgggttaatatctggttcaattttgtaccaaaagggctcattttcttctttttttggggttgaggggcgtttaa

SEQ ID NO: 257 - DNA, 1964 bp, Glycine max
atttttggagacgagtatttatccttaataaatttttcatagtattggatttcttttcttctcaaacgaaactgagattctctaattccgttccttccgtaggcccccagatccgttttgccctatttcggagatgaagaaccccaggaagaagaagagaccgaagccgcagaagaagcttgagaagaacaaaggcgttgttgctgctgctgctgttgttgccgagaacgaaaacgaaaacgaagaagaaaagagaaaacgcagcattttggaggcactggttgaggccttctccttgtcttcagtcagggaagcttccatggcctataacattgccggcggtgatcccgacagggcttcggagatcctaaggaagggtttttcggacagatccgaggattcgttctcgtgtttttcttacggctcttcttcttcttcttcctcttcgtcggggttggaattgggttcgaaaggtggttggaggcagcagcagcagcagaagaagatggttgcttcaaccggcactgtttcaacggttttggggaaggaatatgtgaggaggaacaataataatataaggaacaaagggttaagttctaatggagtttttgaaatggaggaggcagagcagttcctctgctctatgcttggcgatgattctgatattaacttggctgttgttagagacgttctttgtcagtgtggaaatgatattgaaagggcctcagatatattgcttgatttagctgcttccacaaatgagaaaccgaatactgctagacatcctaactacggagtggacaacatagatgatgagaggttctttgctgaccccaatgacagtttgatagacaggagattagagtgcacatctctttcatgggaaggttatctttctaataatccatggtctgttggatcttttggaaggaaatatgcggaggttctcaataattctaaagctaattctgctgttagcccaggatgtacaaagtctgagattcctcagaaggtgttggaatctttgtttaacattcccaaaagcactgaacatgacaaaaataccatgaattggagaaatgtagtaaagaaaattcagtctttgggacctgggttctatgtttctccgcatgttgcagaatctcagcaacgtacttgtgccaagggagatgaatatcatgtgtttagggaagattcaaggaagcaatgggattcagtgaaatcttattatacgaaagctgcaacagcatatactaaacgggaacgagcttatgctgcgtatctttccgaccagggtaaagaacaaactaaattagctcagaaagcagacactaaggccagccatgacatatttgtagctagaaacaaaggtatagaaaatgtgataactattgacttacatgggcagcacgtaaaacaagcaatgagaatgctgaaacttcaccttctgtttggatcatatgttccctctgtccagactctaagggtcattacaggatgtggatcacatggtgttggaaagtctaagctgaaacaatcagttataaaccttttagatagagaagcaattgaatggagggaagagaaccggggaactgtgttgattaaactcagcagatggagagagtatagctttctggacaccagcagtgacagtgacagtaatgattaagcatgtctaagtgcatcagcttgttgtaccatatttagatcaattgcctggcgaaaataaataaattagagctgtgacattgacatgtacattattttgttagccaagctagaccttgggacattttgggtttatcatatcatgtagagcagaacctgtagctcaattgaatctggttgtatgagtcagaattgcatttcttgattaggctaatgacccagctgtgtacatacatgaatatgtatagatgatgtttgattttcaggattttatgtttaatttctccatattg

SEQ ID NO: 258 - DNA, 1708 bp, Glycine max
tttctttccattccaccgcatcgaaaagcttttacttcacgctgacacacactacacaaacccctaaccttccttccttccattcactactactccttcactttacttcaaaatttcacccttccaaatccccaacttttacaattttactattagaatttaccatctctctttctcttcctcaatccaatccaatccaatcccctctcaatcgaagcaagaaaaccatgtatttatcggagaagcctcgtcccatcgatttctacaaggaggaaggcgcgcgcgacatgatgatcgaggtcgtctccaacggcgacctccctcctccgccgccgccgccgccgatgattctcggcgagagcagcggcgaggaccccgaggtcgagatcaaggccccgaagaagcgcgccgagacctgggtccaggacgagacgcgctctctcattggccttcgccgcgagatggacgcgctcttcaacacctccaagtccaacaagcacctgtgggagcagatatcggcgaagatgagggagaaaggtttcgatcgttctccaaccatgtgcaccgataagtggcgcaacctcttgaaggagttcaagaaggccaagcaccaggaccgagggagtggttccgccaagatgtcgtattacaaggagattgacgagatcctcagagagaggagcaagaatgtgcagtataaaagccctactcctccgcccaaggttgattcctttatgcagtttgctgataaaggtattgacgataccagtatctcttttgggcctgttgaagctactggaagaccaacactgaatcttgagagaagtttggatcatgatggacatcctcttgccattaccacagctgatgctgttgcagcaagtggagtccctccttggaattggagagagactcctggaaacggtggagaaagtcagtcatgttgtggaagggttatatcagttaaatggggtgattatacaaggcgaataggtattgatggcaccccagaagccattaaagaagcaattagggctgcttttaggttgagaactaaacgtacattttggttggaggatgaagatcagattatcagaagtattgaccgtgaaatgcctttaggaaattacactcttcacattgatgaaggaatggccattaaattacctctctatgatgagcctgaccatatacctgtgcatactgaagataagatattttacactgaagacgatttccgtgattttctgacccgccggggttggatatgtctaagagaatttgacagctacagaaatattgacaacatggatgatcttcgacctggtgccatatatcgtggtgtgagttgaaagcaggtacatggtgtggtcaatgttcagctaccataaaatgtctggagaactgtggtggggactgttcagatctttgatgtatgtgcggcactaacctggaattgtatttgttttaagttttgataatgctgtttatagttttatataggaaaaggaactagtccctttgcacaaattccgttccaatcattggccttaacatgtctgtaaatatgcatttgcagtgagaacatattgtctaattttatagtggatcattttcatcactcttaactctatgtagctaagttggacagatgcatattatgaagcacacacctttcttgttcaactcttttaggtgtccaattaaa

SEQ ID NO: 259 - DNA, 3245 bp, Glycine max
tttggttcctaaaaggctaaaaccctaactcaaggctccctaaacccaagttgaggcctttattgcaacctcactttctccgcaccgcaacctctcgcaaccccttgcgcttactcgcactcacaacctctctctcagcaagttgctttgacaaaatcaataccactcattttaagaagtcatatatccccgtggaatttttggttgagaaaagaagaaggtgtgaagagagatgggaaagaagaacaaagtgaaggaaaatggaggcaaagagcattgctcctcgacactttttgtctccaacttgccctattccttttccaattctcagttggaggagacgttcagtgaggttggacctgtcaggcgttgtttcatagtcactcagaaagggtcagcccaacatcgtggttttggttacgtccaatttgccgtcgaggaagatgctaaccgtgctattgagctgaagaatggtacatctgttgaaggccggaaaattgtagtgaagcatgcaatgcctcgtcctccctgtgaagaacggcaatcaaaaccaaataaagagggcaagacagatgatctcacaaagccaaaagacgatgatgaagacagcacattatctggagcagagaagaacgtttcagttttgaaggaagaagaagtacaagtcagtaaacaaaaaaacatgaggaagcccacagaaacgaaaaaatcagctctctgtgatgatgtaccagatgagggtagttgctcagaaaaacagagggttgctagaactgttatatttggtggtctcataaattccgatatggctgaagaagttcacggcaaagctagagagattggcactgtgtgttcaattaagtaccctctttcaaggaaagatctcgagcaacatggtctcctgcaagatggatgcactttagatgcttcagctgtgctttatacaagtgtaaaatcagcccgagcttctgttgcaacgttacatagaaaagagataggagggggaaacatttgggtgcgccaactgggtggagagggctccaagactcagaaatggaagcttattgtcagaaaccttcctttcaaggcaaaagaaaatgaaataagagatatgttttcatctgcaggatgtgtgtgggatgtatttattccacaaaagacaaacacagatctgtctaagggttttgcatttgtaaagttcacctgcaagcaagatgcggaaaaagccattcaaaagctcaatggatcaaagtttgcaaaacgactcatagctgttgattgggctgtttcaaaaaagatatttagcagtgatacaaataatgctcttgcctcagagaaaggacaacaaaacatgagtgatgaggatagtaccgatgaagattttgagcttgttgataaaagatctggtcaaggagatagtgatacagactactctagtgccatggaggaagaaggcacccctcctgaagataattttgataaggaagcagacattgcaaaaaaggttcttaacaacttgcttacatcctcgagtaaaggaacatctgtaaacaatgattctatgttgatcaaagaaaacaagggatcaagatctgatgaaattgttaaggatgcagatgaaaaagcatctaatgagtctgaaaaggtttcaggtgtttctaagcctgaaatttccagcagaaacaacttattaaatcctaagggaacagaagatgatttgcagagaacagtttttataagtaatcttccctttgaatgtgataatgaagaagtgaaacaacgattttctggatttggggaaatagaatattttgttcctgttctccaccaagttaccaagcgacccagagggactggttttctaaaatttaaaactgtagaagcagctaatactgtaatttcaactgccagggctgcttctgggatgggtattttattgaagggtagaccattaaaagttttgaaggctttggataagaaatcagcacatgacaaggaactggagaaagcaaaaaatgaggttcatgaccaccgcaatctttacttggcaaaggagggacttattcttgagggaactacagctgctgaaggggtttcagccagcgatatgttaaaacgcctagagttggaaaggaaaaagaagacaaagcttcaatctcccaattttcatgtttcgagaactagactcattatctacaacttacctaagtcaatgaatgagaaagaactcaagaaattttgcattgatgcagttgtctctagagctaccaagcaaaaacctgtaattcggcagataaagtttttgaaaaatgaaaagaaaggaaatgttgctcaggagcgctattcacggggagttgcctttgttgaattttcggagcatcagcatgcccttgtggctctgagagttcttaacaataatcctgaaacttttggtcccgaacatcggccgattgtggagtttgctcttgataatgttcaaacacttaaacttcggaaggcaaagctacaatctcagcatcagactcctcaagttgacaacaatgccatggataatgacaaccctggcacggtagaaggttgcaagcctgtaaaggacagaaaacgaaaatctcgagagcatgacgaaccagcaaaggaatcagtactgaatacaaatggtgaatcgggtgttgcagtggcaaatggaaaatccccacaaggacacaaatccaaaagacaaaagggcaacaataagagtaaaaaggcactgaaagaaaatcgagaagcagccttgtccatgaagccaaagaataacgaaaatggccataacaatggtggtgcatcacttgaaggtcaaaacactgccactgactctaatagaagaaaatcagggaataaagatgatgtggggtttagaaaaagaaagatgcaaaaccaagagcaagaagctggccaaaaggttttaaagaaacggcttaagaagaataaaggttcagtagggaaggacgtagtagacaagcttgacatgcttgtagaacaatataaatccaagttctcacacaagggttccctagagaatgatggagagaaaagacattcaaaacagcttaggaaatggttccaatcatagtttactatttcttgatatgaattttgttacttatattattttttgactgcttccgataatttaagccatgtgactttattgctccttttttttctctccgacaataatttaaaatttaagtgtttaacatttttct

SEQ ID NO: 260 - DNA, 480 bp, Glycine max
gttgtttgtggtgtttacactcttaatcccaaccataccctcaattttatatctatataaaaggctctcctcagtgctcactgtcttaccacccagcacaaagaatctgaggttgagtgattaaaagaatagaactatgtctaaagtggtcacactcttcactttggctcttctattaagcttcaatttaatccatgcctctcgtcctaatccttcacttaacgttgtctcttcttcgcatgaggatgttgcagctacaaaggaagagatagatgaagagagttgtgaagaaggcacagaagaatgtttgataagaaggacgctagctgcacatgtcgattatatctacactcaaaagcataaacccaaaccttaatggcatcatcgcaggaccttcttcggggaccaaatatagcaatacattatataaatcaatataccatacgtatatatgtgtacttatttcataaataaatatat

SEQ ID NO: 261 - DNA, 2493 bp, Glycine max
gaaaatctgaagatacaggtgggtttctcatcctaagccagaaatgattgctctgtagtctgtatatattatctgttaaagcaactcttactcactacataaaaaacatgacgcttttggccatcaaaatgactagatggctgactcaggtagcggtatggagatttgttggttttgtttcaactattgttggacttgtttgttacggtctcagctcctccttcaactacctatttggagagtggagcttgttgaagatctttctttacagtggttttagtctcttcatctgccttgggaatctgtttgcaaaggtatgtcgaccctcaacctcaacgagtctccgattcaaagctcattcatcattcttggttttgaccatcacatctgtgtattcctattttgctgacaaagctatgaatggaaaaccagatgtatatagcttgatttcatgtgtttcctttgctatcatgtcgttcagcctctcaaggcaaactcagtgtggatttgaagtggatcttttttattttttccttggatgtttaattgtattactcttgaagattaaatttgcattagctgttgttggagtaggattcagctattcccttattattcttcgttcctctttagacaccgcattgcaccataatcttggggcccaagttgatcaactggctagtactactgatacttctgcagtagtgcttttcgttgatcaactgggccgtactgatattgatgtagcagcagtgcaagatatcgttgtcgaagggcaacgggataatgcacaacgtgataatgctagtatgatgcaacaactcatggcttgcattgaagttcttaggcagggcaattcgaatctcaccaacatgcttttggagcatacaaaagaatactttgatgataaatcagaactagctggtgtggaccataactttgtgattgatgcgctaccatctggaaaaatcaacgaccttgaggaaaccataaagctcatggtggacgatggacttgagaaagagtgctgcgatgtgtactgtaattggcggagggaaagcttagagcagtgcataataaatttattacggttacaagggatcaacatcgaggaaaaacttgaacagagggaatttcaatattacattttaagatggattaaagctgtcaatgttgctcataggatactatttcccagtgagcgacgactctgtgattgcatcttctcgaggttctcttctgttgctgctctttgtttcaatgaggtttgtaggggagccctgattcaattgctcaattttgctgaagctgttgcaagtggaagcccttcagagtggcgtttgtccaaaatccttgacatgtttgagacattgcgtgacctgattcctgagtttcaatcgttgtttcctgagtcaatggtaaaggaagtaatgaaagtccatgacaaattaggtgaggcaagcagggtcattttcatgaacatggaaaatgtgattttccatatcccagagaccaaggtaattgccccggcagatggcagggttcacctaatgaccaaacacgtcattcgctacctcgtttttactagtcgggcacaaaagatcttggagcaaattttagaacaataccccaagtttgctaatgaagtggcaaaatctaattcagtttctgatcagattgatcaagtaattaagcgattggagacagaacttgtcacagtgtccaaaaactacgacaagcctgctttgcgttactttttcttgatgaataattggaggtgtgtagagctagaggcaattaagttgagattaaaccttggttgtttccataaagacacaacaaaagtgcaacaaaacctcgaactttatcaaagtagttcttggaatatggtgctaaactttttgaagctagagaacaacgagctagtggagcctaatgcgaacgcagagtcactgaaaggcagcctcaatttgttcaacatgcacttcaaggatatatgtagcactcaatctagatggcttgcctttgataagcagctaagtgaaaaaataataatgtcactccaacacatcttgttgccagcatatgggaacttcattgagaagttgcaagatgttcttggtatacatgcttctgagtatattaaatatggattgtttgatattaaagaccaactcaaccatttgtttcttggaagcatgccaatgaatcagtatctgaaagacaaggaaaaattgttaaagcttgcataaactgatatataaactttttgttatcatagaagttgttgtaataagatttatgacttgtactacatgcccttctatgttttccttttagaatgcaaacacatttttcctttctgtgttgtttttgtattttagattggcatgaatcaactcgaagtccaagttgcaaaggagaacatactttggttttattgggggagaaataactgtaaaaaaatttgtcgacggctatgttgcgataatt

SEQ ID NO: 262 - DNA, 858 bp, Glycine max
aacccaattaatctttgttttcaattccttatctcaataattctctttctccttcttctataactctcctctgtttactctgtttttttcacaaaacaacatggctgcatacagagaacccatgaacatgaacatgagcgacagagccccggtttctccgcagcaaccacactcgccgtggcattctccggttccgtaccttttcggtggtttagcagcgatgttgggtctcatagccttcgctctgttgatccttgcatgttcctattggaagctctccgggtacctcgaagggaacggggaaacagaacgggacctggaagctggcgaaacggaacaggaccagaaacctgcgaaaccgtacgaggagaagatcttggtgatcatggccgggcaagagaagccaacattcttggcaactccgagcgtgtcttcgagttgcagcactagcaggacctcttcgttcggcgacaacactagcacatgcacctgcgaggagaaccgaaaatcgcttgaaatggccgtcaaagagggaagcgctgccgggactgggaccaccgaaaccgcacacacctcatcagatcagaacctttgaaacatagtcacatgttgggggttttgttttgtagttaggttgctttcgtgaaaaagcaaagctcgtgacacctgggtgtctctctaggttgcatgttcaacaattggtgctgatatggggattctcttctcttctcttctctttttattttttcttttttctttttccttcttcttcttctctttcgattctcgtctatacattatttcgggaatgtaaattctttgaggtggaattgagacatttgctgtttcacaaatcac

SEQ ID NO: 263 - DNA, 1431 bp, Glycine max
atttacttggtgaaattgaagaatcaagcacaaaaaaaaatccaaaacagtaccttgccgtttattatcacacaagacagcattacccttctattgttatcatcgacattcttaactcttaagaactgattcaccaacgacccctctgaatttcagaaactatcaatgaagggggaagtgcagcttcagcctccagcggttatgcaaaaccctagtgattcggaccctttgctccataaccaggaggaggaggaggaggatgagtcaccgggaagctctggtgagatcaagaatgaggaagaagacgttgaggctggattactcccctgttgtcgaatttgcctcgaaagcgattccgacccagaggatgaattgatatctccgtgcatgtgcaaagggacccaacagtttgtccatcgttcatgtcttgatcattggcgctcagtaaaggaaggatttgccttctcacactgcacaacctgcaaagcccaatttcatcttagagttgaatcgattgaggacaacacttggcgtaaaataaagttcagactttttgtggcaagggatgttttccttgtttttcttgcagtacaaactgtgattgcagctattggtggctttgcatacatcatggacaaagatggttccttcaggaactcgtttgatgatggttgggataggatactgtcaaggcatcctattccattttattattgcattggagtgctggccttctttgtattgattgggttttttggcctcatactgcattgctcctccctcaatagcaatgaccccagaatggctggctgtcaaaactgttgttatggatggggcatcttggattgctttcctgcatcaatggaggcgtgctttgcccttgtggttgttttcgttgtcatctttgcaattcttggtatagcttatggttttcttgctgccaccatggccattcaaagaatttggcagaggcattaccatatcctcaccaagagggagcttacaaaggaatatatagtagaggatcttggtggctgttatttcccaccaaagttggacccagaacatgaaggtcgcttgaaaatgctcaagctcttgtaattacggagcacacacctgtaaaaatgtttttgaatgatttataagtatcaagttgatgctttatttgaccgttacagtctcatgattagcaaccttgtttgctagtgcttggaaatggtttatatcattgttttttttttaaacaaagaatctggatccttgccagattctgtatactggaaaatgatgaaaatatatgctaatatttgtccatacaccaggatatacctataatgtatccatcgcaattgtcatatgagtaatgaaaagtggatacctcttcactccaaacagcttattaatacatataatttctgtctatcttttttt

SEQ ID NO: 264 - DNA, 3228 bp, Glycine max
tccgtagtcacctgagtgactctctttcccgcttccaactctagttggagaaacaacagcagcagcagtagcagctccttgcaacccccccaacgcctctcaacattattagggtttttctttttcagctattaaagttgcactctctcttctcttaacaaagaatggccacttgcacttctctgtctctttgtcctcacactttctgttgccgccaccgccctcaccctactcgccgttcccttgcgtcgtgctctctctccccttcttccctcccagatacggatggacctaaagtactgcgtaaaagatctagaagaatagaaggtcctagaaaaagcatggaagactctgttcaatgcaagatggaagaattctacgaaggacaggatgggccacccctcagagttcttcccattggtgggttgggtgaaattgggatgaattgtatgcttgttggcaactatgatcgctatatcctcattgatgctggtatcatgtttccagactatgacgagcttggagtccaaaagatcatacctgatacaacatttataagaaaatggaagcacaaaattgaagcagttattataacacatggtcatgaagatcatattggtgcattgccttgggtcattccagcattagattctcatacaccaatttttgcatcatcctttacaatggagcttataaggaaacgtttgaaggatcatggtatttttgttccatcccgactcaaagtatttagaacgaggaagaagtttatggctgggccatttgaggtagagcctatcacagtgactcattctattcctgattgctgtggactagtgctccgttgttctgatggtaccattcttcacactggggattggaagattgatgaaacgccattagatggtagagtttttgatcgtgaagctctagaggaactctcaaaagaaggagtcacattgatgatgagtgattcgacaaatgtactctcacctggaaggacaaccagtgaatctgttgtggcagatgcattattaaggaatatttcagctgctaaaggaagggttataacgacccagtttgcatccaatatacatcgtcttggaagtgtgaaagctgctgctgatttaactggtagaaagttggtatttgttggcatgtcgttaagaacatatttagatgcagcttggaaggatggaaagtctccaattgatccatctactctggtgaaagcggaagatattgatgcttatgcgccaaaggatttgcttattgtgacaacgggatctcaagcagagccacgtgctgccttaaatctagcatcttttggaagtagtcattctttcaagctgacaaaggaagatactgttttgtattcagctaaggttatacctggtaacgagtctcgtgttatggaaatgctaaaccgcatatcagagattggatcaactatagttatggggaagaatgaatgtctgcacacatctggtcatgggtatcgtggagaattagaggaagtacttagaattgtgaagccacagcattttctacccatacatggagaactcttgttcttgaaggagcacgaattacttggaaaatcaactggcattcggcacacaactgttattaagaatggagagatgcttggagtttctcatttgagaaatagaagagtcctttctaatggttttatttcacttggaaaagagaatttgcagttgatgtatagtgatggcgagaaagcgtttggtacatcaagtgacctctttattgatgaaagattgaaaattgcattagatggcatcatagtggttaacatggaaatatttcgccctcaaaatttagacagtccagttgagaacaccttaaaaggaaaaataagaattaccaccagatgcctgtggcttgacaaggggaagctgttggatgctctccataaagctgctcatgctgctcttgcaagctgccctgtaagctgtccactggctcatatggaaaaaattgtgtctgagatgttgagaaaaatggtgaggaagtacagtggcaaacggcctgaagttattgccattgccatagaaaatcctgcagctgttcttgctaatgagataaacacaaagttgtctggaaaattaaatgtggatgggatgtcggcattgagaaaagtggtggatggacatgagaaagagaatcagagaaccgaaatgcaaataagagatcgtattgatgtaggtggtctactacctacaaaagacaatgctatctcaagtggagctgaggatggcttgtctgatgcggaggatccaaatgattattttaaaccatttgttgaatcctctccagttgagaagtcaattaaaactaacaatggttatgttccacgaaaggagaagtcatccccattgaaggatgactgttctgaagacactgaagaatgcaattctgtaaatacatcagattctgaacccaaatcttcaaaatcagcaaagagaaataaatggaaacatgaagaagttaagaagctgattgatatgcgtggggaactgaatgacagatttcaagttgtgaagggaaggatggccctctgggaagaaatatctcagaatttgttggctaatgggatcagcagaagtcctgggcagtgtaaatctctgtggacttctttgttacagaaatatgaggaggtgaagaatgaaaagaagaacaagaaaaaatggccgtattttgaggacatggaaaggattctagctgataacaagacactagaaacaaaatgattataaaggtgatgcaccagacaagaaaaatttgcaagagttttctgcattatgattggtaatatgtctgagcatggtcgctgggaaggtaatccatcagttgcattattcttgcatcttgaactccttcattgaatatccatagttttgtgaggagatggacagcgttaaatgcattgacattttacattaacacaagttaatgagggagactatgctggttcaggggatgatttatccccttcctcaaaaggtaactacctacccagtgacagcattttagggtcattttgatgatattgattgacatattgaacaactattttaatgatagtgaagggttaatataatgtaacgagaccaaagtacattttttctgttacttataattaatttcattattttgttagtggcgcgtttggtatgaaacaacgttgcattttgcatattggcc

SEQ ID NO: 265 - DNA, 5636 bp, Glycine max
aaggaaccaaaagtagggagaaaacgagaaactggcgtggaagagcaaaggtatgtgagagagtcttttgacacgacgaagaccaaaaccatcgcagaggcaaagatagattactaaacccacaaccacactcacacacacacactcctctctcagaaaaatacacccttttttctttcacttcacttagggtttcatcgctattgcttcctcatgaagaaatcctcctaccctaatcccacccctcgccgccacgattttcaccgtccgccaccacccacccacggctgcggttgggctccccgccccgcctaccaccgcccctaccaccaatggaggccccgattccacccccacgccgcccgcatcgaccgccctccggagccctatttcagggtggagctccgcctcggcagcagccccctccaccgcgacgacgtcgaggccctgatcgacgaatgccactcccggcacgacaccttcactttctaccccgtcgacgacgtcgccgccgttctcagttaccggagctgggagcaggcgcgagacgccgtcgtttggttctgggaggcgcggctcgcggagaagcacgatttcacgccgacgctggattccaacgtcgtcgtcgtcaaggacgatgtggattgtcgccttcgaccggtgttcgcgaggcacgtgaaagggttgacggaagggaaggaggtgaagcggtggatggaggagagtgaacggttgtcgaaagaaatttctcggctttcgagttcgctgagtaagcccttgcgacttggcgtgcacaacgagttggtggagaagaagaaagggcttgttgatgagaagaatcttgttgaaaggaggttgaaggagtttgagtctgcgatgcagtgtttattgaagtatttggagggtggtgttgacgtggagggtgtgactgtctttaggtttgatggaggttttgattggaagcggattcattgtctgatcaaaagggagtgtcggaggcttgaggacgggttgcctatttatgcttaccggagtgatattcttcaggaaatacattatcaacagataatggtattaatcggagagactggttctgggaagagtacgcagttggtacagtttcttgctgattcaggcattggtactgacgaatccattgtgtgcacccaacctcgcaagattgctgccaaatcagtggctcaaagggtccaggaagaaagcattggatgttatgaaggccaatcaatcaaatgctgttctacattttcatcctcacgtgagtttgattccaggatagcattcatgacagatcattgtttattgcagcactacatgagtgataataatttatccggggtctcgtgcatcataattgatgaggctcatgagaggagcttaaatacagatttactgttgactttgttaaagagtttactttgtaggagggttgaaatgagacttatcattatgtctgctacagctgatgcaaagcagctgtctgattacttttttgcttgtggaatttttcgtgtgcttgggagaagctttccagtggatatcaaatatgttccttctgactatgcaggagattctggttctgctgttgttgcctcatatgtttctgatgttgtcagaatggcaactgaggttcacaaaactgagaaagagggaactattcttgcctttttgacctctcagatagaagtagaatgggcctgtgaaaagtttcaagctccctctgcagtagctttgcccttgcatggaaaactttcttctgatgagcaattccgtgtttttcagaactacactggaaagagaaaagtgatattttcaacaaatcttgcagagacatcacttacgattcctggtgttaggtatgtgatagattctgggctggttaaagacagcagatttgatcctggtagtgggatgaatgtacttaaggtttgctggatcagccagagctctgctgatcaacgggctggtcgtgctgggaggactgagcctggtgtgtgctatagactgtacacggaagctgattatcagtctatggacctaaatcaagagccggagattcggagagttcatcttggtgtagcagttctgaggatccttgctttaggagtgaaggatgtgcaaggttttgattttgtggatgctccaagtcctagctccatagatatggcaatcagaaatctaattcaattaggagccattgaactgaacaatgatgttcatgatttaacttctgaaggttggtgcttggtaagaatgggaattgaacctaggctgggtaaacttattcttggttgtttcaaacatggtttgggtagggaaggtatcatccttgctgctgtgatggccaatgctagtagcatcttttgcagagttggcaatgaatttgataaacaaagatctgattgtcttaaagtgcaattttgccattgtgatggtgacctctttactcttctctccgtgtacaaggaatgggaagctttgcctcgagaaaggaagaacaaatggtgttgggaaaacagtatcaatgccaaatccatgaggaggtgccaagacacaattttggagttagaaacttgccttgagcgtgaacatgacgttgttactccgagttactggcgttgggacccttgtatgccctctaatcatgataagaatttgaaaagggtaatactgttctcacttgctgagaatgtagccatgtactccggctgcaatcaacttggttatgaagtggcacaaactgggcaacatgttcaactacatccatcttgttcattgcttgtatttgctcagaaaccaagttgggtagtttttggtgagcttctttccatttccaatcaatatttggtctgtgtgagtgcatttgattttcaatcattatacgacctttgccctgctcccctgtttgatgtatccaaaatggaagagcggaagttgctaatgaagacactgtctggtcttggctgtattcttctcaagagattttgtggaaaagccaactgcaatttgcttgctcttgtttcacgtataaggaaagcttgtatggatgaacgcatcttcatcgaagtgaatgttgacaataatgaaatccacttatatgcctcttcaaatgatatggatatagcccttgggttggttaacgatgttctagaatatgagagaaagtggttacgcactgaatgtatggataagtttttgtatcatggttctggtttctctccacctgtagctttgtttgggtctggtgctgagataaaacatttggaacttgagaaacgttccttgagtgttgatgtgtgtcatccaaacataaatgaaattgatgacaaggagctcttgatgttttttgagaagaatacctctggttgcatctgtgctgtgcacaaattcacaggcaatacgagggatgaagatagggataagtggggcaggataacatttatgtccccagatattgtcagaagagctgctgagctagatggacgggagttttgtggctcatccttaaaagttgttccttcacagttgggaggggataaaacattttcgttccctgctgttaaagcaagaatttcttggcctcgtaggcttagcaggggatttgccatagttaaatgtgatataaaggacgttgattatatcttgagagatttctataaccttgcagtaggagggaggtatgttcgatgtgaagttggcaaaaagagtatggacagtgttgttataaatgggcttgacaaagagctttcggaagctgaaatatcagatgtgctaagaactgctacaactagaaggattttggattttttcttggtgagaggggaagcagttggaaatccaccatgcagtgctttggaagaggcactcctaaaagaaatttacccctttttgcccaaaaggaaccctcacattagtccttgccgagttcaggtgtttgcacctgagcccaaggatgctttcatgagagctttaatcacttttgatggaagattacatttagaggcagcaaaagctttggagcaaattgaaggaaaggtgttacctggatgtctttcatggcaaaagataaagtgccagcagttgtttcatagctcccttacatttcctactccagtgtatcgtgtgattaaggaacaactggatgaagtacttgcaagcttcaggaatttgaaaggtcttgaatgcaacctggacaggacatttaatggttctcaccgagtgaagataacagcgaacgccacaaggacagtggcagaagttagaagacctctggaagaactattgagagggaaaaccattgagcatgacagcctcacccctgcagttctccaactcatgttgtccagagatggctttagtcttaaaaactcattgcagcaagagactggaacttatattctttttgacaggcacaacttgaatttacgggtgtttggttccccaaacatggttgctttggctcaggagaaggtgatacagtccctcctttctctccatgaagaaaagcagttagaaattcatctgagagggagggatctacctcctgatttaatgaagcaaatgattaagaattttgggccagatctccatggattgaaagagagggtacctggggtagatcttacactgaacatacgtcgccacataatcattcttcatggtagcaaggagttgaaaccgagagtagaggaaatagtttttgagattgctcgttcaagccatcatttggttgagagatttggcaatggacccagttgcccaatttgcttgtgcgaggttgaggatggataccggcttgaaggctgtggccatttgttctgccggatgtgtttggttgagcaatttgaatctgctattaaaaaccaaggcactttcccggtatgttgtactcacagggactgtggagatcccatcctgcttacagatttgagatctcttttatttggtgataagttggaggatcttttcagggcttctttgggagcttttgtggcaacaagtgggggaacttacaggttttgcccttctcctgactgcccctcaatttatcgagttgcagatcctgggtctgctggcgagccatttgtttgtagggcttgttattcagagacttgtaccaggtgccacttagagtatcatccttacctttcatgtgagagatacaaagaattcaaggaagatccggattcatctctgatagaatggtgcagagggaaagaacaagttaagtgctgctcggcatgtggatatgtaattgagaaggtagatgggtgcaaccacgttgaatgcaagtgcggaaagcatgtctgctgggtttgtttagagttctttagtactagtaatgactgttatgaccatttaagaactatacacttaaccatataaattgccatttgcgtaccatttttctgagacttgtaattaagcctagcggtatataataacactgtacatggaagtagcaaattgtacagctttcttaaactaatgtatatatatcacagcagttctgcttcttacttgtatatctaattctaatataagttgcacggtgtatataggttgtgacttttctgctatgcaagctctacattatgtgttcaaaagcagttcaatac

SEQ ID NO: 266 - DNA, 1397 bp, Glycine max
ggtattgttttgtgttttatgaattatttgatgggtgaagaaggagaagtggtgagaaagcaaggacaaaggggtgttggtggagataagtggtacttgtatagctgcttacaagactgtaaatattggtgctgtttaatacacgagactagttctctttcgatggtcccttttgagtgaaaaaccttgtcttctcagctttctttggagagatcttaaagacattgactaacaacaataaagtggatcaatcaaaagacttacttcttcttctaacaacaataagatcacatctttcccactcatgaagagacttagcagctcagattcttccagtgccctcatgacaatttgtccatcaacagaggaacatagtccgaggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagaacttgggttgcaacctagacaggtagccgtatggttccaaaaccgtcgagccagatggaaaaccaaacaattggagagagattatggtgtactcaaagccaattatgatgctcttaagcttaactttgacaccctcgatcaggacaacgaagccttacgaaagcaggttaaggaattgaaatcgaggctgctgcaagaagagaacacaggaggaagcggtgtttcggtgaaggaagagataataacgaggcctgcagactcagaagacaaaacgatggaacaaagtaagagtgacccatcttctgaaacctcaaatattaatcctagttcggagtcggaggaggatcacttgaactacgagtgtttcaacaacaacgacgactgcgtcggaggaaccgccgcatcgcttttgcaagtggacttcaaagacggttcttccgacagcgacggatcaagcgcgattttgaacgaagacaacatgtactctcccttgaaattcaacaattgctccatatcaacctcgccgtcatcgtcttcgatgatgaactgttttcagttccagaaaccgtatcatcaccacgcgcagtacgtgaagatggaggagcacaatttcctcagcgcggatgaggcctgcaatttcttctcggatgaacaagcaccgacccttcaatggtactgtccagaacagtggagctgagaaaagaaacatggaaattaaaccgcttttagaaatttttgtttgaaggtagaaaatgaaatactgtgcaaaagaaaaagagagaacagagatcaatggctgcatggcgtggggtcggagatgg

SEQ ID NO: 267 - DNA, 846 bp, Glycine max
tttatattccaatctctacatcgcattctcgcagtacgatcagaaaagacaaatatttcatttatatatttttttttcacccaaaaaacaaaatccatgtttttttgtttaaaacggtgtagtatcataattcataatggcttgcttgggttaaaatatttagaaccctaagccactcaccgatagagaagccgccgccaccttcactagtcaccgtcgccgccgccgccgccttcaccagtcaccgtcgcattcctctttcagcaaaaccccttcttctcactcacactctcacacccatattctcaaacacacaaaataacaaacacaacacagcaccaacctcggtgataacaattcaaagaaacacagaaatacacagacacgaacaatggctggtcgattccgtgagctgatgaagaaatatggaaaagtcgcactcggcgttcacttgagcgtctccaccgcctccatcacgggtctctacgtggccatcagaaacaacgttgacgtggaatccatcctcgagaagttccacatgggcaccgtctccgagggacaaaaccctaaccctaatcactcagacggcgccgccgcgccacccaagaaccggacggctcagatcgccgcctccgccggcggcgccttcacgctggcgatcctctgcaacaaggcgctgttccccgtgcgcgttcccataaccgtcgccctcactccccccatcgcgaggttcctcgcgaggaggaagatcatcaagagcggcgtatgaattggattcggtgacgagaatcgtgagattatatttatatttgtataccttgtagcatttttgggttttgtgagacc

SEQ ID NO: 268 - DNA, 1423 bp, Glycine max
acgacgttgagcgttctctctcttcgttcagctcaatctgggatacgaagcttgcaatagctgcagcatctgaataggaatggattatatctgtctttttgtcaccttcactgcgattgcgctcttagggtttgtctttgtagtgttttttgaagcatataaaagaagaaacaaccatcagcatatcgaagttccggctatttttgaagatcctagctcattgaaacaggttccttgcccacatattgttgatccagccacaaagtatatttctttgattatccctgcattcaatgaggagcataggcttccaggagctcttgaggaaactatgaattatcttcatcaacgtactttaaaggattcttcatttacatatgaggttgtaattattgatgatggaagtgctgatgagacaaaaagagtagcttttgaatttgtgaggaaatacacagtagacaaggtaagggtcatccttctaggaagaaatcatggcaaaggagaagcaatcagaaaaggaatgatgcattcacgtggtgaactacttcttatgcttgatgctgatggagcaactaaagtcactgacctagaaaagcttgaaaatcagattcaagctgttgccaaaagggaatatcaccatggagattcaagtgatagtgatcctagatttagaatatctgatgtcccagctgctgtgtttggctcaagagctcatctagaggagaaagctttagctacaaggaagtggtaccgcaattttttgatgaagggcttccatcttgtggttctcttggctgctggtcctggaattcgtgatacacagtgtggtttcaagatgtttactagggcagcagccaggaagcttttttcaaatgtacgcttaaaaaggtggtgctttgatgttgagttagtctttctatgcaagtggtttagaatcccagtttcagaaatttctgtgaattggtctgaaattccaggatccaaggtgaatcttctgagtatacctaacatgctttgggagcttgtgctcatgtctgtggggtacaggactggtatgtggagaatttctaattctacctgagcgagcgtggatgatcaacttaactgggaagagaagtggcattttcctatctaaacaagagtcacctcttacaagagaacatatactctcatgccgggcttaagggacaatcatgcaatatttaaagtttgtaggactaaccataactttccgggttattcccttcagtttgggatcatagaggcttttatcctttttacttttagtattgctatttctaccaggtaaaaatatattcaacattatgttgttactgttggctgggaatagttttcaatcacattggtttgtatttttcttaatcaaaatattatatagataactttgtattcctttcattcc

SEQ ID NO: 269 - DNA, 2620 bp, Glycine max
gtgaacagttttgggttgcgttgcgtcgagggactcagcttcttcttcttcttcttcttcttcttcttcttcttcttcttcctcttctcgttcttctctcatccattccatggagcttcagaggcgtccagatcagtgcctcccggtgaggaaagggctgaagaggaagctagaggaggagttcgatgacgacccacagatctccgctcctcccaccggtgacgctcgcgacgccctcctctctgacgttaaggaacaggtttccctcctcgattccaatttctcctggaacgaacacgatcgtgccgccgccaagcgcgccacgcacgccctcgccgatctcgccaaaaacgaggaagtcgtgaacgtgattgttgaaggaggcgccattccggcgttggttaagcatctccaagcgcctcctctggctgaaagcgaccgtttgccgaggccaatgccgttcgagcacgaggtcgagaaagggagtgctttcgcgcttggacttctcgctgtcaagccagagcatcaacaactcattgttgacagtggtgccttaaaacatcttgttgatcttttgaagaggcataagaatggcttaacatctcgtgccattaatagtctcattcgtagggctgcagatgccatcactaatcttgctcatgagaacagcagcattaaaactcgtgtcaggaaggaaggcgggattccaccgcttgttcatttgcttgaatttgcggatacaaaggtgcaaagagcagctgctggtgcattgcgaacccttgcttttaaaaatgatgaaaataaaaatcagattgttgaatgcaatgcccttccaactcttattctaatgcttcgctcagaagatgctgctattcattatgaagcggttggtgtcattggaaatctggtccactcttcccctgatataaagaaagaagttcttcttgctggagccttgcaacctgttattggactacttagctcctgttgctctgaaagccagagggaagcagcattgttacttggacagtttgcagcaactgattcagactgcaaggttcacattgttcagagaggtgctgtccgacctctgatagagatgcttcagtcctctgatgttcagctaaaagaaatgtctgcctttgcattggggagattagcccaggacacacataaccaagctggtattgtgcacaatggtggtttgatgccattactgaagcttcttgactccaaaaatggctctttgcaacataatgctgcatttgctctttatggccttgcagataatgaggataatgtgtccgattttattagggtaggtggaattcagagactgcaggatggagagtttattgttcaagcaactaaagattgtgttgcaaagacattgaaaagattagaagagaagattcatggccgagttctgaaccatttgttatatctcatgcgagtttcagaaaaggcttttcaaaggcgagttgctttaactcttgctcacctttgctctgcagatgatcaaagaaaaatatttattgattataacggtttggagttgcttatgggacttcttggctcttataaccccaagcaacaacttgatggagctgtggctttatgcaagttggccaataaagctatgactctgtctcctgtagatgccgcacccccatctccaacaccccaggtgtatttgggagagcagtatgtaaacaatgctaccttgtctgacgttacatttttggttgaaggcaaacgattttatgctcacagaatctgcctgcttgcatcttcagatgcatttcgtgcaatgtttgatggtggttatagggagaaggaggcacgggacatagagattccaaacattagatgggaggtttttgagctgatgatgagatttatatacactggatcagtagatatcactcttgatattgcccaagatctcctccgagcagctgatcaatatcttttagaaggacttaaaagactatgcgagtacacaattgcacaggatatatcactggagaatgtgtcaagtatgtatgaactttcagaggcctttaacgctatatcattgaggcacacatgcatcctttttatattggagcactatgataaattgggtggaaagccaggacactctcaactgattcagcatataatacccgagatccagaattactttgttaaagccattacaaaggccaattccaatatccagccgtaatgtgctgttctactattgacatctaacccgttgcaatgtacataatgtggttgatgttctttttgttgaacctgcgaaggaagtctcctggatcaagtacagcatggcttaaaaaaaatatctaacatcacgtcatgtacgttcatttctgatgcagtgtaagtcccttctagctgtaacgtcattgtcttagatatagcaaatatgaccttcacgaacattgttttttactcgtgcaaatattgtgatggttgagactttctctttctcaagcatctaatgttgagtttatgagtagtataggttgcccaagcatctaatgtatatatgacaattagatagttgtcttcatattatataatgaaatcttaaagccttttcactggatgt

SEQ ID NO: 270 - DNA, 1359 bp, Glycine max
aaaacaatgaagctgagcgactttgtgggaagagtcaaagaagaagcgcagttaatgaaggtataagactgcagaaactgagagagaaagagatctggaagagatgagtgaagcgcagaagcaggtttggaaaggggccattcctctccagattcacctccacgaatccgaagtcaccactctccctcctcctccacccgctctcgtgttggcacctcggatagggtacttacctttgctgatttcgctcttgaagcctcagttcagcaccacgcttccccctggagtcgacaccatttggtttgagtacaaaggcctccctctcaagtggtatatacctactggagttctttttgatcttttgtgcgtggagccagagaggccgtggaatttaactgtacactttagaggatatcctagtattgtattgcttccctgtgaaggtgaagacagtgtaaagtggagctttattaactcactgaaagaggctgcatatgtaataaatgggaatagcaaaaatgtgatgaacatgtctcaaactgatcaggtggagctctggggctctgttttaaatggtaactttgaaacttatcgacgggtggcatctaagcttaagcttggaacttttgaagatgaatatatggaaaatgttagttcagtcttggttaaatcttcacaaagtacaggggatactgatgttactggacaattgaaaactggtaggattcctgttcgtttatatctgtggactgtcaatgaggagtttgatgattttgaagatgctccacaaattgataattgggacaaagtctcatatatcaatcgacctgttgagatttataaggaagatggtaaatattttagcttaaatgatgcggttaaaagaatattgcccgagtttttcctggaaaattcctttgtaactgatggagatgcaaacattaaccaaagtggagaagagggagaaagttcatctgatccagggtcatgttgcaacacacttgagattgctgaaatcaaacttgtacgcattcaaggaatagaaccaattttagacatacctttctcttgggtggttaacaacttgatgaatcccgagtattttcttcatatgtgtgtttgcttaaaagtttcaaaggccaatgctgtacaatagggataaatttagttatcttggacatacattttactagaaaaatcagaaggtgcaattcttttgtacatatatgtacagaacgatttcatatcatatattcatttcatgattcgattgctatttcccacttccaagtgtaataaatgttgacagatgattatttttcaaatccaatcaaggataccgtttccctgccataattt

SEQ ID NO: 271 - DNA, 663 bp, Glycine max
ataattttggaaaggtttgaagggaaggtgataagggagcagcagagagagtaatactgggtggacagaacagaacaggatagttatctgaatggatcttcatcttagtgtgcggcttcctgtttcacttccctgcttctctcactctcagaatgtgaagttacaattgcaaagaaggagattatccaccgtttcctctgccctggctgagactgcagcgtcaatggcagtagctgtaactgtcgttggtgcagcagctacccttcttgtaaagagatccaaaacttctgagtcatcacagattcaattcaaagcatgtgaagattgtggaggttctggtatatgttctgaatgcaaaggtgaaggattcgttcttaggaaacgttccgatgaaagtgctgagaaggcaagagtgcaagctaagaacatggcaacccgattcacagcgggacttccaaagaaatggagctattgcacaaagtgctcttctggtcgatcctgttcaacctgtggtggcagtggaaagctaagttactagtttagcattacatgttgtctacccagttcaaaagacagttagttcctcagcatttcacatgttcttgtttaaatcacggttcagaatattgaggcaacatattgaactcaagctgatgagtgatt

SEQ ID NO: 272 - DNA, 2522 bp, Glycine max
aaagcattgtccactcgcggcagtgggaatcgaattgcgcgtggtacttccttctgttaattccgtttccattcattggacgctttcgttttgttggtctctctcgtggttgtctttcaccgcattatagccaccgccgttgctgtttgccactcttttttctttttattcgtctcttcactcttcatttttttattattcacaacactttctcctccttccaattccatcgtcactaagttacttaagtttggtagcatagttctgcttctgatttagattccgcataaagttgttgcttacacgtgcccttcttctcttatatcttaaccattgccctctattgccttagcctatgcttattcttttcaccttctaaatattcattgcccagaaccaaatcactttctttttttcattctctgtccttaaagttcgttgctttacattacagggtgtccaaccaaagctaccctcaaatctcaatgctttctaccaacaacaacacaacaagtgcaatgattctggagggttgcaggaggataaaaagtttctgatatttttatttttttgggtattgatttggatgatcctctcctttgagttgctgcttcaaggagagagagaattatttgggatgaaagatgctagtgttgatctgggtttttgctggaaggaagaaaagaaggttctgaattctgatatatagtaatcaagagtcaaaactgaggattcgttaggttggtgttgaatccagttccaatggacacaccaaatgcacagccgcaagctgcatcagcaagcacgccaaggaaaaaaatgacaaagcaattgacaggtaaaagggatgatacacctttgcactctgcagcaagagcagggaatatgactgttctgaaagacacggttggtggcactgaagagggtgaactacgtgtgttgctgacaaagcagaaccatgccggagaaacggttctttatgttgctgctgaatatggttatgttgatatggttagagagctgattcaatattatgatcttgctggggcgggaattaaggccaggaatgggtttgatgcactccacattgctgccaaacaaggggatttagatattgtgaagatcttaatggaggctcatcctgaattgtcaatgactgtggatccatccaacaccacagcagtgcacaccgctgcattacaagggcatactgagatagtgaagcttctattggaagcaggtagtaatctggcaaccatttctagaagtaatgggaaaacagctttgcattctgctgcgagaaatggacatttggaggttgtgaaagcgcttctggggaaggagccttcagttgcaacacggactgataagaagggacaaacagcaattcacatggcagtgaagggacagagtcttgaggtggtggaggagttgataaaagctgatccctcaacaataaacatggttgataataagggtaacacagcattgcatatagcaaccaggaagggcagggctcggattgttaagttgcttcttgggcagacagaaaccgatgccttggtagttaacagatccggcgaaactgcactagacacagctgagaaaactggtaactctgaagttaaagacattctcctggaacatggtgtccgaagagccaaagccataaaggctcaaccaggaacagccacagcccgagagttgaaacagactgtgagtgacataaagcatgaagtccactaccagttggaacacacgcgccaaactcgaagaggtgttcaaggcattgccaaacgcatcaacaaaatgcatactgaaggactcaacaatgcaataaactccacaactgtggttgcagtcctcattgccacagttgcctttgcagcaatcttcacagtccccggccaatttgctgatgaaccaaaagacatccctgcaggttcaggaatgaccattggtgaagcaaacatagccccacaagctgcatttctcattttcttcgtctttgattccatcgccctcttcatttctctggccgtggtggtggtgcaaacctcggttgtgatcatagaaagcaaagcaaagaagcagatgatggccatcattaacaagctaatgtggttggcttgtgtgcttatttctgtggccttcttggcactgtcatttgtagtggtggggaaggatcagaagtggcttgcaattggagtcactatcatagggacaactataatggccacaactttgggcaccatgagttactgggtcattaggcatcgcattgaggcctcaaacttaaggagcattcggaaatcttcaatgggaagcaggtcaaggtctttttcagtatcagttatgtcagattctgagctactaaacaatgaccgcaagatattgtatgccatatagaatcactaataaagccttgttgccctttcatttactctcttttttccacggcctgatggatttatatccaactaaagtgagtacaatcatactagcttgatgtttaatactct

SEQ ID NO: 273 - DNA, 1840 bp, Glycine max
cacgcggtcccaacacacaaagaagaaggaaccaacgtaactgccaggaaactaaaccaaaacctcaaattatcaaaactcgttctcacacacactctcactgtgcaatggcctttctcttccaccgccatcatctctccaccctccaccgccctcacacccttttaatatcctcactccccccaccacctcccactcttttcttttcacacccctcctcattcttcttcttcacactaattcagaatcaacatgaacccaaatgatgctaactctcctaagccgttggagattctgcagatgaaccctgttcctccgtttttgtccaagaccttcgacctcgtcgacgacccgactctcgaccccattatctcatggggctccaccggttttagcttcgtcgtgtgggaccctctcgagttcgcgagaatcgtccttcctcggcatttcaagcacaacaacttctccagtttcgttcgtcagctcaatacttatggattccgcaagattgacacggacaagtgggagtttttcaacgaagctttccagcgagggaagaagcacttgctgaagaacatccaaaggcgcaggtcatctcaatcccagcaggttggtagctatattggaatcgaatgttctactgaggcaggaaggtctgatgttgagattgagatagaaaggcttaggaaagaaaggactatgttgatggaagaggttgttgatttgaaacaagagcagcgaagaatggctcaccgcgcaggagaagtgaatcaaaggctccaatccacagaacaaaggcagaaacaaatggtttctttcctggtcaagttaatccagaaccccgcctttttagcccgccttaggcatgaggagcaaaaagaaatagattctccaagagtggtaaggaagtttgtcaagcagcaccaacatgaaactggaacagcagaaactctccaagaagggcagatagtgaggtaccaacatgattggagaaatataggcatgtcttccgaaactccaaaactaagtccagtttccattgaacagtctcctcactacctttcacagggtttggcaggagaagtgagtgtaggcgcagaagatcttactgctcaaatagagaatattgtatcaaatgacttggctgcagtgcacgggatcacagtgtctcaggaaattatgattggagaaggattatctagctttggagctgaagacccccttttcaaagggaaaagtgtcatgagtccaattctagaagttcctccagagtattttgcttccttcccagagggtttgaccaaggggaaagactttcaagatttttctgctcttggaactgaaggcatgataaagctagaagatatatgggactctggccttaatgttagtggtgctgcttcaggtagtgggaatgagctgtggagcaatcatgtcaactatgaagagtttccagaatttggagtcacaagtggtatgtctgactcagacatctgggatattggcttaggaagtttgggaattgataagtggccaactgatgaaccttctcttggtgaaacaaatggtcaagctggtcaaccaaaagaagataggcctaagaattttggtccatagggtttcatttgctcctgcacttgttgccctttggttacttgctatatttatagttcctaggaggcatattattgaatcatttgatttataaatagtattcattcacctgcttttattcatcatttactttcaatttttttattcttttagatgaattctttaactgtccatgtttttcttcgtaaattctaattgtgtaattattgataacttccactcaagt

SEQ ID NO: 274 - DNA, 3673 bp, Glycine max
ttttctaaatcggttgtttcacaatcgtataattaagcgaaacaaaatctcctaaaactgaaaccatgaaacgccgtgttttgtactcaatggaccaatctcatagtcacagtagtacgatgctgtgtccttcacagtcagtgcaccaccttgtaatcgcacgaaccgctgcttttcttgttggaccgaaccggagacacacaaacaacaagtgctttagagatcgtgtgttatagtggcagcttggatatctgcaattcaattcaagttagtatgttcttatatacgtaggaaattgttggatcctttatgttatatacggataaaaaagccatttccacctaacactgcaaaatcttgcaatctaagtctcatctaagtggatcagatatttagtatttcataaggaaccaaagcatccatccctaacttccgatccttcatccttacttaggcttccattccaattcaagcattactaatctgcaagataaagcaaaaagtactacagaggcaagagaaggcaaattaagaggaatttcaaaaaagttgttttgttttttttgggtattgggtttatttgaaagagtgtaggttgatgttacttgggtatataattcaattgatcaaaaagtttggataataataataatatatccaaatggaggatcaagttttctggttggccacagtgttatccgtagccttcactcacaaattttctgagcaagagtgtatataatgaagaggttctctgcctgctgcttcacaagcagaatctccaagtttcactcccactggaagcacaaccattctcagtctcagatcatggcaggaaacatttctggtccaagtgggagcaagggtgctaatattttacttaatcatgacttctctagtgggctgacctcttggcatctcaatagctgcactggctatgtaatttcatccaaatcaggtactcaaggaggaatcccaatggatttggatgctaattatgctgttatcaccgaccgaaaagaatgctggcaaggtcttgagcaagacatcaccaacaaaatttccattggttccacttacacggtttcggcttgtgtgggagtttccggggtttctcagggatctagtgatgttctagctactctgaaactagaacatcatgattcagctactcgttacttattcattggaagaacttctgttaataatgatagctgggaaaagttggaagggacattctcattgtcaactatgcctgatcgggttataatttatttggaaggacctgctcctggagttgacctgcttatacgatcggtagtgatcaactgttccactcctaatgataataccacaagcacaggatgtgtttcagctggagatgacaacatcatagtcaacccccaatttgatgatggcctgaaaaactggtctggaagaagctgcaagattatgttgcatgattccatgaatgatgggaaaattgttccaaagtccgggaaattcttcgcatctgcaacagaacgcacacaaagctggaatggaattcagcaagagatcactggacgcgtgcagcgcaagctggcctatgaggtcactgctttagttagaatatttggaaacaatgtctctaccgctgatgtacgggctactttgtgggtccaaacgccagatcttcgagagcagtatataggcattgcaaatgtgcaggcaacagataaagattggataacaatgcagggaaaattccttctgaatggttctccatcgaaagtggtcctttatttagagggtccccctccaggcactgacattcttctcaataatttggtcttaaagcatgcggctaaaacacctccttcaaccccaccagatgtaaagaatgttgcttttggggttaatataattgagaacagcaatctggctgatagcacaaatggatggtttccccttggcaattgtactttaagtgttaaaactggttcaccacatataattccaccaatggcacgagattctcttggtcctcatgagctcctaagcgggcgctacatccttgtaactaatcgaatgcaaacatggatgggtcctgctcagaccatcactgataaagtgaaactctttgtgacttatcaagtgtctgcttgggtccggattggctcagcaggatcatcagggcctcagaatgtgaatgttgcccttggtgttgacaatcagtgggtcaatggaggacaaactcaggtttcggatgacatgtggcatgaaattggagggtcctttagaattgaaaagcagccatcaaaggttatggtttatgtgcaaggtcctgcttctggtgtggacttaatggttgctggacttcaaatttttcctgtggatagacacacaagatttagatatttaaagatccaaactgataagattcgtaaacgtgatgttatcctgaaattctctggactggactctggcagctatgctaacacctcggtaaaagttatacaaacacataatgatttcccaattggaacatgcatcagcagaacgaacattgacaacgaggactttgttaacttcattgtgaagcattttaactgggctgtgtttggaaatgagttgaagtggtattggacggagccacagcaaggcaatttcaattacaaggatgctgatgatatgttaagcttgtgtcagaagcacaagatacaaactcgcggccattgtatcttctgggaagtggacgaaaccgttcagcagtggatcaagtcactgaacaaaaacgatctgatgacggctgtccaaaaccgcctaaacggcctgctgactcgctacaagggcaagttcagtcactatgatgtcaacaacgaaatgctgcacggttcattttaccaagataggctaggcaaggatataagggcaaacatgttcaagactgcaagccaactagacccttctgccacactctttgtgaatgattatcatgttgaagatggatgcgacaccagatcatgtccagataagtacatccatcacattcttgatttgcaagagcaaggtgctccggttgggggaattggaattcaaggccacatagactgtccaatagggcctattgttagttcttccctggacaagttgggtattcttggcctacctatatggttcaccgagcttgacgtgtcttccgtcaacgaatacgttagagcagacgatctcgaagttatgctacgcgaagccatggctcatcctacggtggaaggcttaatgctgtggggattttgggagctgtttatgagtagggaccattcacatttggtcaatgcagaaggtgacatcaatgaggctgggaaaaggttcttagctctaaaacaagagtggctctctcacagccgtggccatgttgatgaacaaggccaatacaacttcagaggctttcatggaacatacaatgtgcaagttgtgacaccgtcaaagaaaatttcaaagacatttgtgcttgacaaaggtgactctccactagtggtatccattgatttataagcataatgcttcaccccaagaattaatatcatgtctcttttatattggtggtgttatgttatcttaaaatagttgggatttgagttgtctgggcaactgcacaaaatctcaacacttaaaaattgtctcactcatt

SEQ ID NO: 275 - DNA, 1850 bp, Glycine max
ctgaaacgaattcgggtcgggcttgggcgaggcaaccctaggtagaaaaatgtagatatgttgttgtgtggtttggtgatttgtggaaacgtaatcaacatttcgcagtgtggaggatcgtcttcttcatcccacccacacagagttcagttcagttaggatatctattttttaatggctaatagaccggatccggatattgatgatgattttcgtgagctttataaggagtacactggccccctggggactgctactacaaacatgcaagagagggcaaaatcaaataagaggtctaatgcagggtctgacgaggaggaggaagcccgggaccctaatgctgttccaactgatttcaccagccgagaagctaaggtttgggaggctaagtcaaaggctacggaaaggaattggaagaaaaggaaagaggaggaaatgatctgcaagctttgtggagaatcagggcatttcactcagggctgtccatctactctcggagcaaatcgaaagtctcaagatttctttgaaaggatacctgccagagacaaaaatgtacgggcacttttcacagagaaagttttaagcaagattgaaaaggatgttggctgcaaaattaagatggatgagaagtttattattgtcagtggtaaggatagattaattttggccaaaggtgttgatgctgtgcacaagattcgagaggagggtgatcaaaggggatcatctagttctcaaatgacccaatcaagatcacctgaaagaagtcctgttagtgctcggtttcaacgctctgagccccaaaggtctcattctggaccacgaaatacatctcagtttcaacaaaggtttggtaggcaagagagggctgttgaagaccgtatcagggatgatgttcaaaagttttctagaggttctccacaagcttatggaaatagtggagctagaggtcgttcaagccagtcaagatctccaaggcatgccccttatacaggaaactcatataattcatttgatgatcgtaatcaaaacatgggtgcttataggaatgaaggatgggattctcatagaagagaatctggtatccagcctggtcatcagtttgattacaacgcctccccacagactttagaagaattagagttggagtataagaacgaggcaacagagctaatgaaaattcgtgacagagaagaagatgaagaaaatttcaagcatcgtgaggctattagagatttgagggagaagtacatgagcaaagtttccttggtaagggtcacacatgcaaaacagttggaagaatttcttcagcttgatgcgcagaggcgtcgacagcaagtgggtcaacagatgtcttctggttatcggggttttaaacagcagagttttcctgaatatgatgggtccactgccaatcctcctacttatgctggttctaatataccattggaatcgaggaacaggttctcaggcaacatggaaacttatcctaataggcctcatgataattttggtgaatttcataggcgtggagattttgcaaaagcttacaacagatattaaaattctgtatatcaatcaagtgggtccagattgatcgagtaggcagtttaatgcactggaggccataaggtaggtaagtatgttgattaatcttaggattggatggacatggatttcggttgatgggtctggttttcatttgaaatatggttgctcagattaagaactttgctgtaagttgtgatgcactattgggttattatccttgacttattaacgtgctactgcagcttggattgtgttacggggagatcctttgaaagattgattgattttagtagaatcaaatc

SEQ ID NO: 276 - DNA, 800 bp, Solanum lycopersicum
gaactttccatacaccctttgttctccacattttaccagaactttctagattctctccgctatatataagagcctcctctgccatgtttttcctcaatcaaaagttcatccaactaacaaaaatcatattaatcaattgacttagatattttgattgatagaagatgccgatgcgaccaacagggggattgaaacaagattgggatccaatcgtgctgcagaagccaaagatgaaggcccaagacctgaaggatccaaaaattgtgaatcaggcattgcgagctggagcacaagttcaaacggtgaagaaaatcgacgctggtttgaataagaaggcggcgacgttggcagttaatgtaagaaagctagatgaggcggcggaaccagcggcacttgagaaattgccggtgggtgtaaggcaagcaatacagaaagcgcggattgagaagaagatgagccaagctgatctagcgaagaagatcaatgaaaggacgcaggttgttgccgagtatgagaatggtaaggcagtgcctaatcaactagtgttggggaaaatggagaacgttcttggtgttaaacttagaggtaaaattcacaagtcatgagaagtatgatttttaatttgtgtggaaatggaaaggccatagttgttgttgttgttcttgtataaatggttatatgttaattgtaagaggtaaaattcacaagtcatgatttttgatatctatgcacctctaattgtatcttaaattagtgtaaaattgaacaaataataacgtgacaacaaaaattattatatt

SEQ ID NO: 277 - DNA, 1038 bp, Solanum lycopersicum
caagaaccttgtgaagtagaaaatatgtatagatttagcaacacagtaataggtttcttgaatctattcacacttttagcatccattccgatcataggtgctggattatggatggcaaggagtagtacaacatgtgagaaatttcttcaaacaccacttttgttcataggtttcataatccttatagtttcattggctggtttcattggtgcttgtttccatgttgcatgggcactttggctctacttatttgtcatgttgttcctcataggggcattaatggggctaactgtttttggttttgtggtaacaagccaaggtggtggacttgatgtgcctggtaaagtatataaagagtatcatcttcaaaattactcaccatggttgagaaagaggattaaggatcctcaatattggctcactgttagagcttgtattttgggttccaagacttgtgctaatgttattacttggactccctatgattatcttacgaaagatttgactcctattcagtcaggatgttgcaagccaccaacagcatgcaactatggattgacaacaatgacacaagaggcagattgttaccaatggaacaatgatccaaatttgctatgctatgagtgtgattcatgcaaagctggagttcttgaagatgtgagaagggattggcaaaagatatcagttcttaacattgtcatgcttgtcttactcattggaatttactccattggttgttgtgcttttcaaaacaccaaaagggctgtatctgattatccacatggtgaaaaccgtatgtataaagtcagaccgagatgggatttctactggtggagatggtggcatgacaggagacatcagctttattagaccaaaacatggcacttcgtttggtccaaaagcaacatatcatcaaaagtgatgctaattagtattctctttgttttccaacaaatattaattcctagcagggttttttccacacctccttttctgtacaaagaaaaagatttttctacttaatttcacattctacca

SEQ ID NO: 278 - DNA, 778 bp, Solanum lycopersicum
agagagagaaaataaatcaaagagaaaaaattaagatttttttttcaaaaaaaaaaacatatggggaaagcacgtataataggaattggaatggattattcagcaacaagcaaaatagctctaaaatgggcaattgataatttaattgaagaaggtgacacaattattattattcatgttgtttcttctaaagttgaaccaactagtaaacaactctttgaagatactggatcacctttgatacctttggatgaatttaaacagattaatgtgtctaagtactatggattaaatcctgacaaagaggttattgatatgcttgagcctgttgccaaactcaaaaaggtgacagtggtgtcaaaggtgtattggggagatgcaagagagaaactgtgtgatgctgctgaaagtctcaaacttgattcacttgtaattggaggcagaggcttaggagttcttaaaagggtgttacttggaagtgtcagtaactatgtggtgcaaaatgcaacatgtcctgttactgttgtgaaaaccagtcctcaaaagtgaaaaaaaaaagactataaagtttacgttattttcttaataaaaaaaagaagaaaagctattttgtgtttttactttctttcgtttttgtataatgtcttgttttggattttatttatttgatttcttagggtatgagttggcttttgtttgggagtgttggatgtgagatgattgtgggactttgttatatttcaattatatattatatacatatttttgttggtttctt

SEQ ID NO: 279 - DNA, 880 bp, Solanum lycopersicum
gtggaaatttgatgagccataaaagtgggttgacatgtggtagcaaatacagtgacagatcaacatcgcactacttttccttcttcttcatcaaaaaaaatccattttgaacccaattgctctctctatcactatattggtttttcaagaaactgtttaaccaagcaaaaatcttggagttgtaggtatggaaggaggtggtagatttgttggggtagcagtcgatttctcagcttgcagcaacaaagctctgaaatgggccattgataatattcttcgtaaaggggatcatcttattctcgtcactgttcgtcctgaaggacactatgaagaaggagagatgcagctctgggaggccactggttctcctttaatacctttatcagagatatgtgatggccacacaatgaagaggtatggggttaaccctgaccctgaaacattgcaaatgataacccttgcagctaggcagatggagatcacagtagtcatgaaaattttctggggagatgctcgagagaagttatgtgaagcaattgataaaactcccttgagctgtctggtcatagggaacagagggcttggaaagatcaagagggttattatgggcagtgtaagcaactatgtggtgaataatgctacgtgccctgttactgttgtgaagaatgcagaagactaattttacaatgtgcggaactccttaactggcaaagctgaaggcttttatgttaaattagtcgcttctgtttttctaagcttggtgtcggattaaacttctatcttatcgtgaacattgaacatgttgatgtgtgtattgtgtaccatcatgttgaacctctgtaattcctgtcactatggattgctgcagtaaataaacttt

SEQ ID NO: 280 - DNA, 658 bp, Solanum lycopersicum
attatattccttttttttttaaccattaaaacaatctcattctctttttgaatttgtgaataatttaatcagtttcgattttcattcaaatttgtgtgcaatggctacgatgggaatgacgggaagtattgggggttatggagcagcttcagcgtctctgtttcgattgaggaactcagcgaagaagaagactagaaacggtaaaaatggatttagggtttcatgtgtttgttcatcttctgctgttgccgatccgtataagaccttgaagattcaacccggtgcatctgaatctgaagttaggaaggcgtttagacagcttgctcttaagtatcacccagacgtatgcagaggaaacaattgtggtgttcaatttcaccaaatcaacgaagcttacgatgttgtgatgagtaatttgagaggtgaaacaagagcagagttggagatgattgaggaatatgatgatagtaatgatgaatcaatgagaggaatgcatgaaccagattgggatttatgggaagagtggatgggatgggaaggtgctggcattcgtgactatacatcacatgttaatccttacatatgaatgttaaattaatgacttggggatgaaaacccaagaatgtaagatccgtccatcttctttaaatcaaagatg

SEQ ID NO: 281 - DNA, 1859 bp, Solanum lycopersicum
gaagaacacaaagttgaggtcctggccttatcttcatgttggtctctaaatgtccgctgaatcatatcctttttgaaccaagaatcagtagaggcggattcagatggaaagcaagtgcctccaatgaagttcctgttgagaagtggaagcaagatagcattttcattgatagacgcggcagatttagacaatttgatcacaaaaaagtttcacggaaaagatgtggttctttaaggggcagaggatggaaatatggatctggttttgttgatggtatattcccagttctaagcccaattgctcagcaaattctaacttttataaagacggaaaaagatccagagaggatttggtcttccttggatactctacgtcccaccaataacacttgggatgatctaatcaatgtagcagttcaacttcgactcaacaagcaatgggatctgatcatactgatgtgtgaatggatactgtgcaggagttcctttcaggcagatgtgatttgctacaatttgctcatagaagcttatgggcagagttcacttgttaagaaggcagaatctacttacctggcacttgttgatgctcgatgtgtcccgactgaagatacttatgcacttctcctgaaatcttattcgaaatgtaggatgatagaaaaggctgaagctgtcttctctgagatgcggaagaatggccttccttcaagtgctcttgtatataatgcttatattgatgggttaatgaagggaagaaattcgcaaaaagcattggcaatctttgataggatgaagcgtgaaagctgccaaccatctactgatacttatacaatgctgatcaacttatatgggaaggaaaataagtcctacatggcgctaaagatgttcaatgagatgaaagctcagaaatgtaaacctaatatctgtacctacacagctcttgtaaatgcatttgcgagaagtggcctatgtgaaaaggctgaagaagtctttgaagagctacaagaagctgggtttgagcctgatgtttacacctataatgccttgatggaagcttacagtcgtgcaggctaccctcagggtgctgcagagatcttttctctcatgcagcatatgggctgtgaaccagacacagcttcatacaatatcatggtggatgcctatggaagagctggtcttcatgaagatgcacaaactgtgtttgatgagatgacgcggctggggatagctcctacgatgaaatcctacatgttactcatatcagcctactctagaaacagtaacgtgtcaaaatgtgaagaaatcgtgaatcagatgcagaaatcaggagtgaaactagatacctttcttcttaacagcatgctcaacttgtatggtcgtcttggccagtttgctaaaatggaagaactcttgactgtcatagaagctggaccatacgtagccgatatcagcacctacaatatcttgatcaatgcatatggacgttcaggatttatcgtaaaaatggaagaagttttccaatcacttccttctaagaacctgcagccagatgtggttacatggacttcccgtcttggagcatactccaaaaagaaacagtaccaaagatgcttagaaatcttcgaggaaatgatcgatgaaggttgctatccagatggcggaacagccaaagtgctcctttcgtcttgttcaagtgaagatcagattgaacaagttacaacagtcattagatcaatgcacaagaatgtgaagacagtagagttagtttgacatggcttgtacagctttcatgacattcccatatttgatgtgaaagttagaacatggacataccggcaaaatcgaaagtaaaaatttcaactt

SEQ ID NO: 282 - DNA, 991 bp, Solanum lycopersicum
gtttaatctgacgtggctaatcaaatagaaaaaacacgtgcctcattctgattcgataatgacaccaatgcccgccgatgacgtggaccaccgttctcattcaaatacttctacatagcttctgcgattccggtaccggcagaagctcgcagggagacggagaaatcgggcaaatggcgattaagctgtatacgagatctattgttttgattgttgttattgctttcttatcggttttgccagctacgctttgcatcgaagataaatgttctgcttgttccgccattgctgaggagctcgagcatggactattgaaagaaaagccaagaaaccatttagacatgagacatcgcctggattctaaaggtcagcgtgaagggaaacttattgattacagaggcagcgagttacgagtcgttgaacttttagatgacctttgtgaaaagatgcaagattatacactggagaaggtggattcaagcaccaacacttggatcaaagtaagcaattgggaccttctcaagactaataagcaagaagctcgagcacattcaaaagcgttgtcatccttttgtggaaggttactcgagcaaactgaagatgagttggcagagttgataaagaaaggatctgtccaagttggagatgtgaccaaggtattatgtgaagatctcagcaactattgcaaggggacaagcagctccaacaaggcagtagatgatgaactttgacctgataaatcattttgtttccggggctggttgatgaggtaaagaaagaagattgtcccctattcgcgaaccagaaattcagatgatttccatagaagtagaaacagtttgttacgtcctcatatttcttctgatatttttaacttaatacaacatacatttgtatgtccttccctcttttttattggaccatgtatcagtcatcccatgttgtactcaagatcaactaattttatcgatgaacaatatttactctcttt

SEQ ID NO: 283 - DNA, 1521 bp, Solanum lycopersicum
gcagcatctcacagtcaaaactgcacatgtttttatagggtttttctctttaacactctttcttgaatcttgaaactcaaaaaatggcttcactagttcaattccttcctctcttccctttctttttcttggtttcattctgtgtttctcatggaccctttttaccaaaagccattattctccctgtaaacaaagatccatctacttttcaatatgttactcaactctacatgggtgttactcatcttgctcccatcaaattagttgtagatcttgaaggttcatttctatgggctgattgtgggttgacttctgattcttcaagtcaaaaacttgtaccttgtaattcactcaaatgttccatggctaagcctaatggttgtactaatgacaacaagatctgtggtttgaaatcagaaaacccctttacaagattagctgcaacaggggaattagcagaggatatgtttgctgtggagtttattgatgagttgaaaacaggctcagttgcttcaattcatcagttcttgttttcttgtacatcatctactctgttacaaggacttgctagaggtgctaaaggtatgttggggcttggtaattcaagaattgcattgccatctcagttgtctgatacatttggttttcaaaggaaatttgctatttgtttgtcttcttcaaatggtgctataatttctggtgaaagtccttatttgtcacttttgagccatgatgtttcaagatccatgctttatacacctttgatttcatctagaaatggggtttcagaagagtattacataaatgtcaaatccctcaaaattaatggaaagaaactatctttgaacacaactttgcttaccatggatggggaaggtcaaggagggacaagaattagtaccatttccccttttacaactatgaagacctcaatttacaagacatttgttgaagcttatgaaagatttggtttttccatgggattgactaaagtagaacctatagcaccatttgggctttgctttagcacaaaagtagaggagggactaaatgtgccaagtattgatcttgtgttgcaaagtgagatggttaagtggaggatttatgagagtaattcaatggtgaaagtaagtgatgaagtgatgtgtttgggattcttggatggaggggctaaccaaaaggcatcaattgttatagggggtcaccaattggaggataatcttttggagtttaatttgggaacttctatgcttggatttacttcttcattgtcaatggtggaaactagctgttctgacttcatgttctcaaaggattcttcaccttttgattcttgacatgaatccttaaccaaagattgacaattcccttttgtatagttgtgttaagaacatgtattggctcttaattatagataatcataacttaggccaatcttagtatattagaggagtactagtttattgtgagatagtgtttcttgactcacttttttgagttgtgagaaagttttgatatgta

SEQ ID NO: 284 - DNA, 718 bp, Solanum lycopersicum
atagtaatattattccataatctctctctttctttgccttaattctttatatttacacccacccccactattttgtgagcttcatttcaaagttttgaatggagaatttgttgggtcttatgagagttcgtattcacagaggtattaatttggctattagagatgttactaccagcgatccttacgttgttgttaggatgggcaaacagaaattgaagactcgagttgtgaagaagaatctcaacccagaatggaatgaagaattaacactatctattactgagccaattctcccaatcaaactgcatgtttatgacaaggatatattttctcttgacgataagatgggtgatgcagaagttgacatacagccatttatagatgcggtgagaaagcggtacaagaacatccctagtggaaccataatcacaaaaataaagccaagcaggcaaaattgtttctctgaagagagctccattgtgtgggaaaatgatcaggttgtacaaaatgtgtttattagattgcgaaatgttgagcgtggtgaaatagagctacaattgcagtggattgacattcctggttccaagggtgtgtagctagctatctactactatccatcaatcatgtacagtcactatcctttattcatgttgtattctggtctgttttttggttaaaaatttctgttaccaaatgaactactcagttttgattcaca

SEQ ID NO: 285 - DNA, 1443 bp, Solanum lycopersicum
tagaacatttccaaaccttttttcaactattatttttccttaaataataggaaaaatttatttaacacgtttgaaacaaacaccaccaaatttggtgacgccccccatcttctttccaattttcacctaactatatattttcactctcacattataaaccctcaaaaaaatcaaaataaacacattttttctttccacaaatatggcttctttcttctgttcaaccaagttccttctactcctattttttctatctgcaattccaatcgcctttatcatccatctagaaacttcttctccgacgactcacgtttaccattatcacagtaccggctggttacgcgagtgttctaaatgggacgatgctaaccgccggttcattgtcagtttcttcgaaggtggtttgggtgtgattccggttgaggccgattattctcccggcgacgtactacaggaaatgccggtagtgaaagacgctgatttgaccggtaatgcgtcgctcggttttactatagaccgggaaaggaaccgggttttagtcgccgtcgcagatgttttggggaatcggtatagcgctttggctgcctatgatttgacattgtggaaccgggtttttctcaccaaacttagcggtccagaggatgaaaaagcatttgcggatgatgtggtggttgatacagaagggaatgcatatataacagatgcaaaagcagacaagatatggaaggtaggcgcgaatggtgaacttaaatatacaatcaagaactcaatatttactcctaaagagtggtacaataaactggttgggctaaacggaatagtgtatcatccaaacggatacttactggtggctcatacattctctggcaatttgttcaagattgaaatcgccaaaggtgatgaagttaaactagtaaagattgactatggatcgttgaaatttggcgatggcatggagttactatctccaaccaagcttgttgtggctggaaatccgacaagactagttgagagctctgatgattgggagagtggcactattgtggggaaggccaaaggcgctattcatcgtttaagtacagcagcaactgtgaaggaagggactgtttatcttaatcatatgattggtttgggatatcctaggaagaaacatgttcttgttgaagctgttttttctgcttaattattgttccatccatcccttttcatttgtgtgtaagagtcaattttatacttgattaccacactactaatttatgttcctcacataaagaacagttgtatcgcatcgtatcgtaggatatacagtatttatgttgttatgcatcaagcattgcagtatttggatgtgtttttgctcttttactatcaaggaatgcaagcaaaaagtatccaactacaacaatttatcatgttgtccagtaatgctagtagttctctctt

SEQ ID NO: 286 - DNA, 1191 bp, Solanum lycopersicum
aattcaagattcctttatttctctttcttcttcacatataaaaatccacgaacttatccctattttttcatggagcttattcccactcttccttatgatatcggactcgaatgtctaattcgagttccttataataatttctcgtcacttacttccgtcagtagaaactggaagcttcagattgagcttcccgagttttggaggcgaagaaaagctactggttcaacccgtcaggtgattttaatggcgcaagctcgaattgacccgagattaaaactcgggtcatttaagtactctgctttttcgttttacaagcttacgctttacgaaccggagtcgggtaattgggcggaattaccaccggttcctggaatttccgatgggctgccaatgttttgtcagctcgtcggagtgggattgaatctggtggtgatgggcgggtggaaccctctttcttgggaaccttcgaacgccgtttttgtttttagctttgtgtccgccacgtggcgacgtggagccgacatgcctggttgccggagatcatttttcggttgtgcgtcggattctgaacggacggtgtacgtcgccggaggtcacgacgaggagaaaaacgcactcaaatcggcgatggcgtatgacgtggcaagggatatgtgggtcccggtgcctgacatgacaagtgaaagagatgaatgtaaatgctccttttttgaaggtaaattccacgtcatcggtggatatgacacgagcatgcaaggccagttcggtacgagcgctgagtcattcgatccttccacgtggcagtgggaccaagtcaacgaacatttctttgaatctgccacgtgtccaagaacctgcgttgagggtggggacggcaaattgtacttgtgccgggacggtgatgtgctggcactcggtaagtctacgtggcaagctgtggcggcaattccgacggagctccggagcgtagcttttgtgacagcatggaggggtaaaattctgatgaccggttctatgggatttaatgaaccccacaatacatatgttcttgatttaaagagttataaatggaccaaaatggatactccggtgtacttttccggccacgttcaatccggctgctgcctggagatgtaaaaagagtttgttttgattgtacagttagttataaatcagaaagattttaattac

SEQ ID NO: 287 - DNA, 799 bp, Solanum lycopersicum
actttcctgctctatttaagactgcagcaacggacagaaatgtcatttcacattccacagtccattttcaactacttttcttttcttctccatttttgccccaatcagtattcagtatcttctccgaccaatgagcaaagaaggaagtagaagaggagtaaaatggagctggacctccgccttcgtcggtgccgccgctgccgcagcaacggtgatgacactctcttcgaagccacgggatcctgattttcatctcatctccatcgatctcacttccttcaagctcaatttccccgtcgtagacgcggaactcatcctcaccgttcacgtgactaaccctaacgttacttcaatcaactactcctcaacagaaatgtcgattttctactccggcgatcacctcggttcagctcgtgtgaaagccggatctcagccgccgcgttcctgtcaggtactccgtcttccggcgaggttaagcggacttcaacttgcacatcacgggaaggaattcgtcgccgatgtagcgaagagggagatgttgctggatgctacggtggatatagaaggttttgcgaaggtgatgtggtgggaccataaattccgggtgcacgtggatagtcacgtgaccgtagacccggtttttcttgacgttattgatcaggaaaataaatcggctttagaggtctttgtgaaataacggttcagtccggttcagtgtgttgtatcggtttattttgtattcatcaccactaaaaatgtacttcagtaattaaaatatttaagttctatcgttacaatt

SEQ ID NO: 288 - DNA, 1677 bp, Solanum lycopersicum
ttgaattattactttgcagggaaaagagttctatatcccggccatctcctcccgtcggtacagtacgacctccggcgtcggcagaagaagtaactctcttacgcggcctctgtaaggcatgccgggtccaacaatggaatcagaatttccagtggagccacaatcgctgaagaagctaagcttcaagtcccttaaacgatctcttgacttattttcacctatccatggccatttccctcttcctgaccctgaaagcaagaaagttcgaacgagctataagctaaatgtcgagtatggaggtataaaaggctcagcggctgaacctaatgccaaagcgggtgtgcagcatcaggctcaaccagcttctgcaccttccaatacccttgctcttccaggtcctgaaaatacaagagacgagaaaaccggaaatgaactggctcttggtccatccataccagggaatggcccgactgatgttaggttctcagggaaaagcaatgctgttgttccttctcacagttcatctgaaagaaatttgtcaactgctgcaatcatggaaagaattccaagcagatggcctcgtccaatatggcgtgctccatggaaaaattaccgggttatcagtggccatttgggatgggtgaggtctgtcgcagtggatcctagtaatacttggttttgtacaggatcagcagatcgcactatcaagatatgggatttagcaagtggaagactgaagctcactttaacagggcacattgaacaagtccgaggccttgctgttagtaataaacacacatacatgttctctgctggtgatgataagctagttaaatgctgggacctggaacaaaataaggtgatccgctcctatcatggccacctcagcggtgtttattgcttggctcttcatccaaccattgacatcttgttcaccgggggtcgtgattctgtctgccgggtttgggatattcgtagcaaaatgcaaattcatgctttatctggacatgacaatactgtttgttctgtttttaccaggccgatggatccacaggttataactggctctcatgacagtaccattaagttctgggaccttagatatggtaagacaatggcaactctcacacatcacaagaaatctgttcgagctatggctcagcatcctacagaggattgttttgcttctgcatcagcagacaacataaaaaagttcagtcttccaaaaggagaatttatgcacaacatgctttcccaacagaaaaccatagtcaacgcgatggcaattaataatgacggtgtaatggtcactggaggtgacaatggaagcatgtggttttgggattggaaaagcggtcacaatttccagcaatctcaaactattgttcaacctgggtcactggacagtgaggctggcatttatgccctcacctacgatgtaaccggctcaaggctgatcagctgtgaagctgataagaccatcaagatgtggaaagaagacgaaactgctaccccagaaactcatcctcttcactttaagcctccaaaagacattaggcgtttctagttgtaatcgtaattcagaaagcaaccctttgtaatacatacaaatcgaacttcttctgtgcgtcgtttcggagtaagactgacccgataaaagcaccatgtccagagtag

SEQ ID NO: 289 - DNA, 2408 bp, Solanum lycopersicum
gactgagagagcttaacaacatccacatggattacaggggcaactccttaaacgcacacctccaacagagttccaacgaaatcaataatggagctgcgttgcttgcagacactcaatatccctgcaactgctttagcagagaagccatttttgtgtggacacccaattacattgattcaaactagcactaaaaggggcccaaattccaaaaaccttaagacccttcgtttcagaactcaaatttcagcaaaaattagctcattggaacctcaaggaactgcaaaagatgtcaaatcaaaagatgcaaatcttgtttttgttgctggtgcaaccggtagggttggttctcggactgtaagggagcttctgaaattaggctttaaagttcgagctggagttcgaagtgctcaaagagctcaacctcttgtcaaaagtgttgagcagataaaacttgagaatgctacggatggaggagcaaaagctatagagaagcttgaaattgtggaatgcgatttggagaaaagttatcagattaggcctgcactgggcgatgcatcaattgttatatgttgcattggtgccagtgaaaaggagatctttgatgttactggaccatatcgaattgattacctggctactaagaaccttattgatgcagcaaccgtcgcaaaagttgaccactttatcttgctcacatctttgggaacaaacaaggtcggttttcctgcagcaattctcaatttgttttggggagtcctcctttggaaaaggaaagcagaagaggcactgcttgccagtgggcttccttatactattgtgagacctggaggaatggaacgtcccactgattcttttaaagaaactcacaatattactctttcggaggaagatactttatttggtggtctcgtgtcaaaccttcaggtggcagaactaatggcggttatggccaaaaaccggagcctttcatactgtaaagtggttgaagttgttgcagaaacaacagcaccgttgacccccatggaggaccttcttgcaaaaattcccccccaacgtgttgaggtttccccacccaaggaaactggtgatttacagaaatctgcaactccaaccagtattacgtctgagatccctgatgccttgctcgagaaaaaaccttctgaaacaaagttgaaagcagcagcacctctctctccatatactgcttatgcagagcttaaaccgcctacatctcctagtccgattcctcctggtggtcatcaagcaggtgcaagtggagcagaagatagcaaacccactaaaaaagcctcttctgttgttgattatgcttttgacaaagcagaattgctgactacaagaccttcgtctccatatgctgcttatgaagatttaaagccacctacatctcctagtccaaatcctcccggaggtcgtcaagaaggttcaagtggagcagaagatggtgaacctactaaagcagtttcttctgttgttgattctacttttgacaaagtagaattgctgactacaaggcctttgtctccatacactgcttatgaagatttaaagccacctacatctcctagtccaattcctcccggtggtcgtcaagaaggtgcaactggagcagaagacagcgaacacactaaggcagcctcttctgttgttgattctacttttgacaaagcagaattgctgactacaaggcctttgtctccatacactgcttatgaagatttaaagccacctacatctcctattccaattcctcccggtggtcgtcaagaaggtgcaagtggagcagaggatagcgaacacactaaggcagcctcttctgttgttgattctacttttgacaaagcagaattgctgactacaagttatgaagatctaaaaccacctacatcccctagtacaaatcctcctggaggtcgtcaagaaggtgcaagtggagcagagaataccaaacccactaaggaagcctcttctgtttatttatttacttttgacaaagcagagttggtgactacaaggcctttgtctccatacactgcttatgaagatttaaagccacctagatctccaagtccaagaccgagtggtttgaaatcctcagcaactgcggaagtaacatcagcagttactggaggcaacgatgtggcaatcgatagtgctaacaatttctccaaggaggattcatcaaaaagttcagctttctgtcattctccttaccctgcgtatgaggacttcaagcctccaagctctccaacgccatctttcaataaaatgtgaaaatctagttctgttttgcttcactagttgtatctcggcaatcctattgcgtaatgcatcaactcaagcattacagttggagcaatttttttttttcgttttttcacttgtatttg

SEQ ID NO: 290 - DNA, 1903 bp, Solanum lycopersicum
acataaaagttttccgctctatgcactaaaaccaatctcacatggctactcctctcaaaaataccaatagactctctcttgcaatggaaagaactggccaatgggtattttcacaagaaattccaactgatgttattgttgaagtaggtgaagcaaactttaatcttcacaagttcatgctagtagcaaagagcaattacataaggaaacttatacttgatactaaagaaagtgatgtaagtcgtataaacttgtctgatattcctggagggccagagatgtttgagaaggcagccaagttctgctatggagttaactttgaaatcacagtacataacgttgctgctcttcgttgtgctgctgaatatcttcaaatgactgataaatactgtgacaacaatctcgcaagcagaacagaggattttctagctcaagttgccttgactagcctttctggtgcacttgttgtgttaaagtcatgtgaaaatcttcttcctcttgcacatgatctcaatatcattcaaagatgtgttgacatcgccggtgctaaggcgtgtgtggaggcgaattttcctagcagatcaccaccaaattggtggacggaagagttaactatcttagatgtagcttttttcgagagaattattgttgcaatgaaaactcgtggggcaaaagcgttaaccatagcaagtgccataatcacatatacagagagatctcttcgtgatcttgtacgtgaccactcaggaaacaacacgagattaatggtaccagaggattcggatatgagaatgcatcaacgggaacttctagagtcgattgtgactctgttgcccgcggagagagcagcttttccaatcaatttcttgtgttgtctcctgcgtacagctattttcttaagagcagccagtagctgcaagaatgaattggagaaaaggatatcagcaatactagaacacgtgacagtcgatgatctgttagtcttgtctttttcttacgacggagaaagactattcgatcttgagagcgtgaggagaatcatttccggatttatggagaaagagaagagtgtagctgtgtttaaaggtggtgattttggagacgtttgtaccaccgctatgcagagagttgcaaagactgtcgatgcttatcttggtgaaatcgctacatttggagatctcagtatatcaaaattcaatggaattgctattttggttcctaagggcgcgagaaaggctgatgatgatctttatcgagctgttgatatctacttgaaggcacatccacatttggatgaaattgaaagagaaaaagtgtgtagtgtgatggatcctttgaaactatcacatgaagcaagagtccatgcttctcaaaacaaacgtttgccggtgcaaatagtccttcatgctctctatttcgatcaactaaagataaggagcggagcagcagatgatagtaataacaacatgcccgaagccatggcaacaaggaatcaattacaagctgatgtttccctcgtaaaggaaaatgaagttttgagaacggagttgctaaagatgaagatgtacatagcagatatacagaaaacaacaaattctagtcaaggaacatcaaaagggagtctgaagaagacaacattcttctcttctgtctccaaaacattaggcaaattcaatccctttaaacatggatcaaaggacacttctagtattgttgatgatgctgctctagatcttactaagcctaggagaagaagattttccatatcttaagctatttacattatttggtttaattttagttttatgttgtgtgaaaaaactatgattgattttgtactgtaaaggattgattgattatgttgtttgattatattgttatgttaatatattcatgtatcaca

SEQ ID NO: 291 - DNA, 2916 bp, Solanum lycopersicum
aaccagtaaaaaacatacaaaactccaaaaatcccacccctttcatacccataaacaccaaaccctaaccttataagaatgggataaaatacctgtactaaatttccaatttgttcacgatttcaaatttttgttttcaaatcatactagtctgttctctttaaggcctcgttgaacagccgtttcattgaaaggttggtacttgaagacaacggtatgtgcaatttttcttctaaattagaggtttgtgcgccaactcaatccgctgccttattcattattggactttttgaatctggttgatgaggagcgttcggatggactcaattggtcccccaactaaaaggttggtggaactcaaccgtcatagcatacaggatggtcagaatggtgtaagggatgggattactggtgatggacaggggctttcagaagaagatgagtcaaggattaatgaggatgtcgaaggtgggaatgaaacacagagggatttgttacaagtgcaggctgttttacagacacagcagcaacagcccccagggcctttggttaggtgggagcgttttcttcctcttagatccctcaaggttctgctggtagaaaatgatgattcaactcgtcatgttgtcagtgcattgctgcgaaactgcagttatgaagttatagctgtgggatatgcccttgaagcatggaggattttagaagatctaactaaccatgttgatcttgttctgacggaggtggccatgccatttttgtctggtgttggtcttttgtcaaagattatgaaccacaaaactctcaagaatgtcccagtgattatgatgtctgctaatgactctatgggtatagtctttaagtgtttgtcaaagggcgcagttgactttttagtgaagcctattcgaaagaatgagcttaaaaatctgtggcagcatgtttggaggaaatgccatagttcaagcggaagtggaagtgaaagtggtatacaaactcaaaagtcgacgaaatctaaaagtgttgaaatgtcgggaaacaacactgatagcaatgatgaagctgagaatggaagctttgatctggacgacagggacggaagtgacaatggaagtggcactcagagttcgtggtctaaaagggccattgaagtcgacagcccccaacccatgtcaccatggaatgaattggcagatccccctgatagcacttgtgcccaggttatccattcaagaccagaagcacttagtgctacctgggtgcctgcaaatgccacaagaagatgtctcaatgagaaggatgaactgggaaatgttagaacggttaaagatttgaacatgggcgttgctaatgttccagagctcgaaggcctatcaggtaaagttatggatggtttagcagcttctatgaaggacaaacatttggagttagatcctaaagataatgagaatatgggtagaaacctaaagctgaacaaggaaacacgggaagatgacctgaaggacaaggatgttggttatatgggtgacataaccaacacatgtacgcctcaagtagaaagtactgccaatgaagttccaaatgatccttccaagatcacaaacatcaaagaaattgccacctatgacagtaaagacatgccttcacttgaacttagtttgaagcaacttcgagatgttggagagaatgggactggtgtgcaagagcgaaatatactcaggcattcagatctgtcagcgttctctaggtataatgctgcttcaactgctaatcaggctccaactggaaacgtgggcagctgttcaccagttaataatagttcagaagttgcaaaagcagaatcaattcacaacttgcaatccaagtcgagcagtacccctaatcagcgctcaaatggaagtagtaacaacaatgacatgggctcgtcgacaaataatttcttcatcaaaccagacacattaattgacaaaccaataaacaaacctgcagtcaatgcccattcctgttctgcatttcaaccagtgcaacatggacatacttcttctcttcaagcaatggttccaggaacacaagatactgcaaaggcagccgtgggccaagcaagagcaatgcaccagaagttccaagttcagcaccaccatcatcactaccatcaccatcaccaccatgtgcttagcttgcagcagcgacaacagctgcttaacgctgatgcttcgtctttgcgaaatgctgttgaaactgctcccgattgtggaacatctgacatggtaggtactcctgttgaaggaaatgctgctaattatggaagtgcatcaggaagtaacaatggaagcaatgggcaaaatggaagcagtggccaaaatgggagcagcactgctgtagttgctgaaggaaccaatttggttgctgaaaatgaaactggtgaaaaatgtgaaattggaagtgggagtggaagtgcaactagaagtggtgatcactcggctcaacgagaggctgctctgattaaattccggcaaaagaggaaggagagatgctttgagaagaaggtccggtaccagagtagaaagagacttgcagaacaaaggccacgcatgcgagggcaatttgtgcgtcaagatgcagacaaaagtaaaagcaacaatacaaattcctgacccctaccgtttgaattggatggttgatgtcaaatgagttcaagaagctttaactttgatcgcctaggtagggaggaagcagttcggtaaaacagctaaatttatttagttgaagcattggtgtctagtaataattacttattggagatgttattaattggggagtcctatgaagacgtctttgttatatagtcagtttgaagatacttattttgcacttctagatgttgggaataccctaataaaattcttcagtatgttgtgcttt

SEQ ID NO: 292 - DNA, 1613 bp, Solanum lycopersicum
aagttagaagttaggctagacggacgacaagctagccgcagtgatatgattcaaaaccccaaacaattgatattatccacattccacatacatacaacagtgccaaagaagaagtggaatcccttttccatggctatctctacatccttttgccgccccatttcctctttcaatgctctcacttcaccgtctctctgttacttcaaacccttgtacaaccacttgaaacttgatccttctttgcccctagtcaagtgttgctcctctcacattggacaatctccagaacacatcaacggcaggcaacctgatttatctcctatagcttcttttggtgtcacaatgacaaataatggaacatctaaaccatcatatagatggcgtagggtactgcttaaagttagtggtgaggcactagcaggagatcaagcacaaaacattgatccaaagatcacaatggccattgcgagggaagtggcagctgtcactcgacttggcatcgaggttgcaatagttgttggtggaggtaatatttttcgtggatcctcctgggcaggaagtagtggactagatcgttcctctgctgattatattgggatgttggcaactgtaatgaatgcaatattcttacaagctacaatggagagcattggaatccccacaagagtccagactgcatttagaatgtcggaagttgctgaaccatatatccgtagaagggctgttaggcatctcgagaaagggagagtagtaatttttgcagcaggaactggaaatcccttcttcacgacagacactgctgcagcactgcgttgtgcagagattaatgctgaggtggtgttgaaggcaacaaatgttgatggagtctatgatgataaccctaagcataatcctaatgctcgtcttcaggataacctgacttaccatgatgttatttcaaaagagctctcagtgatggaccttactgcgattactttgtgccaagagaataacattccagttgtcgtttttaatctcaataaaacaggtaacattgccaaagccattaaaggagagagagttggcacattgattggtgacacatggaatacagaagcagtagtatcttaagagtacaaaatagttggtttcagcagatggaagttggatcactgttcgtagcatttcaacacactcagatagctcatttggcagattgttccaagaagttggcactcaaatattgagtaaattatgtgccatttgcccttcgaaaactatggattcgaaagtactgaagataagcatataatctcccggaatatttttaacataaatgctgatactggatactactcccttggaattttcagagcttttcttgaagtgcaaaactaggtagctaagagttgcattctttgacgtgtaatgttacttgatatctgcatttcttttcttgcccctaacattttcattcacttgggggttgttttggtttgaatatgatctatctataagaattatgcattacttatatatggtttgatgtataacaaaatttactgcgtatgtaaaattgcgtactacgtatatagcgtttgttttttgatataaaatgttgcatgtcagttgta

SEQ ID NO: 293 - DNA, 859 bp, Solanum lycopersicum
tacttaatatatagtgtatatatataaaaatatcttgaaaatgaaagaaaagatttaggcacaaccattcatgtatttggataagactactactacactactagtcatttacaaagtaacacaaactcattaagcaaaattaattagctcatatggaaactctcatatgtattcaaatcccaaatctcttcattacaaactcatttccattgagtcaaaaactcccaatccattttcataaaagaataaacaggattccgaacctccaacgaaccacatggaaattgaatgccgaagcaaaaggcttcggcaatggaaaacctgaaatttcaaaaaagggaaacagaaggaataacaacaacaatgacgatagcgacgagaaaattccgacggagatatgggaaaggattatcggaaggattctgttttacgtcggagctccgttgatcggcggtgtgattttgctgcagattttcgatttaataaagcagcagaaactgttggatctgccaatttggttgccgtttttgacgacgtttatcacatttggggcttcagcacttggagctgcttatgggactttgtcagccagttgggatccggagaaacagggctcgtttattgggctagaagaagctcagaagaattgggttgatatgtgggctgaagatggtgctgatgaagaagaagaaaataggtggattaattaagaaatgtaaactaatgattattattctttaattgaataggtataattaaatccagattttttttgatcggtggttgtttattcgataagtggttgacaaaaaataagggattgggtatcatatagttgattaaatttataaatttctcg

SEQ ID NO: 294 - DNA, 955 bp, Solanum lycopersicum
cactcaattctcaaacttaacaatggcttccacaggtagccttttgtgcaaatgtagagtttcttctttgatgagtatctcttcttttcctttgatgcaacccataaccagaccagaaataacttactcccagagacatgtcagagtcggaacttcctctgtcctaaggaatgtatcccacaacatgagcatgaagaaagttccacgtatgatcaccagagctagctcagaaccgagtggcagtagcgatggagctcttggacagaataagacaccatttggatatacgagaaaggatgttatattgattggagttggagttacacttctaggggttggcttaaagagtggattggagttcttgggatttgaccctttacaagctggaaatgtcgttcaattagtcctggttttgggtctaacagttggatggatctcaacatacatcttccgggtttcaaacaaggaaatgacatatgctcaacaactacgagactacgaaagcaaagtcatggagaaacggttagagagcttaacagaagcggaattacaagtattgcttgagcaggttgaagaagagaagacccgcctgactagtggtgaagaggtcaaatagatattgttttccttgtggctacgtatcgttggaccttgttatccatgaattatggactagaccatactgaagtctgtacagtgtcgatatatgtttgcctagcattcgatgatcacatccaacttgataaaacaattctggaatgaaacaggttccaccaggtggggactggggagttcatgttatgtaaattgtttaggattatatagaaaatacatggtatacgaactattatttatcgcttgtgcatttgttgttaccttttctattcaagcaagaacagaaatgtgataaaacactgaattttcttttcaagcaaagaacggaagtgtgataaaa

SEQ ID NO: 295 - DNA, 2095 bp, Solanum lycopersicum
cttcatactcactctttatcattcacagatcccaaagtttcaatcttttttcccaaatcttgatacccttttcagtatttgagtgattttttttttgactaatttagtatgtagattttgatttttatgtgaaaatatgaggcgggtcgagctcaattatgggtgatgaattggggttttgagatgggtatgaatcagtttgaagaaatggggaaaagggttccgagaagggtgtggcttagatctcaaatgacaatggtattaatggtgggtggaaatcacacttcatccaggttttgtactcgttaatctgtttgaatttgttgtttttaggcttaaatctactgtttttagcttctgtgaaaacttcacttgctgttatagatcttgaaagtttaagaaatcttaaagaaaaaaaatggatatgaaggttttgaaatggcaatttcttcatgggtcgttagtgaaacgtttgattctgaaagggttcttgtttgttactgttatgattgttgtgtcatttgttcaaatgacacatatgattcagaaatctgaacctataatgttgaattttggtgtatgccctttgaactttgggtctgatgagtatatgaatgtgactgggttctttaaacctgtttctggattggggatttcgctgtttggagcttctttgatgaagcgggacgacgaaaaattgaccaaggatgtgtttaaggagctaatggaaaaggatttcttggatttgaatgctaatgcattgtgtgttgggaagaaatcgtcgtttgcagctttggtgctgcgagaattgggactcttgagtgctgttggtgttgatgcacacccgtatttctctcttgtatggagaagatttatgtacgagctcgatcatgagaacaattctttcgattttgtgttctcgagggatctggataaggtcactgttccagctcttatggtgcttgagattgagcgtgtcttacgtccagggggcaccggtgttatgctcgtgggttctagtagtttctacgcgggtaacttggtaaaaggcaacttgataaggtctgccaccccagtttcgtcgttcttgaagagttctgatgttgtgcacgtatgtggggttggcacgtatactctagtgatgttcaagaaacgatcagagattgttcaatctctcgtgcattctgtgcttcctgctaattgtccttccaatgtgaacaacaagccgtacttgaagcaccttgagccactcgtggaaaagaagcttggacagtttgacacacaaatctcatacttgcccaagttcatgaacatctcatcaaggaacaaactggtgtatatcaacgttggtgcaggggaattcgtagaatcaactcttgcaagaacattcaagcctcattatccgatccctcaccacttgttcaatgttttcgtcattgatcataacacctccacactgtctttatatgtgaagaatcctggtattaactttgtgtaccatccaggacttgctgtcgccggagagactactttgtcatctgttgacactgacgaatatttgggtgcaccactagatcgtgaaggattcgacttcattcattggtttagtgaaacagttaaagacggagactatgtcgtcctcatgatgaatgctagagcagcagagctaaacattctagcagaactattccaaactggatcaatatgccatgtcgatgagctgttccttcgctgctcggctgcagattgcagaaatgctctttgtggagactgcatgagccttttcaaaactctaaggagaagtggtgtgtttgctcatcaatggtggggagactagagttttgtcaagagttttaagtgcattttatgtattcttgtgttcaacttttgctttagtgtctgttgggaataaattgaggggaggctgtaggttgaaagttgatactgtaatcttactttctcccttctggaactgcacttgatgtcttgtgtatgtgtccatgtgtgtatgtgagttgcttgtctctaagtttctcttttaagtttatggaagaaatatgtgttatgtgttttaagaactatgctttattgtgat

SEQ ID NO: 296 - DNA, 1448 bp, Solanum lycopersicum
aaaatcacgagaacagctcatacatggtggccttctcatttcttctctgtaataataatcaaaaattcaaattttttcaaaccctataatctcaactttcatcagatccacaatcagatccgatcattttttttgatccgattttgaatctgcattgtgtggtaatcgaatttggaataacggaaagtttcaaattcgtgaaatttttccgatctgattatcaatttcgttagttttttgcgatgttttgaggatcggcattggttgtgattttgttgctaattacattgaggaatggcgtcgttgtctggccttagcgaggagcttggggaaatcgaaggacagatttcggatatttttcgagctctttcaaatgggtttcagaaattggagaagattaaggattcgaataggcagagcaggcagttggaggagctaacaggaaagatgcgagaatgtaagaggcttatcaaggaatttgacagagaagtaaaggatttggaatataaaagtgacgcagataccaccaagatgctgagtgagaaaaaacaatcaatgatcaaagagttgaactcttatgttgctctgaaaaaacaatacgcaagcaatattgagaacaagcgagtagatctttttgagggtcccggtgaagggtttgctgaagagaatggcttgctagcttcaaatatgagcaatcaacagctgatggatcaaggaaataggatgatggatgagacagatgaagccattgagaggtcaaaaaaggtggttcatgaaactgtaaatgttggaaccgagactgctgcagcactgaaggctcagactgaacaaatgagtcggatagtcaatgagctagactcaatccatttttcaataaagaaggctacacaattggtcaaggaactcggtaggcaggttgccactgatcgttgtattatggccttgctctttctgattgtgattggggtcatagcaatcattattgtgaagattgtaaacccacataacaaagacatccgggacatccctggattagcccctccagcacccagtcgacggttacttgcttatccttactgaaatattgaagccaaccatattgacaaggataatgtattatctacttcccacagcggatttacttggtttttgacttgagaacagagagtgaccgagcagcaagagcaaggcaggggatgaaggagaatgcctaattcagaaagaagagtctcccatcttctctctggtaatgatagttttccattctttgtgatgtttaatgagatagattcatatgatatttgtttgtatgattattatctttaattctagataactggaactttttcattgaggaaaatttgaactacacaaaccaagctttggcactggttgatttgtgcatagaccagtattgtataatagcatcattaattttatcatactta

SEQ ID NO: 297 - DNA, 1407 bp, Solanum lycopersicum
cctctttatatcccttccatttccttcattttttttcttctaactatccctaaagcaacttcacttgctctctcctacttctttcttagcaactttcccccttcataaatccatttatatgctcacacacacacatatttcacaaaattaattaccaattttgtcatcattgaagtttcacaaaatggagaaagttaaaagtatggagaaaaagaaattgattaatgagttaacacaagggaaggaatttgtaaaccaattgaaaaatcagattattggtccattagcttctcctgaggaatgtgatttactaattgggaaaatattgtctacacttgaaaaatcattatcaattctcaatttgaaggctcttcttcttgaaggtggaattaataatattaacaattctacatcttcatgttcatcgatttcatttcttggtagtagtaataataatattagtcccaagagtgaagtttttgattcttcaagggaaaaattggacaaaaatatggtctccaagaaaagaaagaaaacacaacaatggattaatcaaacaagcatttctgtaaatgggcttgaaggtccatgtgaagatggatttagttggagaaaatatggccaaaaagatattttaggggctagtcatccaagggcttattataggtgtactcataggaacacacaggggtgtttggcaacaaaacaagtccaaaaatcagatgcaaattcaacaatatttgaagtgacatataaaggaaggcacagttgcaaagttgcacaatctgaaatattttcacttaataaccaaaaacgccagaaatgcaacaaaaaacaacaagaagaaatggtaatattcaattctgcaacaccaaaccataacgctgaaaactttaacattataacagcaaaagatgaagaggttttcacggcgttcccattccctcctgcaccactacacatcgaaaatattatcgaagaaaataaattctttccagattcgtcagagttaccattatacttggcgtccccaaatgatgaatttggaatggaacacatgattctacagagctcagattcagatcttactgaattgatatcaactccgacttcgatttcaaattcctcatttggtggagaaggggtggattatgaacctgaaatcacatttgacattgaagaattcttcatttaatttgaaatttagagaattcattgcaagtttgtaatagcaggaagtaagttttgtgcaataatttttgttgttatttttagcctaattgatcctaagctaaagtcaattgactgatgtttaagagaaatagttgtagtaaaattgtaacgtcgatgaattcatgtttgtaattacaagctttcgctattgaaattcaagttgcatttcaattt

SEQ ID NO: 298 - DNA, 1419 bp, Solanum lycopersicum
acaaaacagcacatatatatagagacaaaatcacataatacgccctcgccggaatcttattttcactgtcgccggccgttaaaactttttttttctagttcggaggtcaaataattaacctccgatcggaagaagtagttattctaactgcttctatttaatctgaaaacgggaaaacccctgagctggttaaggtggatttcgtgatgggattttgtatttgtcctttggaaactcctgctagattactgtggagtactagtttcttccgccacaagcttatgctcttctaaaacttagtcaactctcttttttcatacacatccctgctaaaaaagaagaactctgtgctggagtttttgttttcctttttctgtttcgccggaaacatataaataatcttctgtgtgtaaataggcgattttccagatagttgaaaatatgggatctgggcatatatttttcgacccgtcgtcgtgtcacggcaacatgctgttccttgggagcggagatcctgttttccgaggaccaagatcgacgatgatgaagatggaggactcctcgaagaggcgacccttctttagctcgccggaggatctatatgacgaggaatactacgacgagcagtcaccggagaagaagcgccgtctcactcctgagcaggtgcacttgttggagaagagctttgagacagaaaacaagctggagcccgagcgcaaaacccagctggccaaaaagctggggctgcagcccagacaggtggctgtatggttccaaaaccgccgtgcccggtggaagaccaagcagctcgagagggattatgatcagctcaaatcctcttatgactcccttctctctgattttgactccgttcgcaaagataacgataagctcaaatctgaggttgtttcattgatggaaaagttacaggggaaagtggttggaggagcagggggaaatgaaaaatctgacatcttggaggtggatgctatgacgatccttcaagtgaaggtgaaggctgaggaccggttgagcagtggcagtggtgggagcgcggtggtagatgagcatagtccacagctggtggacagtggggactcatattttcacactgatcatgaggagtatccagggcctggaggatgcaatgttcctccacccatggatggtttacaatcggaggaagatgatggtagtgatgatcatggcagttgccatggctacttctctaacgtctttgtggcagaagagcagcaccatgaacaaggagaagagcctattggatggttctggtcttaattgaattttagaatattatattacagtttttcttatctacgcgcgctttgtatgatgaaataagtgtcgtaattccaacttcttatttaaacatctattaatatgcttttgcagctttta

SEQ ID NO: 299 - DNA, 2030 bp, Solanum lycopersicum
gtaacacagtttttggcggacctttcaatcttgtttggaacagagtcttcagttttattgctttcttgttttcatcgacatcatcaactttctcattcttcaaatctaccgcacacccacctcctcattcattctcatttctctgtcagagtagtaattgttcttgcaggaagacaggaatcggattacattgatcaggaaatggattctgcagccatgactagcgtttgtggcaaatctgctctttgctctactcccggtttatttttggggagaacgaacggtattaggagctcgcagtgtagctttatagctggaaataggataaactttccaaggcagacagctcaagcacacagagttcgtactaattctcgcaagggtcatggtgctcttactgtgacatgccgcgccgagaaaattctggtggcaaatagaggagagattgctgttcgcgtgatccgaactgcccatgagatgggaattccttgtgttgcggtttattcgaccattgataaagatgccttacatgtgaagctagctgatgaatctgtttgcattggagaagcaccaagtaatcagtcgtatttagtgatcccaaatgtcttgtctgctgctatcagtcgcggatgtacaatgttgcatcctggatatggtttcctttctgagaatgcaagttttgttgagatgtgcagagaacatggaatcaactttattgggccaaatccagacagcataagagtcatgggtgacaaagccactgctagagatacaatgaagaatgctggtgttccaactgtaccaggaagtgacggactattgcagagtactgaagaaggtgtaaagcttgccgaggagattggttaccccgtgatgattaaggcaacagctggtggtggtggacgtggaatgcgtcttgctaaagaacctaatgagttcgtaaaattattgcagcaagctaagagtgaagcagcagctgcatttggaaatgatggcgtttatctggagaagtacatcgtaaatcccaggcacattgaatttcaggttttggcggacaagtatggtaatgttgtacactttggagagcgtgattgcagtattcagagaagaaaccaaaagttgctggaggaagcaccatccccggcattgacaccagagctgaggaaagccatgggtgatgcagctgtggcagcagcagcatctataggttacattggtgttggaaccatagagttcctattggatgagagaggctccttttacttcatggaaatgaacactcgtattcaggtagagcatccggtgacagaaatgatatcctctgttgatctgatagaggaacagatccgtgtcgctatgggagaaaagctccgatacaaacaggaggatattgtgcttagaggacattcaattgaatgccgtataaacgcagaagatgctttcaaaaacttcagacccggcccagggagaatcacttcatatttaccagctggaggtccatttacgcgtatggatagccatgtttatcctgactatgtggttccacctagctacgattccctgctaggaaagctcatcgtatgggctccaacacgcgagagggctattgagcgcatgaaaagagcacttgatgacaccgttatcactggagttcctaccacaatagaatatcataaactcatccttgatatcgaggactttaagaacgggaaagttgatactgctttcattccaaagcatgaggaagagttagctccgcctcagcaaattgttccagcagcaagcaaggagctgatcaatgccaatgcttaattattcttctattttagttttagttttttcttctttgattttcttacttcatcaagtgaatatagtttaagaacattactctcattggaacttgaagtgagtgcatttttggatataactttcatctccttttatctttagcttgttgtatttaaagatacacaagactgaatgaaattattctctttttataaatttatcttattatgtgatttcaa

SEQ ID NO: 300 - DNA, 1060 bp, Solanum lycopersicum
ctaaaacagctctggaaattcatgagaaaacagagctgttggaaacaatcttgaaatagcaaagcaaacttgtgaaaattaatatgatgacttcaagggttatttttactattccttatttctcttttccatccatttccaataaatccccataccctaaactaattcctgatacatctgctcccatttgttatgctatttgttgctcaacttcaactcctggattaccagttacaacagaaatacttaggaatgatactcctttgactggtggagcatttgattttgaaaatgccactacttctctaactaaaagagtgttagcttcaccgaagaaagttactattgtacgccatgggctcagctcttggaatgaagaaagtagagttcagggaagctcaaacttatctatactctctgaaaaaggaacaatgcaagcagaaagatgcaagatggccttgtccgatatacactttgaccaatgtttctctagtccgatatcacgcgccaagacgaccgctgaaatcatatggaaagggaaggaagagcctctggtttttcttgattccctgaaggaagcccatctattttttcttgaaggcatgaaaaatgaggatgctaagcgcatatatccaaaggagtatacaacttggagagaagatccatctaagttttgtgtagatggtgtatatcctcttcaaaaactgtggggaagagcacatgaagcatgggaagaaattttattgacaccgggagagcactttttggttgtgacacacaaatctattttacgagcattgatctgcacagctcttggactaggaccagaacggtttcgttcagtggatataaataatggaggattatgtgtattcaaattcaacaaagaaggagaagccatgcttcaatccctgaacatgacagcacatatgtatactgatcacgtctaccactattaaaatcaacaggtacaatgactggacaaacaattgatcagcactacgccattgaaacaacatagaaccacataaacgtacaatgtctgtgtagtatgtgagtt

SEQ ID NO: 301 - DNA, 1493 bp, Solanum lycopersicum
ttatgctgcacttgtgaccttgcaatagtagtgctttcaaagaggttgagctttgttgaaagtacacaatggaggcagtacgtgaactctacaacagagccaaaccctttcttgcagtcatttttctccaatttgggctagcaggcatggatattctcaccaaagtggccttgaatgaaggaatgagtaactatgtatttgttgtgtaccgccatgcagttgccactttggttattgctccttttgcaataattctagacaagaaagtaagaccaaagatgaccccctcaatatttgctaagttggtacttcttagcttactggagcctgtcatcgaccagaatctctactctattggcctgaaatacacaacagcaacgtttgcagctgcaatgtgcaacattcttcctgccattacttttataatggcctggatattcaggcttgagaaggtgaagcttacaagcatccgcagccaagccaaaatagttgggactgttgccacagtggcaggagccatgatcatgacactggtacgaggtccaatagttgaactattttggacaacaggaaatgccggtcataactctcaaagtggtgggttaaatctaagccatgctatcaaaggttccatcatgataacaattgggtgcttcagttgggctgcattcatgattttgcaggcaatcacactgcggacttatcccgctgagctctcgctcactgcttggatatgcttgttgggaacaactgagggagccatagtagcaatggtaatggagagaggaaaacctgcagtgtgggccataaactgggactctaagtttcttgcagctgtatacagtggaatattctgttcaggactcgcgtattatattcaaggagtcataatgaaagacaggggccctgtttttgtcacagctttcaatccattaagcatggttattgtagctgtattgagtacaattattctacgtgaacaactgaacctgggaagggtactcggtgctgttgtgattgttgttggactttacattgtcctatggggtaaaagtaaggatcacaaatctccatcaatcgatgaacaagcaataccaacacatgaaaccaaaattgacaaggaaccttttagtcagacagttacccacatcaattcatcgaaaggaacaactgctaccgaagatgaaggcatataatgattttctatttgaggctttgtcttccaaattccaaaaggaggtctggctatagagcagcctcttcatctaagaaatgagctcctcttcagctgcatcttgaattagtaattattagttaaagatggtttacagcgtgtggccaaatttaagccagttaaaccaccatttttgggaacttctttctgaactatagaatgactaaactatgttaagcctataggccttttcttttggtttttaatcgatattaaaccatgtataataaattatagtaacaacaataatcatgcccag

SEQ ID NO: 302 - DNA, 1440 bp, Solanum lycopersicum
aactaattacattttgcttcttcttcaactgacatttcttcaatcattttccgccgccatttcaccgctgctcctcaccggaaaaatgaacactccggcactttctctccgtcacaaccatttcctcaatggcagctccgctctggtatccggcattcgtctaccacgctcctcctcttcccctttccgtgtccgtatgtctctccaggaaaacggtccatccgtcgccgtcgtcggtgttactggcgccgtcggtcaagagtttctatccgttctatctgaccgtaacttcccgtaccgttctcttaaactccttgctagcaaaagatcagctggaaaatcgatgaagtttgaggaacgagattatactgttgaagaactcactgaggatagttttgatggtatagatattgcattgtttagtgctggtggttcaattagtaagaaatttggacccttggctgctcaaaagggaacaattgtagtggataatagctccgcttttcggatggatgagaatgtgcctcttgtgattccagaagtgaatcctgaagctatggcacatgtcaagcttggttctggaaagggagctcttattgcgaatccgaattgctctactattatttgcttgatggctgttactcctctccatcgtcgtgctaaagtcaaacgcatggttgttagtacatatcaggcagctagtggtgctggtgctgctgcaatggaagagctagtgcagcagactcgtgaggtcctggagggaaaagaaccaacctgcaatatctttaaccagcagtatgcttttaatcttttctcacataatgcacctgttcaacccaatggatataatgaagaggaaatgaagctggtcaaagaaacaagaaaaatatggagtgacaaggatgtcaaggttactgcaacatgtatacgtgttcctgttatgcgtgcacatgctgaaagcgtgaatcttcaatttgagaatcccctcgatgagaatactgcaagggatattcttaaaaatgcaccaggtatagttgtagtcgatgaccgtgcaagtaatagattcccaaccccacttgaagtttccaataaagacgatgttgcagttgggagagtacgtcgtgatgtttctcaagatggagattatgggctggacatctttgtttgtggtgatcaaatacgcaagggagccgcccttaatgctatccagattgcagaaatgttgttgtagatttgcgatatagcacccttaaaggttctaattttggctccaaatgtgagagacagagaatcttaaaggtagtattcctttagcattacattttgctcagcaaaacttgggaatcctcatttacgttagttgagttcattctagtttggagagagattttacttcaattcaaactcttgtttctgtcaaacttctgttatttataataa

SEQ ID NO: 303 - DNA, 1251 bp, Solanum lycopersicum
agtaaatgcaaagtccagaagcatcttatgtcactttcaacttacactatctgccttttatacactctgcactctctcttaaattctcttccatcaatactactactttctatctttcattcttatggcatcctctccacctgatcaagaacaacaaccacctcaatttcctccacttcactacaggacatgggttttgaaagtttccatccattgtccaggctgcaagagaaaagtcaagaaagtcttgcaaagcattgaaggtgtttatactacggatattgatccacaacaacagaaagttatagtgactggaaatgttgaagctgaaactttgataaaaaaactgataaggaatggaagaagtgctgagttatggccagagccgaagcctatattaaaagagaaaaaaccaaagaaaaatgaaaacagcgaagacgacgatgatgatcatgaagatgatgaacataataataataataataatgaaaaaccagctgaacatggtcctccaagacatggtgtgaggtttggcggggttgagacttttacgatggatgtcaaagaagtaaggccagatgaaaggccgccggaaaatatcgccgtcgttgagaggttcccggcgccggagcaaaaggccggcggcggtggaggagctaagaaaaagaagaaaaagaaaaagaagaagagtagtagtgggaataacaatgcaaatccaaatgcgagtgcagggtctaatggtgcaccgccaggtagcgaatcagatgctgcgaaaatgggtcccaatcagatgatggatcaagcgaatcaaggccattcaaatcagcatccttatcctaacccgtgtgatcagcatccacacgctagttattatgttcctcagcagcatcagagttatattgtgagttacaacgcggcacatcctatggtaagcagtgcgccggcatattactatgttccatcatcaccgtacatgcaatctgatatttattctaagcaacaatgtacaccgttagattcttttgagatcttgagtgatgaaaaccctcatgcttgctatatcatgtgatcaaagttgatgtggaattttgtatattaagacaaaatagtattcgaattttggcaggaaattagagttctaatttctgtatttagagttcagataagtagtaagcatattgtagaaaaatgtaatgtgctatactactccctactttatatttcagcttaattactaaccgtttttgatac

SEQ ID NO: 304 - DNA, 3597 bp, Solanum lycopersicum
gataaacaaattatttttttaccttaaaaggctgacatatttacaaatataaccttgtattaactaaaattccatatttagattatactattttgaccaatcctcttcccctgttttcttctgtaaagacaccacctattcttggcaatttccaaataaaaatggcgaaaaagcaaaatgattcttcaagattttcaacaaatcttactccatctccccaaaaagacaaacccatttcatcttcatcagaattagctctgttttaccctcaaaatgaagaaccagttccattgatagtgttttatccatcatcagtcaggagaagatcttctagattcactaccaacaaattcagtactagtgctactgaattcatgacgaaaaatcgggacaccatttcccctgaaaaaactgtttttcttcttccatcaccacctacattggccggaaaaaatactccggcggaaggtacgaggaggtcgccgagattggtatcactgtcagctaggacgacgacggcgaaggagaagggcaaaaaagtaaattcaaggaaatcggagggtggaataaaacaagtggaactatcgaggaagcggaaaccggcaagttgtaaaatggatgaagaaacccgaaaatctccgaggttcaattccgattcctcaaatggagttcaactagcattgccggagatgagcgcgtgcggtgcactcgccgccggcggaagaaccggcacgaagagggaactgctggctctgatgatgacgacgccggcgaacagcagcgcgtcgaggaaacgcgctgccagggggagtgattcagtaaatgtagggaacaattcacgaggatcccggaggaaagatccagtttttgcagaatcgccgggaacatcggtaaaaataacggctgagagcaattcagcgggagagaagaatttaagatcgagaaaagcacaagggagtgttaattataatgagagtaaaggatcggaaacgaaacggataaaaagttcagcagagaaaagtgtgaggaagcagaagagtaatgcatgttttatcggtgagccgatagatacagaggaagctcaacagcaatggcaatggcgatacgaattgaagaatcgaaaaacgcagcgccaagggtggaaattaaattccggcgaagaagatgaaatcatattaaatgtggaatgccattatgctcaagctaaggttgctggtttcattttcaatattggagattgtgcatttgtaaagggtgaaggcaagaaaaaacatattggcaggatcttggagtttttcaagacgacagagggggaagattattttagggtacaatggttcttcagagctgaagatacggtgttgcaaggtgcggcttctttccatgacccaaagcgcgtattctattctactttggagaatgataatttactagactgcatagtttccaaagttaacgtggtagaattaccaaccaggcatgatttgaataaaaaggatgttccacctgctcacttttattacgacatggaatactgtgttgattattccacattccgtacgttgcataatgtcaaaagctctgtctccccttcgctagttgatgtgtcatataagcctatcactacatatcctctggaggtatcaccaagttgtgaacctatgaaagtggagttgtcattattggatctatatgctggttgtggcggcatgtcaatgggattgtgccttggcacaaaactctctggtcttaatcttgtgacgaaatgggcagttgattttaataaagctgcctgtgatagcctgaaactgaatcatcctcagacacatgttaggaatgaaggtgttgagaattttctagagctactgaaaagatgggagaagctaattaagtcgtacggctgtagtgatatcaaaacaagctctaatagtgagctagacgacagagatgaaggcgaaaacaatgatgattctcagtctggttccaatgcatcttctggagaatatgaggtattaagattcgttgacatatgttacggggatcccaacaatgacggaaaatctggacttcattttaaggtgcgatggaaaggttatggtccgagtgaagatacttgggagccaattgagaacttgaaaaattgcggagacagtataaaagattttgttcgaagggggcaacagttgaaaattctgcctctaccaggtgacgttgatatgatatgtgggggtcctccttgccagggcatcagtggatataatcgccacagaaatactgatgacccattgtctgatgaaaaaaatcgtcaaattattatatttatggatgttgtggaattcctacggcctaaatatgtgttgatggaaaatgttgctgacatattgaggttcgataaagcatctcttggaagatatgctttaagccgtttggtacatatgagataccaagcaagacttggaactatggcagctggttgttatggtcttccacaattccgattgcgagttttcttttggggtgcacttccaagtgagaggttgcccccatttccacttccttcgcatgacgtgattgttaaatattggccctcacctgaatttgagcgtaatactgttgcttatgaggaaggacaaccacgtgaccttgaggaagctcttgttcttcgtgatgcgatatctgatatgccagctgtcacatggcatgaaactcgtgaagaaaggccatatgagatgccccctgaaacagagttccagaaatacataagattatctaaacatgagatactgagttgtacatcaactggagtcaaggaaacaaaagaacctgttttgtctgatcatcggccttgccaactaaacgaggacgattacttgcgagtttgtctagtcccacgtagaaagggagcaaatttcagggacctccctggtgtaattgtaggaggggataatgtggctcgtcgtgatactaaagatccaaaggttctaccaaacggaaagcccatggttcctgactgtgcctttaactttgagcatggaaagtctaagaggccatttgcaaggttgtggtgggatgaaacagtagcaacattagtgacgtttcctaatcatcgcgcccaggctatcttacacccagagcaagatcgagtactgaccatacgagagtatgcaagattgcaaggttttccagatttctataggtttactggtactctcaaggaaagatattgccaagttgggaatgctgtagcagttcctgttggtcgcgcacttgggtacgcgcttggacttgcctatcagaggctagctggaaatgagcctcttattaaattgccatcaaatttctcattcttaacacctccaattgatgacattgttgtcttgcaaacataagctcatattcatcatttttttcctcaattggcgatttcggagctactgctgatacttagcagattactccatttttctagtatgaacttttatttaacagaacagatactagactggggcagccaagttgattaatttattgatcaatgaactagcattcctttaatgtgaacctgttttcttatatttataaattctcctttctgaa

SEQ ID NO: 305 - DNA, 1648 bp, Solanum lycopersicum
aagaatattgtgagcaaatcttctttcatttgtaattcaaaaattactactccttctttacttttccaatttagttacatttatatgcaactccacatatattataagccataaattccatggaaaccaaagttatttctagcggaatccaccactctactcttcctcaaagttacatccgacccgaatccgacagaccacgtctatcggaagtagtcgattgtgaaaatgttccaataattgacttaggttgcggagatcaagctcaaataattcgtcaaattggagaagcttgtcaaacttatggtttcttccaggtaattaatcatggtgtaccaaaggaagttgtagagaaaatgctaggggtagctggggaattcttcaatttgccagtagaagagaaactaaaattatattcagatgatccttcaaagaccatgagactatcaacaagttttaatgttaaaaaggagacagttcataattggagagattatctcagacttcattgttatcctctagagaagtatgctcctgaatggccttctaatccatcatctttcagggaaatcgtgagcagatattgcatggaaattcgacaactcggatttagattagaagaagccatagcagaaagccttggcttagagaaggagtgtataaaagatgtattgggtgaacaaggacaacatatggctatcaatttttatcctccttgtccacaaccagaacttacttatgggcttccggcccatactgacccaaattcacttacaattcttcttcaagacttgcaagttgctggtcttcaagttcttaaagatggtaaatggttagctgtaaaacctcaacctgacgcctttgtcattaatcttggtgatcaattgcaggccgtaagtaacggtaagtacaaaagtgtatggcatcgagctattgtgaattcagatcaagctaggatgtcagtggcttcgtttctatgtccgtgtgatagcgcgaaaatcagtgcaccaaaacttctgacagaagatggatctccagctatttatcaagactttacgtatgctgagtattacaacaagttctggagcaggaatttggaccagcaacattgtttggaacttttcaagaactaaaattacaagtcgtttggttcatagggtaaggtatctcccgggattaagtttagaattaaatttatattttgtttggttgagggtgagataaatctatgctttcaatcaaacagaatataaatttaatctcaaacttaatcctgaatatcccatcttctccgatccaattccgatataatttagtcagcaaaccaaatgaccccgaatcataagtagtaccactttcagtactttttttttttaagattcgagttatagttctggggtgggaattaaactaggttgaaaaaagaaaaatggagacaccaattaccttgttgatttacccaaattacatgactactccaatgttttgttactgtcaagtagtgttagcaattgggctggagaaatggactacaaaatctcgttggaataataataatttgtagtagtaatttcattgtatactgtatttgcctcaccgtatgagttattaaaggttgtgataatatattgaaacatcgatgttcgtg

SEQ ID NO: 306 - DNA, 7478 bp, Solanum lycopersicum
atgccgaaaaaacgaacaagagtgcagagctccgccacctaccccctgtgtccgctccctctctctctgtgaagctctctgtttttctgtgtttcgtttctcctcattttcatctccatttatgtgaaaagaaagaaccttttccttcagttttcttgaaaagttagtctggataaggacaacggacagccttttttttttctctatttatccaccgcccccttacgccgcctctagaaccccttttggtttattcatcttttcatgtgatctgctgaaaaatcgactgatttggtcatcttgaacaacggatctgagactttcttgacgtttttaagaatcttggttcctgtataacgttttgttttttttgatattcgataaagatctcgactttaatattatatatatacaaaaatctatcttaaaaactggtaaagatttgaacttgggtgtttttgaatatgtcgattgcttcgagttctgtacttcagaccaagaacaatggcgttgttatgtcatcgccggttaagagtctcgtggggcatcaattgaatgctatgcctttgggtcgggttggtgttggtctcgggagaactagggtgacgaggagctcggtagtgaagaggactaccggtttcgagaaaaagttttatggagccaagcttcgggcttccgggccggaaaggctgcacctttggcaatctgacgggccgggtcgggctccgaagctaagggttgtggtgcgttctgcattgtctcaggtgccggagaagcctcttggactctacgatccatcatttgataaggactcttgtggcgttgggtttgttgctgaactttccggtgaaagtagccggaaaacggttactgatgctattgagatgttagtgcggatgtctcatagaggcgcgtgtggttgtgagactaatactggagatggagccggtattcttgttggtttgcctcatgacttctacaaggaggtaactagtgaggcgggatttgagataccaccacctggacaatatgcagttggtatgttcttcctgcctacctctgacagtagaagggagcaaagcaagattgtatttactaaggtggctgagtcacttggtcatacagttcttggatggcgtccagtccctacagataattcaggactgggcaagtctgcattgcagactgagcctatcattgagcaagtgtttctgacaccaactcctaggtcaaaggtcgactttgaacgtcagatgtatattttgaggagggtggcaatggtagctatacgagctgctttaaacctccaacatggtggcgtgaaagatttctatatatgctctctttcttcaaggactgttgtttacaaaggtcagctgaagcctaatcagttgaaggaatactactttgcagatttgggcaatgaaaggtttacgagctacatggccctggtgcattctaggttctctacaaatacctttcctagttgggatcgtgctcagcctatgcgtgtcttgggtcataatggtgaaattaacacacttcgaggcaatgtgaactggatgagggctcgtgagggtcttcttaaatgcaaagagcttggcctttcaaagacagaaatgaaaaaactgttgcccattgttgatgccagttcatctgactcaggagcttttgatggtgtgcttgagctactgcttagagctggtagaagcctcccagaagctgtaatgatgatgattcctgaagcctggcaaaatgacaaaaacatggatcctagccggaaggcattgtatgaatatttttcagccctcatggaaccatgggatggacctgctcttatgtcatttactgatgggcgctatcttggagctacgttagatcggaatggtctgcgtccaggtcgcttttatgttacatacagtggtagggttattatggcaagtgaagttggagtagttgatattccacctgaagatgtatccaggaaaggtagactaaaccctggaatgatgcttctggtggactttgagaaccatgttgttgtagatgacgatgctttgaagaagcagtactctcttgcaagaccttatggacagtggctgaaaaagcagaagatagagctgaaagacattgttgagtcagtaaattattcctatagggtacctccacccattgcaggagttttgcctgcggtaagtgatgaggacagtatggaaaatatgggacttcacggtttattggctccattaaaggccttcggttacactacagaggccttagaaatgctgctactcccaatggcaaaagatggtgttgaggctcttggttcaatggggaatgatgctccattagcagtgatgtctaatagagagaaacttacatttgagtatttcaagcagatgtttgctcaagtcacaaaccctcctattgaccctatcagggaaaaaattgttacgtctatgcaatgtatggttggtcctgaaggagatcttactgaaaccacggaagaacagtgtcaccggctctcactcaaaggacctcttttgtccattgaagaaatggaagctgtaaagaagatgaactacagagggtggcgcagtaaggttcttgatattacctactccagagaccgtggtacaaaaggtctagaggagaccttagacaggatttgctctgaagcgcatgatgcaattcaggagggttatacagcaatcgtactttctgacagaggcttctcgccgaagcgtgttgctgtgagctctttattatctattggtgctgtccatcatcatttagttaaaaagcttgagcgaactcgagttgcattgattgttgaatctgccgagccacgagaagtgcaccatttctgtacattggtaggatttggtgctgatgctatctgcccttatttagccgtagaagctatatggagactacaggttgatggaaaaatcccacccaagtcaaccggtgagtttcattccaaggatgagcttgtcaagaaatacttcaaagcaagtcactatggcatgatgaaggttcttgcaaaaatgggcatatcaacattggcatcgtacaagggtgctcagatatttgaggctgttggtctttcgtcagaagtgatggagcgatgtttcaatggaactcctagcagagtggagggtgcaacttttgaggcacttgccaaagatgcactcaatctgcatggacttgcatttccatcacgggccttggctccaggaagtgcagaagctgtggcactccctaatcctggtgattatcattggagaaagggtggtgagattcaccttaacgatccatttgccattgcaaaattgcaggaggctgcgcaatctaatagtgtagctgcctacaaagaatattctaagcgtgtacaggaattaaatagacaatgcaatttgaggggacttttgaaattcaaagagggagaggttaaagttcctctagaagaagttgaaccggcaagtgagattgtaaaacgtttttgtactggagccatgagttatggatcaatctccttggaggcacacgctactcttgcaatagcaatgaacaagattggaggcaaatctaacacaggcgagggtggtgagcaaccttctcggatggaacctcttcccaatggtacaaagaacccaaaaagaagtgcaattaagcaggttgcaagtggtagatttggagtctcgagttattaccttacaaatgctgacgagctacagataaagatggctcagggagccaagcctggagaagggggtgaacttcctggacacaaggtcattggcgacattgctgtcactaggaactccacagctggagttggactaattagccctcctcctcatcatgatatctactcaattgaggatcttgcacagttgattcatgatcttaagaatgcaaaccctggggcacgtgttagtgtcaagttggtttctgaagctggtgttggggttatagccagcggcgttgtcaagggacatgctgatcatgtcttgatctccggtcatgatggagggactggtgcctcaagatggactggcatcaagagtgctgggcttccatgggaacttggtcttgcagagacgcatcaaactttagtggctaacgacctccgtggtcgaacagtgctgcaaacagatggtcaattgaaaactggaagagatgtagccattgctgctcttcttggtgcagaggagtttggtttcagcactgctcccctcataacacttggctgcataatgatgagaaaatgccacaaaaacacttgccctgtggggattgccactcaagatccaattcttcgggagaagtttgctggagaaccagaacatgtcataaatttctttttcatgctggcagaggaagtgagagaaattatgtctcaacttggtttcagaacacttactgaaatggttggccgttcagacatgcttgaaatggacaatgatttagtcaagaacaatgacaaattgaagaatattgatctgtccctacttcttcgacctgctgctgatatccggcctgaagctgcccaatattgtatacagaaacaggatcatggtttggacatggctttagataacaatttaatagccctttccaaggctgctttagagagaagtcttcctgtgtatattgaaactccaatctgcaatgtaaaccgggctgttggaactatgctaagccatgaagtgaccaagcgttatcacctcgcaggtcttcctgcagacaccattcatatcaagcttagtggaagtgcaggacagagtcttggggcttttctttgccctggcatcacattagagcttgaaggagacagcaatgattatgttggtaaaggtttatcgggtggcaaaatcgttgtttatcccccaaaaggaagcaagtttgaccccaaagaaaatattgtgattggaaatgtagctctttatggggcaacaagtggggaggcatattttaatgggatggcagcagaaagattttgtgtccgtaactcaggggccaaagctgttgtagaaggagttggtgatcatggctgtgagtacatgactggtggtacagttgttgtgcttgggaagactggaagaaacttcgcggctggtatgagtggtggtgttgcttatgtacttgacttgcattccacgttccactctcattgcaatccagagctggttgatcttgataaagttgaagaagaagaagatatcatgactttgaagatgatgatacagcaacaccagcgtaacacaaacagccaactggcgaaagaagttcttgctgattttgataatcttttgcctagatttattaaggtcttccctagagattataaacgggttcttgcaagcatgaaaaaggaggaagcttacgaagcagcaaaagaacgtgccatcaaggaagcggaggagcaagaagaagaagagttgaaggagaaagatgcctttgaagagctgaagaagttagcagctgcatctaaggatgaatccagtcaggttgaagaggagcagacattgaagaggcccatccaagttgctgaggcagtcaagcatcgaggttttgttgcttatgagcgacagggtgtgtcctacagggatccaaatgttcggatggaggactggaaagaggttatggaggaatcaaaacccggtccgctccttacgacacaatctgcacgctgcatggactgtggaactcctttttgtcatcaggagaactctggatgtcctcttggaaacaaaataccagaattcaatgagttagtgtatcagaatagatggcgtgaagcactggataggcttcttgagacaaacaacttccctgagttcactggtcgagtgtgccctgcaccatgtgaaggatcttgtgtgcttggtatcattgagaatcccgtttctatcaaaagcattgaatgtgccattattgacaaagcttttgaggaggggtggatggtgccacgacctccttctgagagaaccgggagaagagtcgcaattgttggaagtggaccctcaggcctggctgctgctgatcagttaaatagattgggtcatactgtcaccgtgtttgaacgtgctgataggattggtggtctgatgatgtatggtgtgcccaacatgaagaccgacaaaattgatgtcgtccagaggcgggttgaccttatggagaaggaaggggtgaaatttgtggtcaatgcaaatattggaaatgatcctgcgtactccttggatagtcttcgtgaagatcatgatgcaattattttggctgttggagccacaaagccgagggaccttcctgttcctggacgagaattatccggagtccatttcgccatggaattccttcacgcaaacacaaaaagtttgcttgacagcaatctgcaggatggaaaatacatttcagccaagggaaagaaggtggttgttattggtggaggtgacactgggacagattgcataggaacatcaattcgccatggctgcaccagcgtagttaatctagagcttcttcctcagccaccaaacactagggctcctggaaatccttggccacagtggcctcgtatcttccgtgtagattatgggcatcaggaagctgctgcaaagtttgggaaggatccgagatcctatgaggttttgaccaagcgtttcattggagacgaaaatggaaatgtgaaaggactggaggtgatacgtgtacagtgggagaaagatgccagtggaagattccaattcaaggaagtagaaggctctgaagaaattatcggggctgatctggttatgctagccatggggttccttggtcctgaatcgacaatagcagacaaactaggattagaaaaggacaacaggtccaacttcaaggctgattatggacgcttctcaactagtgtggagggggtgtttgctgcaggagactgtcgtaggggacagtctttggtggtttgggccatctctgaaggacgacaagcagctgctcaagttgacaagtttctcatgaaggatgacgaggactcgtctgctgatgcagctagccaacaagaatctgtcaaaaagcagccaacagtcgtgacataagacacttgcttttggcggaggctggttttagtatcttccttcaaacaacttccaagaaaagaaatacataaatagtaaatcaaaatcagctcagctggaacataggataggggggactagttgagaatttctgattctttttttggggagagtttgagggtagggaatagtattttttttgttttttggttgctgcatcttgggtgttcataactatattatgtccgtgccagtttgcttggagggtagctcccaacataagctaagatgaaaaaaataataatatgtacagttcgtttgcccaaaattaagatatggggattttgttgattcatttggtttatgtactttgcaagtaatacattatttctgaaaactttg

SEQ ID NO: 307 - DNA, 2640 bp, Solanum lycopersicum
gtgcttacagagtatcctaaatttactatcaagaaacataattctctactttttagtgactgtattctttaaaaatgcatgcagcttcttcaaccccaagtatttcttgaagtttacagctttaattcctcaaaaagataagcaaaaaaattgcatttgtcatgggaattgcaaaaacagggcagggttcatgttggcttcttgtatacatggtgtttcttctgtttaatttatcagatgagttcttagaaccttcacaatctgaagccatagtgaaaattaagcagcttttgaacttccctcaagatttgagtagttggagtgacaatacagatttttgtaacagtgagccaaacactgccttaacactaatgtgttatgaagataacataacacagcttcatatttctggctataactggttccctaatttgcctcaggggttttctacagatacccttttctctaatcttgctcttttgcctaatttaaaggtgctttctttggtttctttaggtttgagaggaactttacctaaaaagattggatttttatcttctttggagattgttaatatcagttcaaacttcttttatggtgagattccaggacagatttcatatttgaagagtcttcagacacttatattggataataatgagtttacaggccaagttcctgaaggggtaggcttacttcattcgttgtctgttttgagtatcaagaacaattcattttctggttcattgcctaattctttgtcaaatttacaaaccctaagaatcctttctatttctggtaataatttttctggggttgttccaaaccttcataatctgtcaaatcttcaagttcttgatttggaaagtaacaatcttggacctaatttccctaatattccaaccaagttggtatctttggtacttaggaagaataagttcagtttaggggtaccaaaagaactgagttcatgttatcagttaaagaaactggacatttcttctaatgagtttgttggacccttttcaccaacaattttatcattgccatcactcagctatttcgatatttctggaaataaactaactgggaagcttctaaagaatgtgacatgtagtcaagacctttcatttgtgaatttatcatcaaattacttgacaggggagttgcctgattgcttgcaccctagttctggttccaagattgtattgttttctggaaattgtctgtcgaataaagagcaatggcagcatccttattcattttgccataatgaagctttggctgttagtattgagcctcataagagaaaggttaaagggggaaatggtaaagctgttcttgcatcaagtatggtaggaggttttgttggagtagtagcgattgtcggtttggctttcgtggttgttagaagggagtatgtcaagcagaaagctagcaaagcccctcaaacaagattgatacttgaaaaggtctctcctgctcacacacttaagctgcttaatgatgcaaggtatctttctgaaacgaggaagttgggtttgcttggggcccctccttatcgaacgtttgtcttggatgagcttcgagaggctactaataacttcgatatatcaaatctaattggtgcaagctccagtgggcagatttacaaagggcgtctcacagatggcactgtggttgctataagaagcataaaaatgaagaggaggcatactgtccagtcctacactcaccaactagggcgtatttcaaagatcagatacagccacttagttagtactattggacactgctttgagtgctaccaagatgactcaagtgttagccgaatatgtttagtctttgaattcgtgccaaatgtgacgctgcggggggtcatatcagaagcaaattcagctcaaaagtttacttggacgcaacggatgtcagctgcaatagggatagcgaagggaattcagttccttcatactggaatagtaccagggatattctccaatcaattgaagattacagatgtattactggatcagaatttccacgttaagattagcaaatacaacctgcctttgttaattgaaaataagaaaatggatgctggaccgtcttctagtggatcaaagggaaatgatggacaaaggttaaaatacgaggagaaagatgatgtgtatgactttggagtaatcttacttgaaatcatatcgggaaggacaatcgatacaaaaaatgatatagatgtttctaaagacattctaatagttagcttaacagctgacgagatagcacggaggaacatcattgatccagctgttcggaaggaatgctcagatagttctcttagaacattaatggaactatgcataaaatgtctttcagatgaaccatcgcaacgtccttctgtagaagacttgatatggaacttgcagtttgcagctcaggtccaagacccttggaatagagacacttatggcaaccaagagtcccctggtcatgtgtaagaacttatgcaaatatccaatgatcaatggaccttttcttgtacaaaatgtaactttataccactaggatagtagtaattagtttcaattatttagtagcctctattgcagcacttttggctatgaggtttcagtactcttt

SEQ ID NO: 308 - DNA, 1884 bp, Solanum lycopersicum
tagcaaattagccaccaacaaaaagaaatttccaatttttttttcttgataaactttgaggtttttttttttttaattaagaaaaaaatggggttaatttcaaagatagccacaaatgatggacatggagaaaattcagcttattttgatggttggaaagcttatgaaaatgatccatttcatccaacacaaaatcctaatggtgttattcaaatgggtttggctgaaaatcagctttgttttgatttaattcaagaatggatagtcaacaacccaaaagcctcaatttgtacatatgaaggagttcaagattttcaagatactgctatttttcaagactatcatggcttgccagaatttagaaaggcagttgcaagattcatggagaaagtgagaggagatagagtgagatttgatccagaaagaatagttatgagtggaggagcaacaggagctcatgaaagtttggcattttgtttggctgatcctggtgatgcatttctagttcctacaccatattatccaggatttgatagagatttgagatggagaacaggagtacaactttttcctgttgtttgtgagagttctaacaatttcaaggtaacaaaagaagccttagaagaagcatatagtaaagctcaagaatcaaatatcaaagtaaaaggattacttataaacaatccatcaaatccattaggtacaattttggacaaggaaacattaaaagacatattaagattcatcaatgacaaaaacatacatctagtatgtgatgaaatctatgcagcaaccgcgtttagtcaaccttcattcatcagtatctcagaagtcaagagtgaagttgttggatgcaacgatgatttagtacacattgtgtatagtctatcgaaagatctagggtttcctggatttagggttgggattatttactcgtacaatgatgccgttgtcaatattgcacgtaagatgtcaagttttggacttgtttcaacacaaacacaaagattgattgcttcaatgttattagacactatctttgttgaagatttcatcgcgaagagctcgatgagattgttacaaagacatggtttgtttactaaaggattaggtcaagttggaattacaacattgaagagtaatgctggtttgtttatttggatggatttaagaaggtttcttgagaattcaacatttgatgatgaattgaaactttggcatataattattgataaagtgaagcttaatgtttcacctggttgttcatttcattgctcagagccaggttggtttagggtttgttttgctaatatggatgatgctacaatgaagattgcattgagaagaattagacattttgtctatttacaaccaaataagggagttgaagttgcaacaaagaaacaatactgtagaacaaggagcaaacttgaaattagtttgtcatttaggagattggatgattttatgaactctcctcattcacctatgtcttctcctatggtccaagcaaggaattaatcgtacgtatgtggtgttctgatcagcttctacacacatcgttcaattatggacatgtcgactatttcactgagtacctgattgtaagtttacataacataacatagaatggaagtttatatatagtgattctttgtattcttttattaaaagttttttttttttgcctataatatactatggttgcaaaaaaaaaaaatcaagttatgggattttattatattgtgaaatgtgaaattctttttttcttgtgttatatatattttttttcctgtatagctttttgtaagttgaggaaactcaatttgtaatttgagttcaagaggcaaatgcagaggatatatacctatcaatttgtagcga

SEQ ID NO: 309 - DNA, 576 bp, Phaseolus vulgaris
attgaagagggtgtgttttgcgctctttcatcttcacaaaaggaagagtattcgttgtgctgtgttcacaaatccaaagaagtgaagtgaatcggaggatcttcttctgttccatgtgatggctggacttttaggatttaggagccttccacccaaggcaaagaatttggtagttgctgggagtttgacagcttttgtctttggtgcctacttctacaccatgagggctgttggaggcactgatgaactgcaggtagcaattgataagtttgaatctcacaagaccaagaatgagggtgaatccaacatgtcatcaaaggtctaaagctcatgcattgcttctacaacaaaacaatgtattcacttatttgatctgtaatcaagctttttactctgcttaagagtcttgaaaagaagaatgaatgatattgaatctagtgctaataagtttcaagcagccctatgtacaaataatgtgtggtagggaaactataatcgagatcttgttttggccttgccgagtgtttgataatggtaatagaaatctgtgatcatagtattctcaattacaaagaa

SEQ ID NO: 310 - DNA, 494 bp, Phaseolus vulgaris
gcagtgattaggcagcaaagtgacctccctgtctctggcttcggtgtctttgtattttgaggtaattaacaacacaatgtcgctgagacgtttctttggcttttctgatggtgaggtcatgaggtctgatgcaaaaccttgttctcggctaatgaggcacacggctggaatctatagtgttgggggagcattaggtttttggatcctttgtcgactgcattatggtcctcgaattacaaatcctaggagccttcgttgggcagcatgtggagctgtaactgtaagctcaagcacggctttactggttcgtttatttagtcctgaatgtgagccccaaaatatagctgcttacgacaataaaaagtaacactgatattgtcacccttttccttttccgccattaattaatataaaaaagggaaaaaagtaggagtttttgagaaccttttctccccaggacatgggcatattgaaatcacatcactcttgtaaca

SEQ ID NO: 311 - DNA, 1280 bp, Phaseolus vulgaris
cagagtggcattttgtgctttgtcactttttctgttttctttttttctgttttcttctctgtctgatttcaatttcaatttttggaaagctaacattcgcaatttgcaattcaaaatcgtcagtttcttctaaaatttatatagggcattggtcccctttttgaagcttggttgagggactaaagtacagttataggtagaggatggcatgtagggggtgctgggagtgccttttgaagcttttgaacttcatattgaacctcactggtctggcaatagtgggctatggaatctatcttcttgttgaattctctaaagcttcagatgatgacactccggatatttctcctgtcagtgatgattctgctctgattcaacttggccggcccatactcatggctgtgtcattatctaacagcttttttgataacttgcctagggcttggtttatttacttatttattggtattggagtagttctctttcttatttcttgttttggttgtattggagctgcaacacggaatggatgctgcctgagctgttattcaactttggtggtattattgatcttgatagagctgggatgcgcaggctttatattctttgacaaaaactggaaagaagaaattcccacagacaaaactggagactttgatgcgatatatgaatttctgagtgagaattggaatattgtgaaatgggttgctcttggaattgttatctttgaggctcttcttttcctgttagcccttattgtcagggctgcaaataggccagcagaatatgacagtgacgaggagttcattaatccaaggcagcaagttcgtcagccattgctcaatagaccggcagcaggcccatcagcagggctacctgcttctggcacaactgaccaacgttcaagcagaaatgatgcttggagtacaaggatgagggagaagtatgggcttgatacttcggaatttacatacaatccatctgagtcgagcaggttccagcaagtaaactcccagatagctgaagaaaagagccgctgcactataatgtgatctcttttgctgagtattttgttcactccatgacatggccaagatcattttcatgttagcgtgttatattgttctgagacatcgaaatttacagtgcattgcttgtgttcatagattagagagagtagtgaagtcattagatgctcatattgtccttccttgttttgaagtggtccaagttcatcacttgctagtttggaaaactgtgattttctccctaaccccata

SEQ ID NO: 312 - DNA, 1833 bp, Glycine max
tgtcctcgagtgtgttctaaatctaacactgaagcacatcacatcatcagcgagtagagaagaaacacacagaaaacaaggaaagcaatgcctgtgatcgcggcaaagcccaacaaaaacccctccttatacgtccccaagctcttcctcctctgcaccctcttctccattctctccctcgccctcttcctcttcctcatcttccccaccgccacaacaacaaccaccctccacccttctctctctccattctcctcttccacaatcaacgtctacgtcgccgacctccctcgatccctcaactacgccctcctccacacctactggtcctctttctccgattcccgtctccccaccgatgccgatcacaccactcccccttcctccctccatcagacggctaagattcccccttaccccgagaacccactcatcaaacagtacagcgccgagtactggatcacgggcgacctcatgacccctccccaacaccgcgccacctccttcgcgaagcgcgtcctcgacccgcttctcgccgacgtcgttttcgtccccttcttcgccacgctcagcgccgaaatgcagctcggcgccaacaaaggcgccttcagaaagaagcacgacaacgacgattacaagcggcagaggcaggtcatggacgccgttaaaaacacccatgcctggaaccgctccggcggacgtgaccacgtgtttgtgctaaccgacccggtggcgatgtggcatgtcaaggacgagattgcccctgctgttctgcttgttgtggattttggcggttggtaccggcttgactcccgaggtggttcaaactgtagcgagagtgatgtgattccgcacacgcaagtttctgtgattaaagatgtgattgtgccgtacacacatctgctgcccaggttggacttgtcggataacaaggagcggcaccagcttctgtattttaaaggagctaaacataggcaccggggaggtataatcagagagaagttatgggatctattggttagtgaacctggtgttataatggaggaaggtttccctaatgcaactgggcgagaacaatcaataaaagggatgcaaacatcagagttttgcctgcatccagctggggatacacccacttcatgccgactttttgatgcaattcaaagtctttgtatacctgtcattgtcagcgacaacattgagcttccatttgaaggtatggtggattatgcagaattttctgtcttcgcagcagttagtgatgccctgaaaccaagctggctagtcagtcatcttcaaagcttttcaaaagagcagaaagacagattccgccaaaatatggctcgggtacagcccatctttgtctatgataatggccatccaggtggtattggaccaatacctgcggatggtgcagtgaatcatatatggaagaaagttcaccaaaaactgccaatgataaaagaagccataattcgagagagaagaaaaccacctggtgtttcagttccacggcgttgtcattgtacttgaatttaagtagttctttatatttttctacttttaaaggggctaagatatgggttaatgtctggttcgattttctttcttttcttttttcgggttggggggcgtttaattttttggatagtgggatactaatgtgtatggtgtagaagttagttgccattgaccgtgagtagagtgctacttagtatttcattttcgcttcattcttattgcacttgaattaatatgttactactttcacttgcataacaaatcgttgatgtattgaaatatcaatcattgattttatcatcaacaattagg

SEQ ID NO: 313 - DNA, 60 bp, Zea mays
gtatgaagaaggattaaagctgaggccgaatggttcgctaggtttactctcccctcctct

SEQ ID NO: 314 - DNA, 60 bp, Zea mays
cggcacgactcccagtggccaagtacactcacccgctcgcgcgcgtgagcgatgaaagct

SEQ ID NO: 315 - DNA, 60 bp, Zea mays
aatctattggcgggctggcggctcctgtctgtgagtcgcagactcgcagtagccagtaga

SEQ ID NO: 316 - DNA, 60 bp, Sorghum bicolor
cgacctatatgtaaaccacccgcccgcttccaccctacgccacagaaaaaacgcaggtgc

SEQ ID NO: 317 - DNA, 60 bp, Sorghum bicolor
cacagtgcctccttcccgaccgccctccccggcgcgaccccgcccggcagcccctctcca

SEQ ID NO: 318 - DNA, 60 bp, Sorghum bicolor
catctctccgactcacctctctgtcctctccctgtgcaagccgtcgctagcgcctgccgc

SEQ ID NO: 319 - DNA, 60 bp, Zea mays
ctcactctcactccgtcctccctcttccttacagaaacacaactcatgcagctcgtacgg

SEQ ID NO: 320 - DNA, 1328 bp, Gossypium hirsutum
aaaaaaataggcttcttcgttcttttcctctgtcactgccgccaccccatctttgctccgccgctgattccaccgccccactgccagtgactttgaagctgtttatattcaattagaatgtcttcttcaccattattttctatgagcacgatgaaaagggattcgtttgttatgaaaacgataacttcgaacaaagagttcaagtttaatgtttcgaattccttcgataagctacctgttacgagtcctacattgttgttaaccggtgagaactcgttgaaatggggacaaaacgagagtcttttaaggaatcgaatgcaatgctgtgcagtggaagtcaagaacatgcctgggtatccaatggggaagaagtttgaactcgatgatgtgattgaagctcaacaattcgatagggaaactttaaatgctatatttgaagttgcgaaagagatggagaatatcaaaaagaactcacccggaagtcaaattctcaaaggttacctgatggccacccttttttatgaaccttcaactagaactaggctttcattcgagtcggccatgaaacgattgggtggtgaagttttaacaactgaaaatgctcgagaattttcttcggcagccaaaggggagacccttgaagatactattagaactgttgaagggtattctgatataattgtgatgcgacactttgaaagcggtgctgctaaacgagcggcagctaccgcaggcattcccatcattaatgctggtgatggtccgggtcaacatcctacccaggcccttttagatgtctacaccatagaaagagagatcggaaaactagatggcatcagagttgggcttgtcggagatcttgccaatgggagaaccgtccgttctcttgcctacttacttgcagagtaccaagatgtgaagatatactttgtttcccccgacgtcgttaaaatgaaggacgacattaaaaagtatctaacacggaggggtgtcgagtgggaagaaagtggtgatttaatggaagtggcgtctaagtgcgatgtggtataccaaactcgtattcaacgagaacggtttggagaaaggatcgatctttatgaagaagctcgtggtaagtatatagtggatgagaatgtgttgaaggtaatgcagagtcatgctgtggtaatgcatcctctcccgaggcttgatgagattaccgtcgatgttgatgccgatccgagagctgcttattttagacaagcaaagaatggtctttatataaggatggctcttttaaaattgttgcttgttggatggtgaggagaagaaggggctatttttggatt

SEQ ID NO: 321 - DNA, 809 bp, Arabidopsis thaliana
atcgcttctccaaaattttcttcaaagaacaaatctcccaaatctaaaatctttctcttctctcttcgtttccataaccatgtctgcgaagaagattgtgttgaagagttccgatggtgaatctttcgaggttgaggaggcggtggctctcgagtcacaaaccatagcgcatatggttgaagacgactgcgtcgacaacggagtccctcttcctaacgtcacgagcaagatcctcgccaaggtgatcgagtattgcaagaggcacgtcgaggctgctgcctctaaggccgaggccgtcgagggtgctgctacctccgatgacgatcttaaggcctgggacgctgattttatgaagatcgatcaagctactctctttgaactcattctggctgctaattacctgaatatcaagaacttgcttgatctaacatgtcagacagttgcggatatgatcaaaggaaagactccagaagagatccgcacaacgttcaacattaagaacgacttcacaccagaggaagaggaagaggttcgcagagagaaccaatgggcttttgaatgattgatcttcagagagaagaatcaaaagcagcaagcaaccagtttcttcttccttatgtttattgccgttttcaagtgttgttgatgacttgctttttaatattcttcatgaatcatgactatcttcttcctcttctttctttcttatcaagaaccaatgtttcttactctttgtgggatggataatttgtgcttttagataatcttcaagagtgatgttggtttgtcttacaaaataacttctttca

SEQ ID NO: 322 - DNA, 1123 bp, Glycine max
aactcgtggaattgaaagagagataattagaggggttttctctttgagagaatcgtatcttacaacttttcgtgaccacttttagtgagggaagagaagctgagagactccaattagattcaagagagatggccatcagccatgaaacttgggctttcattttcggtcttctaggcaacgtgatctcctttatggtgttccttgctccattaccaactttttaccaaatctacaagaaaaaatcatccgaagggtttcaatcactaccttatgttgttgcactgttcagttcaatgctctggatctattacgcacttgtgaaaaaggatgctagcctccttctaattactattaactcctttgggtgtgtgatagagacaatttaccttgcaatcttccttgtttacgccccaagcaaaaccaggctttggaccatcaagcttcttctcatgttgaatgtttttgggtttggagggatgcttctttcaacactataccttacgacgggttccaaacgtctttctgtgataggatggatttgccttgttttcaacataagcgtttttgctgctccactttgcatcatgaaacgtgtcataaagacgaggagtgtggaattcatgcctttcagtttgtccttgtctttgaccataaatgctgttatgtggttcttctatggccttctcctcaaggactactacatcgcactcccaaatactcttgggtttctatttggcataatccagatggtgctgtatttggtttatagaaacgccaagccacaaacattggaggagccaacgaaggttcaggaactaaatggtcatattattgacgttgtgaagccaaatcatgcaacaaaaaatggtcatgtgcctgtgattgagatagctagcagtgtgtgaaaatgaagcaataatgaatcgagtccaaagagaaagaaaaaaaatgaggccccaaaatatttaagctaaaagtacgattattacttaattactttgccaagtggggcctcatcttaacgcaagaacagtacgtgaagtttggtgtttagggttcttttaagtaacgtgtttgcctcaatttgtagcaataatatgttaggtggtcaattatgttagca

SEQ ID NO: 323 - DNA, 966 bp, Medicago truncatula
acgccttacccgagggaaatagaaaacaaaatccatagaagaagaaaaaaaaaaaaaaaaaaaaaaagaggggaatttctgcaaccctaatttcattgctaaaccctaattgtttcagcattcctctcttaattaatcctcttctcatttttctcgggaaataactcttcagatccacaaataaatcttgcagccatggttttctgggtttttggttatggttcactggtatggaacccaggttttgattatgacgaaaaaatgcttgggttcattaaggactacagacgcgtctttgatttagcgtgtattgatcacagaggaacacctgaaaaccctgcaagaacttgcactttggaggagaaagaaggggaaatttgctggggagttgcttattgcgttcgaggaggccctgaaaaggaaaaactggctatgcagtatttggagcggcgagaatgtgagtatgatcaaaagactcttgtaaacttctacaaggaaggagattctctgcatcccgctcttactggagttattgttttcacgtctacgccagacaaagaaaacaacatatactatctgggacctgctccactggaggatatggctaggcaaatagcaaccgccaatggcccatgcggtaacaacagggactatctttttcttctagaaaaggctatgcataatcttggtcatgaggacgacttggtaatagaacttgctaatgaagtgaggaaagtccttggagtggtgaatgtagtgctgaacgagaaaaaattggttggaccgacgcaacttccacatcagccgcatgtacccattccatcccttcagttgcacccactgccagaacctattgctttggatagttaaggacctggagattactaaaaattgatctcagttcttcatctaaactgatttgatgtggaccctgctaaccatcaatcaattttttaaataatatca

SEQ ID NO: 324 - DNA, 2106 bp, Brachypodium distachyon
acatttacgttgtgtcctcaaccaaactgtacgaagtgacatagtactaggaacgcaaggaatgcaagagtaggatttaatttgtgacactaatcgtcttcatctttttatgtcagacagcaacgctttatttacgatctctggatgcctgggcttgaccgtctccatgtatttagtccacacaaattccctagcgagcactagtagtagtccgtataaaataacagtatacagaagatcgatgcttgggccggtcagtgtcaaagaaaacttgaagcgcgcgcccgcccgagcgttgacatctagataagaaaccatccatctgcgagctcatagccggcgacacggtccacacggaggccagggcatggcggacaccgagacccccttcctgcagcagctcacagccggcgacacggatgaggacgaggacccgccgccgctcgccggcgtctccgacttccgcggccgccccgtccgccgcgcctcctccggcggctggcgctccgccctcttcgtcgtcgtggtggagatcgcggggagcttcgcctacttcggcgtgtcggcgaacctgatcacgtacctgacggggccgctggggcagtcgaacgcggcggcggcggcggccgtgaacgcctggacgggcaccggcaccctcatgccgctgctcggggccttcgtcgccgattcctggctcggccgctaccgctccatcatcctcgcctgcacgctctacgtcctgggctacggcatgatcacgctggcgtcgacgctcccggcgctgcgcccgccgccggccggtgacccgtccccgacacaggtggccttcttctacgggtccctctacctcatcgccgtggcgcagggcgccgacaagccgtgcggcgtggccttcgcggcggaccagttcgacccgggccacccgggggagcgcgccgcacgcggctcgctcttcaactggtggtacttctccatggccgcaggtatcaccgtcgccgtcgccgtcatgagctacgtccaggagaacgtcggctggggcgtcggcttcggcgcgccctgcttcgtcatgctcgccgccttcgccgccttcctcgccggctcccccacctaccgcctcctccacacacccgacgatgccgccaagactagcagcagccccttcgcccgcctcgcgcggagcctcctcgccgccatcaagacgaagaagaagcatcaacagcagctagaggttgaagacgagtcgtcggaggcggcgaggagcgtgctgcggctgatgccgatctgggcggcgtgcctggcgtacggcgtggtgaacgcgcagatcatgacgctcttcaacaagcaaggacgcaccctcgaccgccgcgtccgcatcttcgacgacctggagctcccgccggccgcgctgcaggcgctcgggccggcgacgatcctgctcttcgtgcccatctacgaccgcctcctggtgcccgcgctgcggccgggcgcgctcacgccgctgcggcgcgtgggcaccggcatggcgctgtccgcgctcaccgtgtgcgtggcagcgctcgtggaggcccggcggctagacacggcgcggcagcacgggctcgtcacggtccacgccggcggatctacggcgacggtgccgatgagctgggcgtggctggtgccgcagtacgtgacgatcggggtggcggacgtgttcgccgtcgtcgggatgcaggagttcttctacgaccagatgcccggcgagctgcggagcctcgggctcgcgatgtacctcagcgtcatgggcatcggcgggtttattagtagcgcgatgatctcggtcatcgatcgggttactagcagtggcggcggggatagctggttcgcggatgatcttaaccgggggcaccttgattacttctactggctgctcgccgggttgagcgccgccgagctcgtgatgtatctctgtctggctaggtcctatgtgtacagcaacaggagactgctccgctgaccagcggcggatccaggaaacggcaacgccccgggcaaaaatagaaataacttgtactgaatccgtgccaattaatatagaaaaagacaccaatgattaaaacttcaaaa

SEQ ID NO: 325 - DNA, 2000 bp, Sorghum bicolor
gacacgcacaggcgtttaagaggggaggagattacggaaagcaaagcgcagcctcgatcgatctctggctgtcgactctgcaggcgtcgcgcctacctataaagccctaacctgcgacgacttcaccatgtgtcatcggagcgagctcctctccctcgtgctgtaccaaccagccatggtcgacaccgtcgccggcgccaccgactaccgcggccagccggcctctcgtgccgccaccggcggctggaaaccgtcggttttcgtcatggcgatggagatcgcggagcggttcgcgtacaagggcgtggccgcgaacctgatcacgtacctgacggggccactggggcagccgatggcgcgcgccgccgcgtccatcgacgcgtggaagggcgtctcccagatgctgccgctgccgctcgcgtgcgtcgccgacgcctggctcggccggtaccgggccatcgtcctcgcctccctcatcttcgtcgtgagcatgggctccctgtcgctgtcggcggcgttgccggccttgcgcggcggccacgtggccatcttctacgtggcgctgtacctggtggctctcggcgagggcgcgcacaagccgtgcgcgcaggcgttcgcggcggaccagtacgacgagaaggaccccaaggagagcgtggcgcggagctcgttcttcaactggtggtacttcggcatgtgcgccggcaccgctgtcaccaccatggtctccagttacgtgcaggacaacgtcggctggggcctcggcttcggcatcccctgcatcgtcatcgtcgcctcgctcgccctgttcttgctcgggaccaggtcgtaccggttctacaccaccacggaggccagccccttctctcgcgtcgggaacgcgttgctggcgttgatccacagctgggcgcccaagcatcgcaccagaaaattaggcgatggcgacgaggacaacgccgtcgccgtcgaggaagtgaagagcgtgctccgcctgctgcccatatgggcgtcgtgcataatctacgcgatcatcttctcccagacgtcgacgttcttcacgaagcaggccgcgacgctggaccgccggatcggcgcgaggttcaaggtgccgccggcggcgctgcagacgttcatcagcgtgagcatcgtcgtcttcatccctgtgtacgacaggctcttcgtgcccctggcgcgacgctacacgggaaggccgacggggatcaccatgctgcagagggtcggcgccggcctggcgctctccctcgtcgccgtggccctgtccgcgctcgtcgagatgaaacgactccgtgtcgcgacggaagccggcctggtgaacaccccgaaggcgcagctccctatgacgctctggtggatggtcccgcagtacatcctcatcggcgtcgccgacgtgttcgccatgatcgggctgcaggagttcttctacgaccaggtccccgacgcggtgcggagccttgggctggccctgttcctgagcatcttcggggtcggccacctcctcagcagcttgctcatctccgtcattgacaagacgacagcgaggagcgggacgagctggttctctaacaacctcaaccgcgcccacctcgactacttttactggctgctcactggcctctgcgccgtggagctcgtcgcctttgtgctcttctctcgagtgtatgcttacaagagaaagagtggcaatgatggtggcagtggtgatctcgtgtgatacatatgcagtttgagccgtactgatcactttgaggggtgcctgtagctgtagttgtttgtagagagccagccctctacggagtacggagttgctacgggattctggtgttaacacactacttttccccttatctcttgatttatgattccaaaatgggctagggaagaggacacttggtttaagtttccaaatgggctagttgaggctatatattctcaaatgggccatccccatattattttgggagttggcaaataacaaaatt

SEQ ID NO: 326 - DNA, 1917 bp, Panicum virgatum
ccaatccacggacctgtcgtggacttgtctaggcaggcgggcggggagggaggtctccgtcggccatgtccatggaccccgccgaccgcatgctggcggatcccctcctcctccccctcccagcggcggccaagcaggtgctcgccggcgtcaccgactaccgcggccgccccgtcacccgcggggcctctgggggatggcgatccgcgctcttcgtagtggccgtggagatcgccggcagcttcgcctacttcggcatctccgccaacctcatcacctacctgacggggcccctgggccagtccaacgcctccgccgccgccgccgtcaacgcctggtcggggacggcaagcctcatgcccctgctcggcgcattcctcgcggacgcatacctgggccgatacagatcaatcatcctcgcatgctcactctacgtcctggggtttggcatgctgactctgtcgtccacggtgcctccgctgcgccctgctgcctcctcgcacttgcccagcggcagcagccggccaccgcctcaggccctgcaggtggccttcttctacgtctccctctacctcatcgccctcgcccagggcgccgacaagccctgcggcctcgccttcgccgccgaccagttcgacgccaaccaccccgccgagcgcgcctcccgggcctccctcttcaactggtggttcttctgcatggccatcggcatctccgtcgccgtctccgtcgtcggatacatccaggacaacgtcggctggggcgtcggcttcggagtcccctgcgccatcgtgctcgctgcattcgccgtcttcctcatgggcacccccacctaccgcctctaccaacacaagaagaagcagccaccaaaggaggaggaggaggaggagcagcagcagcagcagaacaaggccatggccagcagcgcgctccgccggcttctccccatctgggccaccagcctcgcctacggcgtcgtgtacgcgcagatcatgaccctcttcaacaagcagggccgcaccctggaccgccgcatcgtgggagccatccagctcccgcccgccgcgctgcagacgctcggccccgccagcatcctgctcttcgtccccgtctacgactgcgccatcgtgccggcgctccgctgggccaccggcaacccctccggactgaccatgctgcagcgcgttggcgccggcatggccacgtccctggccgcggtgtccgtcgccgcgctcgtggaggcgcgccgcctcgccacggcgcgggagcacggcctggtggaccagccgggggtcaccgtgcccatgacctgggcatggatggtgccgcagtacgccatgatgggggtggccgacgtgctcgccgtcgtcggcctgcaggagctcttctacgaccagatgcccgacggcctccgcagcctggggctggcgctctacctcagcgtcatgggcatagggggattcatcagcagcctgctcatctccatcatcgacggcatcacatccaggggcggccgggacagctggttcgcggacaacctcaaccgcgcgcacctcgactacttctactggctgctcgcggggatcagcgccctggagctcgtgctctacctaggcttcgcaagatcctacgtttacaaccaccaacacctagctacctaggcttcgcaagatcctgcgttcggctgctcttctcccctccagcgctatagtaatttcctctcgcaccactccagctactagctccagctccaaccagcccaacagtatttttctctcatcccattccagctccagcctccagctccagcctccagctccagcctgccgaacgcggttgctagtgtggtgtcgtgtgtaacgaacgaacggtgcgtgggtgtaaataacaaacaaaaccattcatcattcatcaacc

SEQ ID NO: 327 - DNA, 2344 bp, Phaseolus vulgaris
caaaacatttggagtgaacacttgaagatatctgttatcaggaggaagtaaggtgaagaaaatgtggaggctgaagataggagatggaggaaagaatccatacatatttagcacaaacaattttgtaggaagacaaatatgggagtttgattctgaagcaggaactgatgaagaacgagcccaggtggaagctgctcgtcaacatttctatcaaaatcgctttaagctcaaggcttgtggtgatcgactatggcgatttcagattttgagggaaaagaaattcaaacaaaaaacaaggaaagtgaagatagaagatgatgaagaaataacatgggagaaggctactctcaccctaaagagaacctctcattacctgtcggcactgcaaactagtgatggccattggcctgctcatctcgggggttcccactttttcattcctatcatggtcatttctatctacagcacgggacatcttgattctgtacttccgaaagaatatcgtaaagaaattctccgttacttatataatcatcagaacgatgatggagggtggggattacacatagagggtcctagcacgatgtatggtaccacactaaattatataagtatgagacttctcggagaaggagctaatggaggtcataacaatgcttgtgttaaggctagaaaatggattcatgatcatggcagcgtaacacatgtgccttcctggggaaaattttggctttcggtacttggtatagttgattggagtggatgcaacccattgccgcctgaattttggatacttcccactattctccccatgcatcctgctaaaatgtggtattattgccgacatgtatatatgcctatgtcatatatatatggaaaaagatttgtgtgtccaatcacaccattgattagagaattaagagaagaactctttattcaaccgtatgatgaaagtatttggaagaaagcacgtcacaaatgtgctaaggaagatctctattatccccatcattggatacaagatctaatatgggatagtgcttatttagttactgagccacttcttacacgctggcctttcaataagttgattagagaaaaagcacttcaagtagcaatgaagcttattcactatgaagatgaaaatactcgatatatagatggtggttgtgtgaacaaggctctgtctatgcttgcatgttgggtagaagatccaaatggagatgcttttaaaaagcacgttgcaagggttccagattatttatggctttcagaagatggaatgtgtatacatgcacttagtacgcaatcatgggatgctggttttattgttcaagctcttcttgctactaatctaattgatgatcttggtcccacacttgcaaaagcacatgattttatcaagaaatctcaagtagtagaaaatcgttcaggagattttaagagtatgtttcatcacatttctaaagggtcttggacccttgctgatagagaccatgcattacaactttctgatggcactgcagaatgtatgaagtgttgtttacttttatccatgttaccagaagagattgtgggagaaaaattggaacctgaaaggttatatgattcagtcaattttttattgtcacttcagagtaaaaatggaggtgtaactgtgtgggagccagcaatagctcaaaagtggttggaacatctgaatcccgcggaatttctggctgacatagtaattgagcacgagtatcttgagtgtactggatcaacaattcaggctttagtgttgttcaaaaaactatacccaaatcatagaagggaagagatagataatttcattgtcaaagcagcacaattcatcgaagatgaacaattaccaaacggaaattggcatgggaactggggagtttgcttcacttacggtgcctggtttgcagttggaggtttagctgctgctggaaagtcttacagtaattgtgttgccattcgtaaagctgtgaagtttctactctcaatacaaaatgaggatggtggttggggagaaagttatctttcatgtccaatgaagacgtacgtgcctcttgaagggaatcgatcaaatgttggtcaaacagcttgggctctactagctttgattcttagtggtcaggctgagagagatccaactcctcttcaccgtgctgcaaagttactcattaattctcagttagaagatggtgattggccccaacaagaagcattgggggtgtacaagagaagttgtttgcttcattacccattctatagaactgtttttccgttgcaggctttgtctgaatatcgtaacaatgttttagtgccatctacttga

SEQ ID NO: 328 - DNA, 1620 bp, Zea mays
gttagttattttccgctctgttcctcagccgcaacggccgccgcccgccggtcgtcgtcggccacgtcgcgcggtctccggcatccccagcccgcagcctcacaacctgatcgatgctcccctaccacccagtcaaccacacacacgcacacatacacttctcaaaaaaatccctcccgctcccaccgccgtctcctcctcccaatcacattccgtttccattcgcgcggcccgcgccgccgtcatggccgccgcctccctcctcgaggccactcgcttcctctccaccccgcacccacgctcgcgctcgcgcccgctccctttcccgcccggcagcggcctacacccccacctcctcaggacccctcgcctctccactctccgcgtccacctccaccgtcccgctcctctcggcgcgcaggagccggcgaggcctggcgcgctcctggccgtagacgcgctcaggaggtccgtgctcgactccctcgcggcgctcaagcggcccgcgctcgcgctcctcctggccggtgtgctgctcgccgcggcatcggcgggcgggccgcacgcggcggcgctggccgcctcgggcgggcgcgtcggcgggtcggccttctcctcgcgctcctcctcgcctcgatcctacgggtacagcgcgccggctcccaggggcgggtacacggccgctcccttctactctccttcgcccttcgtatccgtcggcccagccctcggcatcggcttcgggggatcggggttcctcgtgaccctcatgggtttcgcggctttcctctacctggccgggttcctgtccgactcgtccggcgctaccagtgtgctcacagagacggagaagaccaccgtcctcaagctacaggttggcttgctgggcatggcacgatcatttcagaaggagcttgatcaaatagctgagaaagcagatacatctaccccagctgggttgagctatgtgttgacagagacaacattggcattacttcggcatccggactgttgtatctcagcttactcatcggtggatgtgaaacgaagcattgataatggtgagaaacgtttcaatcagctttcaattgaggagaggggcaagtttgatgaagagacacttgtgaatgtgaacagcatcaagaggaataaaggaggcagccaaagatcaagtggttttagcaacgagtacattgtgataaccatattggttgctgctgagggagtacataaggtgccggttataaatagcagcaatgacttaaagacagctctacaaaagatgggtgccataccatcgcgcaaaatactggcagtcgaggtcctatggactccacaaaatgagaatgacactttgtcagagcgagagctccttgaagattacccgctcttaaggcctctgtagaaagaagctgctgtagattcagttttggcggttttcttattaactatagcgcagatcttgtgtttgtataaaagtgtataatttgttattgacgtcactgttagccttcatatcagaacatttagcgcatcgcagtacaagtctgcgattgtctgccggtagtcttggtcgctgttcctgacacaataacacaaaattgtaaatagattgttctg

SEQ ID NO: 329 - DNA, 6047 bp, Zea mays
aattattgtaaaatacttttaatattcaaaaacctaattgaacagtcagacgagtgtgcggcaaaagctgaagcaaacaaacgcaaacggctcatcccattcccatcacatgattcccaactcagcgccgcatcgcgtcaccgcaatctcgcagtcatccccccaaattcccatgtactgctcttgctcctgataatggcttgatttctcagtccgcactcgtcactgaggctgggcgctgacgccttccccgtttttgcagctccgcgaccgctagccgtgaggatgagcctcctccgcaaccgccgcgccgccgccgccgcggctgcagcggcggcggcggcgggaggaggggggtacccggagccgccggcttacaacatcatcccgatccacgacgtggtgatgcacggggagcacccgtcgctgcggttcccggaggtgcgcgcggccgtggaggcgctggcgcacgcggcggacctgccgccgcctccgctagcccgcgcctgggacgccttccgtgccgacctcttcgactggctcggcgccaccttcggcttccagctcgacaacgtccgcaaccagcgggagcacctcgtgctcctcctcgccaacgcgcagctccgcgcaggcggcaccctccccaccgaccaccccgccgacgtgctgcaccactccatcgcgcgggacatccggaggaagctcctcaagaactacaagacctggtgctcctacctcggcaagaggccgcacgtccatgtgcccagcggcggacgccgtgtcgctcagggggtcggccctgacacacgccgcgacctactgtacaccgccctctacctcctcatctggggcgaggcggccaatttgaggttcatgccggagtgcctctgctacatcttccactacatggcactcgatctcaaccatgtcatcgaccagtcgattgatatcgagactgggcgaccatcagttcctgcggtgcacggtgtggatgctttccttgacaaggttgtgaagccgatatatgacgtgctcgaggctgaggtgaagttcagccggaatgggaccaagccacactcggcctggaggaactatgatgatgtgaatgagtacttctggagccgcagagttttcaggcggctccagtggcccctgtcaccagcgaggagcttctttataaagccaggaaaccccgggcgtattggcaagactggttttgttgagcagaggtcgttctggaatgtgtaccgcagctttgatcgggtatgggtgatgctcattctgttctttcaagcagcaatgatcgttgcatgggatggccacactccgtggtttagcctacgctaccgtgacatccagatccgggtgctgtctgtgttcatcacctgggctgcgctgcgcattgtgcaggcagtgcttgatgcaggcacacaatacagcctcgtgaggacggatactatatttctcgcagtacggatggtgctcaaggtgcttgttgctgttgggtggactatcacattcattgtgctctatgttcgaatgtggaatcagaggtggcatgaccgcaggtggtctttttctgccaattccagggtgttaaactaccttgaggcagctgctgtgtttctcatcccacaggtgcttgcacttgtgctcttcatcgtcccatggattcggaattttctggagaaaaccaattggcgaattctatatgtgctcacctggtggttccagacccgtacatttgttggacgtggtgtgagggagggccttattgataacattaagtataccacattctgggtgtgccttctcactgctaaatttagctttagttactttctccagattaggccgatggtgaagccaacaaagactattctcagcctccatgacattcggcgtaactggtttgagttcatgcctcacacagagcgaattgctgtaatctttctgtgggctccagttgttcttatttatctcatggatattcagatatggtatgcgatcttctcatcacttactggggcacttatcgggctgttctcacatctgggggagattcgcagtgttgagcaactgcgcttgagattccagttctttgcaagtgcaatgcagttcaatttgatgccagaggaacacctggatgctgtgcacggtggcctccgaagcaagctgtatgatgctatcaatcggctgaagctgagatatggctttggtcggccgtataggaagattgaagctaacgaggtggaagctaagaggtttgcgctgatatggaatgagattattcagacatttagagaagaggacatcattagtgacaatgaagttgagcttcttgagctaccaccagttgtgtggaaaattcgtgtggtgcggtggccatgcttcctgctaaataatgagctgcttcttgctcttagtcaggcaaaagagctagtagctgatgacaggacacactggtcaaggatacgtaacaatgagtacaggcgttgtgctgtcattgaagcttatgacagcatacgtcacttactgctggagatcattgaggatggaactgttgagcacataattttcagtcagctgttctttgcatttgatgctgcaatggagaatgggaaattttgcgaagaatataaaatagaactgttgcctgaaatccattcatctgtaatcgccttagtggaacttctactgaaagagaagaaggatcagaccaagatagtaaataccttgcagactctttatgtctttgcaattcatgattttccaaagaacaaaaaggatatggaacaactgaggcgagagaggctagcaccatcaacactagaggattcccgtctcctctttgaggatgtcataaaatgcccaggcaatgatgatgttagcttctacaaacaggtgaggcgcctccatacaattctcacctccagggattctatgaacaatgtcccaaagaatcctgaggctcgacggcggataactttcttcagcaactctctattcatgaatatgcctcgcgctccaacagttgagaagatgatggcattcagtgttttaaccccatactacaatgaagatgtgatgtacaacaaggaccaacttcgccgtgagaatgaagatggtgtctcaattttgttttatcttcaaaagatatatgaagatgattggggaaactttttagaacgtatgcagagggatggaatgactgatgacagtgaaatttgggctgggaaatatcaggaactccgactctgggcctcgtatagaggacagaccttagcacggactgttaggggaatgatgtactaccacagagctctcaagatgcttgcttttcttgataccgcctccgaggtagacatcacagagggtactaaacatcttgcatcctttggttcagttaggcatgagaatgatgtgtatcccatgaatggtggtttccggcggcaaccacaaaggaggttagacagaggaaccagtactgtaagccaactgtttaaaggtcaggaagatggtgctgctctcatgaagtacacctacgttgtcacttgccagatatatggaaagcagaaaattgctaaagatcaacgcgcagaagatattttaactctaatgaagaaaaatgaggcacttcgtgttgcttatgttgacgaggtccatcaacgaggctatactgaatactattctgtcctggtaaagtttgaccagagcttacagagggaggttgagatataccggattaggttaccaggtgaactgaagcttggggaaggaaaacctgaaaaccagaaccatgccatcatattcacaagaggtgatgcagttcagacgattgacatgaaccaggataatttttttgaagaggccctcaaaatgcgtaacctgttagagcagtacaactattatcatgggagcagaaaaccaacacttctgggagttagggaacatgttttcactggatcggtctcttcgcttgcttggttcatgtctgcacaggagacaagctttgttacccttggtcagcgagtcctagctaatccgttgaaggttcggatgcattatgggcatcctgatgtatttgatcgcctctggtttttgactcggggtggtttaagtaaggcatcaagagtgatcaatatcagtgaggacatctttgctggtttcaactgtaccttacgtggtggcaatgttagtcaccatgagtatattcaggttggtaagggccgtgatgttggcctcaatcagatatcaatgtttgaagcaaaggtttctagtggcaacggtgagcagacccttagtagggatgtctacaggcttggtcatagactggatttctttcggatgctctctgtgttttatacaacagtagggttctacttcaacacaatgctggtggtcttgacagtttatacatttgtttggggacgcctgtatctagctctcagtggtcttgaggctggtatccagggcagtgctaattcaaccaacaacaaagccttgggtactgttcttaatcagcagttcatcatacagcttggcttcttcactgcattgccaatgattatagagaactctcttgaacaaggtttcctacctgctatctgggatttcttcacaatgcaaatgaatttttcatctgtgttctacacattttccatgggaactaagagccattactatggccggacaatccttcatggtggtgcaaaataccgtgctactggccgtggttttgttgtgcagcacaagagttttgctgaaaattacaggctgtatgctaggagccacttcataaaggcaatagagcttggaataatattgactgtgtatgctgcacacagtgttattgccaagaatacacttgtttacataattatgaatatatctagctggtttctggtggtatcatggattatggctccatttgcttttaatccgtctggttttgattggttgaaaacagtgtacgattttgatgatttcatgaactggatatggtatcctggtggtctcttttctaagcctgagcagagctgggaagtgtggtggtatgaagagcaagatcatctacggaccactggtctttggggaaagattttggagatactgttagatctcaggtacttctttttccagtatggggttgtataccagctgaagatagcaaacaatagcagaagtattgctgtctatctgctttcctggatatgtgtggctgtgatttttggtctgttcgtgctaatgtcctatgctcgagacaagtatgccgcaaagcagcacctttactaccgggttgttcaaactgctgtcatcactcttgtagtgctagtgctggttttgtttctgaagttcacggaatttcaaatcattgacatcttcactagtcttttggcatttattcctactggttggggcttgatttcgatcgctcaagtaattcggccattcatcgaatccactgtggtctgggacagtattatttctgtggctcgtttgtatgagatactgcttggagtgttcattatggcaccagttgcattgctgtcctggttgccgggatttcaagaaatgcagacaagggtacttttcaatgaaggtttcagcaggggcctccagatatcccgtattcttactgggaaaagaacaaatacagtttgaggttctgacccagattgttgcggcggtgaaggtgaagcagcggtgctctatctcctatgtacagcttagcaattcagtgtggaagggctttgtgcttactgatatagcttagatccatattgaactcttccagtagcttttatagctatctagtttaggagtccagatttgtgattttggcaatttaggtattcagttcttttgtacattggttgagctagttgtgtgtagctgattctattgcagcaccaccggtgagctctagtgacctatttgttgacctctgctggaagttgcatcttttgtgctagcaactgtgtcgtgactcgtgagtgctattgctctgctgaaggtataaaagttgctggaaaggatgttcctgg

SEQ ID NO: 330 - DNA, 1449 bp, Zea mays
gggcgtgtgagtgatggacgatcccccaatcctgcgtccaccactcatcactctccccccactcatctctcctgccccgccaccccaccagcgatggccctgtgcgccgccgctgcctccacggccaccgcctccgcgtcggcccatctatcggcctccaccgctcgcccgcggggcccctcctcgacgtcgctgccgtcgtccttcgtcggcgcgttcccgtgcgcggtcgctgcgaggacgaggaggaggcgcgcggcggcggcggcggcccgcgccaccgtcacggtgcgcgcggaggccaggaagagcgtgctgatcgtgaacaccaacggcggcgggcacgccgtcatcgggttctacttcgccaaggagctgctcgccgccgggcacgccgtcaccgtgctcaccgtcggcgacgaggcctccgacaagatgaagaaacccccgttctcccgcttctcggagctgacgagcgccggcgggaggacggtgtggggtgacccggctgacgtcggcgcggccgtgggaggcgcgtcgttcgacgtcgtcctcgacaacaacggcaaggacctcgacgccgtcaagccggtggcggactgggccaagacggccggcgtggggcagttcctgttcatcagcagcgcgggcatctataagccgacggaggagccgccgcacgtggagggggacgccgtgaaggagagcgccggccacgtgggcgtggagaagtacatcgcggagcagttcggcagctgctgggcgtcgttccggccgcagtacatgatcggctccggcaacaacaaggactgcgaggagtggttcttcgacaggatcgtgcggaaccggccggtgccgatcccggggaacgggatgcagctgaccaacgtggcgcacgtccgggacctgtccagcatgctgtcgctggccgtggagaagcccggcgcggcggccggcagggtcttcaactgcgtgtcggaccgcgccgtgacgctggccggcatggccaagctgtgcgcggcggccgcgggcgccgacgccgtggatatcgtgctctacgaccccgccgccgtcggcgtcgacgccaagaaggccttcccgttccgcaacatgcatttctactcggagccccgggcggcgaaggaggcgctggggtggacgagcaccaccaacctgccggaggacctcaaggagaggtacgccgagtacgccgccagcggccgcggcgacaagcccatggccttcgacctcgacgacgtgatcctcgctgccgtcggcaaggcgccggcgagcgtcgccgtatagtatagtataataacacccggccggcaccgacagcgccgcaccacaccatcgtctatactctatactcccggtggcgtccggtttagagatttctctcgtaaaaactacgtacgcccgacatgcacgacgtcgcaaacgaacgtt

SEQ ID NO: 331 - DNA, 1655 bp, Glycine max
atggacattaacaataacaaatgagttccacaactatgttgttgttggtcgtgttcatgattctatgtatttcatgcccctcatttcaaatggtactctttgcctctaacacacactctttcccaaacccaattcaacaacacccaccacctcctcaaatctacctcaaccctttccgccaaacggttccgccgccaactctccctcccactctccccgggcagcgactacactctctccttcaacctgggcccacgggcccaagcccagcccataacactctacatggacaccggcagcgacttagtctgggaaagcccaatgcctctccccccgtcaacaccacccgaagcgtcgccgtttcatgcaagtccccggcatgctccgcagcgcacaacttagcctctccctccgatctctgcgccgccgctcgttgtcctctcgaatcaatcgaaacctccgattgcgcaaatttcaagtgtccaccgttttactacgcatacggtgatggaagcttaatcgcgcgtctctatcgtgacacgctttctctctcttctttgtttctcagaaatttcacgttcggttgcgcttacactaccctcgccgaaccaaccggagtcgccggattcggtcgcggtttgctctctctcccggcgcagctggccacgctatctcctcaactcggaaaccggttttcgtattgtttggtttctcactcgttcgactcggagcgagtgagaaaaccgagtccactcattctcggacgttacgaggaggaggaggaggaggagaaggttggtggtggagtggcggagtttgtgtacacgcctatgcttgaaaaccctaagcatccttatttttataccgttggcttaatcggaatctccgtcgggaaaaggattgttccggcgccggagatgctgcggcgggtgaacaatcgaggcgacggcggcgtggttgtggattccggcacgacgttcacgatgttgccggcggggttttataactcggtggttgacgagtttgaccgcggagtcgggcgagtcaacgagcgcgcgcgtaagattgaagaaaaaacgggactcgcgccgtgttattatttgaactccgtggcggaggtgccggttctaacgctgcgttttgctggggggaattcgagtgtggtgctgcctaggaagaactatttctacgagtttttggacggtagggatgcagcgaagggaaagaggagggtggggtgtttgatgctgatgaacggtggagatgaggcggagctgagcggtgggcccggggccacactcgggaattaccagcagcaggggtttgaggttgagtatgacctggaagagaagcgcgtggggttcgctagaaggcagtgcgcgtcgctttgggagagactcaatcgcgacaaaaactagcgtatgatatggtgcactgcacacactggatttccctcccctgctttctgtcacgggtcgggtctttctgtaaattgaaataaggcgtgctttggggccatgcgcttgtgtgtctacttaataggaaaagttgtacactattcttttaaaaagcctgaattgtattgtaaaaattgtaagtaaacataaatcgtttaagaatagtatttttaagtgctcgaattgatgtagtacttt

SEQ ID NO: 332 - DNA, 2300 bp, Triticum aestivum
ctccggcgatgtcggcggccgtgggcggcgccgagttccacggcttcggcggggcggcgcagctcccgcggtcccggatgctcggcaggcccgtcagggtggcgccgccaggggcgacgccggctggcggcggcgggccctcggcggccagcattcgcgccgtctccacgcctctgaagaaggatgcaaaagaagttaagcgaagcaaggtggagataatcaaggagaagagcaatttccttcggtacccgctgaacgaggagctggtctcagaggctcccaatgtcaacgagactgctgtccagctgatcaagttccacggaagctaccagcagagcgaccgagaagttcgtgggcagaagaactactcgttcatgctccggacaaagaatccttccggaaaagttccaaaccagacttacttggccatggatacactggccgatgagttcgggatcggaacgctccgtctgacaaccaggcaaacatttcagctgcacggcgttcttaagaagaacttgaagcatgtcatcagcactgtgataaagaatatgggatcaaccttaggtgcctgtggagacctcaacaggaatgtgcttgcgcctgcagcgccgtatgtgagaaaggatatcctttttgctcaagaaactgcagagaatattgcggcacttcttgcgccacagtcgggggcttattatgacctgtgggtggatggagagaagataatgtcagcggaagagcctcctgaggtcaccaaagcccggaatgacaactcacatggaacaaacttccctgattcccctgaaccaatctacgggacccagtatctgcccaggaagttcaagattgcggtcacagttgctggtgataactctgttgatattctgaccaatgacatcggtgttgttgttgtttcagatagtgcaggggagcctgttggctttaacctctatgttggaggtggcatgggaaggacacaccgaatagaaaccacattccctcgtctggctgatccacttggttatgttcctaaggaggatatattatatgctataaaggcaatcgttgtcactcagagggagaatggaagaagagatgaccgcaggtatagcagaatgaagtatctgcttgacagctggggtattgacaagttccgggctgaggttgaaaaatactatggaaagaagtttgaagattttcatccattgccagaatggcaattcaacagctaccttggctggcaggaacagggtgatggtaaattattctatggagtgcatgttgataatggtcgtcttggggggcaagcaaagaaaactctgcgagagataattgagaagtatagcttggatgttagtattactccaaaccaaaaccttatcttatgtggggttgatcaggcatggagagaacccataactgcagctcttgctcaagctggcctgttggaaccaaaggatgttgatctcctgaacataacctccatggcatgccctgccttacctctgtgccctctagcacaaacagaagctgagcgagggatcctaccgatacttaaacgaattagagcagttttcgacaaggttggcatcaaggatgaggagtctgtagtggtgaggataactggctgccccaatggatgcgccagaccatatatggcagaggttggctttgttggtgatggcccaaacagttaccagatttggcttggaggaacaccaaaccagaccaccttggcagaaacgtttatgaacaaagtgaagcttcaagatatcgagaaggttttggaaccactgttttcctactggaatagcacgcgccaggaaggcgaatcttttgggagcttcacaaaccgaatgggatttgagcaactgaaggaggtggtgaacaagtgggaggggtcagcgtcagccgcatgagagctgtctttgctggacaagtcccagcaccatttttgctggggtgagaatctggtggcgaccaagtactctacggattatttttatataaaaactaggagaggaggaggaaacctgtcaattccgttgacaggcggaggacgaaggaagagccgggtctgaagaagttgctcctcttgtgtttgttgtgaggtttttttttttgtgtgtacttgtatggataactccgttggcccctttgtttagcctgagaataaattccttgcaaaaaaagaaatactgcttgataataaatttgtccaaggcaggggtgcttttggtattgttcggcacactggaaagaatttttttttagaacaaaaacctcggccgcgaccacgc

SEQ ID NO: 333 - DNA, 1677 bp, Brassica juncea
accggagaattcaccaactaccaaaacggcgtcaacaacccgacgagccgattcacggcgtactccgacggcggcaacggaaaggctcagtcgttcaaaacctacactcacgaggccaacgccgggaacggccagtcgttcacgagctacggcaagaacgggaacggagtgccgaacgagttcgcatcctacggcgtctccgccaacgtaatcggctccggcttctcgaactacggcgagaaaggaaacgccgccaacgactccttcaccagctacggcagcgacgggaacgtcccgcagaacaacttcaagaactatggcgcctccggtaacgccgcctccgacacgttcgcgaactacagagacaaatccaacgtcggagacgattccttctcctcctacgctaaagactcgaactccggtacggctaaattcactaattacggtcagtcattcaatcccggttcggagacattcaccggttatgggaaaggagccgaaggacacaagatcagcttcaaaacctacacgcccaactctaccttcaaagactacgctaaaaacggcgtcggtttcgcgaagtataacgtttcctccacgtcagcaaccctcggcgatggcaaaaccgtgaataagtggatcgagccgggcaaattcttcagagaagcgtctctcaaagaaggcacagtgattcccatgcctgacattaaggataaaatgcctaaaaggtcgtttttgccccggagcatcatctcgaagctccctttctccacttccaagctcgccgagatcaacaagatcttccacgccggagagaactccacgatggagaagatcatctccgacgcggtgacggaatgcgagaggtcgccgagtgttggagagacgaagcggtgcgttggttccgcggaggatatgattgatttcgctacttcggtgcttggccggagcgtggtgctgcgaacgacggagaatgtggcggggtcgaagcagaaggtggtgatcgggaaagtcaacgggatcaacggcgggaaagtgacgaaagctgtgtcgtgtcaccagagtttgtacccgtatctaatgtattactgccactccgttcctaaggttcgggtctacgaagcggatcttcttgacttgaagagtaagaccaagatcaaccacggaatcgccatctgtcacatggacacgtcatcgtggggtccgaagcatggagctttcttagctctcgggtcgaaaccgggtctgatcgaggtttgtcactggatatttgagaacgacatgaactgggctatcgcggattaaaaccgggtcgggtctggatctatcatgcttttttttcaagtattaaatatgaatattatcttatcgccgagatttgaatagaggaatgttaattttctactattgttatatgctttcctaagctttttcagtaacagtaaagacttgttactgatttgtttgtggcggcacgaataatgtttaagatatttagtgaatgtttgttgacgcaatttatgagtatagctggttagttggattggctgattgaatatttatatctataaaaatgaaggggttatgttatgacatggatttatcatgtgtatattataagaggcagttatatataattatgatgaaagaaaagatataatataagaagatggagac

SEQ ID NO: 334 - DNA, 818 bp, Brassica juncea
gcacgtgggaatgttgcactatcagtgttgatgacagcagccagtactctctcagctgtgatcatgacgccgcttcttacggccaagcttgccaaacaatatgtcgcagttgatgctcttggattagtaaagtcaacactacaggtggttcttctcccagtgttggctggtgcatttatgaatcaatacttccaaaggttggtgaagtttgtttctcctctgatggctccaattgcggttggaacagttgcgattctgtgcgggactgctattggtcagaacgcatctgccatactcgcttcagggaaacaagtggtcatggcttgtgtccttcttcacctctctggatttctctttggctatctgttttcgagactactcagaattgatgtggcttcgtcaagaactgtctctatcgaagttggcatgcagaactcggtgcttggacttgttctcgcggcagagcattttgggaatccgctcactgcagtaccgtgcgctgtttctagcgtctgtcactccatcatcggtagcgtcttggctggagtctggagacgcagtgccccaaaacaacttgaagactgaagataaatggaagttgggattttcacctgagtcgggaccgtttagttaaagtttgttgaaacaaaaaggttttggtcttgtggagctagttagtcctggtttagtcttgtttaatacaaacctgtttatgtcggttttgttatggtacggtgaagtttatcttttgaactcatgatctcttcaaatgttgtagactttaagtgatgaggtttgaaaaggctattatgtaataa

SEQ ID NO: 335 - DNA, 952 bp, Brassica rapa
tagaagaaaaaatgatcgttgtcctgaagagatgaggaatgaacggatcatgtaatacaccctgaaaaaaaatcaaaacatgtggtcatgttatgcccaaaaataaagtttcacgtgcagtaggaaacagagaatattttttaaaaagaaaagaaaagttaaagttagagaggtgttaccagagaagcaaagatgggctgcatatgtcttatcaatttaacaggtaccaatatttatcggcctgtgcttacaagaacatcaaacaaaccctacatcacaagaggaccatcgatggctgctattcgagctgagtcagttgctactgagaaattaggaatctttgtcgagaagaatcctcccgagtctaaactcacccaactcggtgttcgtagttggcccaagtggggttgtcctccaagcaagtttccatggacttatgatgcaaaggagacttgttttctgctagaggggaaagtgaaagtgtaccctgatgggtccgatgaaggcgtagagatagaagcaggcgactttgttgttttccctaaagggatgagttgcacttgggatgtatccgttgctgttgataagcactaccaattcgagtgaatggctatcagtttctgctccgcatatttggtgatatgttcgatataacttcactgtctttgtatgttgacttaattttgtgtgtcatgtatcagtctatgcattactgggatttatttgctttgatatctaagtgatttctcgtaatgtaatgtcccgttgctggcatttcctgcccaatcctcatcatcctaacttaggttagagcgtcgaggatctaggggtttaattgttttggtatgtttcttttggctgcctaggacaggcttgaagtatgagactattagagaatttcggttagaaattcttttgcgttattttagactttttaaggactttgtgcttg

SEQ ID NO: 336 - DNA, 926 bp, Phaseolus vulgaris
gcactgttgcttctccttttgttcactcctaatggctgtgtgccgattcgcttattgttcctctgcatcatcttcttccaccattgttcgtttcccgaaatacccttcacaacacgttaaatcctctttgctgccattctcattcgcaaccatggaagctcctccagaaggttatcgcaggaacgttggtatctgtctcatgaactctcacaaaaagattttcgcggcttcgaggctcgacattcccaatgcttggcaaatgcctcagggtggtattgatgaaggtgaggatccaagaaatgcagctatcagggaattaagagaagagacaggagttaattcggcagaagtgatcacagaggtaccatattggttaacttatgacttcccaccaaaagtgagggagaaattaaatattcagtggggatctgattggaagggtcaggcacagaaatggtttcttttaaagttcactgggcaagatcaagaaatcaatcttttgggtgatggtactgagaaagctgaatttggggaatggtcatgggtatcgcctgaacaaatagttgatctttcagtggatttcaaaaagcctgtctacaagaaagtccttgcagagtttgctccatatttccaataatcttatctctggctgaaattgttatggcttccctatgacaggtgcttttgctgattctgaggctgtttttaggaagaatgcattccaaataactaccaagacatgcgaagagggttatttattgtatgtccgagtgaaatatatattatgatgaaaattgtcatgccaggaattgtatctttccacttattttttcatgaagaaaacgtattttatcgtgtgaaatgagttttgtccttttgtgaacgcagtaataagatttttgttaaaaagaaacttcattattttg

SEQ ID NO: 337 - DNA, 5298 bp, Phaseolus vulgaris
tcttcttcttcgtgtatctctccgataaacccttgacgacgtttggacctgttttgacggcgccgccatggttctcttcaccgagggcgtgacgaattccgttaaggcggtggggttcagtttcttaacgagtgacgagttactaaggagcagtcgcgtgaagataacgaatccgattttgctcaatccgctgcttaaccctgtttctggtggactatacgaccctgctttgggtccgctggatgacaagtctctttgcaagtcatgtggtcaaggttctaaacattgccccggtcattttggtcatattgaacttgtttctcctgtctacaaccctttgatgttcaatattcttagcagtattttacagagaacttgtttctcttgccatcattttcatgctagcaggaaagaggtggaaatgcgtacttctcaatttgagctcataatgaaaggggatattatcagggccaaaagtttggattctattatttcagatgaatccaaccactcaggtgatggtgatgagagccagggtgttgagcaactgggagaaaattggtcctcccttcaatttagtgaggcaatgtctgttctaaggaaatttctgctccgaaaatataagaagtgtcaaaattgtggagtcgtgaatcctagaatcagtaaaccaacctttggatggtttcatatgaatgtcctatctgatgatgaggctagagcaaataccatgagagctctggaaagtgaaacaatcaatgatgatatgtctttaggtggtggggagactacagaagaagaagatataacatctactgggactgcaaaaagagataaaagaaaaaaagggaaattgtcttccaagctagctgcacaaaataaactttctgggtcgttgctaccatcacaggttaaaggtattttagagcttctgtgggaaaacgaggcccgactctgctcttatattagtgatattcaagatcaggggtttggaaagaaagccggtcactcaatgttctttctagagaatatttttgtgcccccaatcaaattccgtcccccaactaaaggaggtgatgatgtgatggaacatcctcaaactgttttgttgactaaggttttacaaggcaacatatccttaggagatgcccatataaataagttagatccttctaaagtactgagccggtggatggatcttcagcaatctgttaatttgttattcgacaataaaacttctggccagggagaagtagctgctggcatttgtcaattgctagagaagaaagaaggcatctttcgccagaaaatgatgggaaagagagttaattttgcgtgccgttctgtcatatcacctgatccttatttggcagtcaatgaaattgggatacccccatattttgctttaaggttatcctatcctgagagagtgactccttggaatgtcacgatgttaagaaatgctatccttaatggccctcaatcccatcctggtgctacacactatactgatcaacaagcaacagtcaagcttccaccaaatgggaagttgctttcttttatatcaagaaaattaccatcgtcaagaggagttattttggatcatgggaagatttctgatcaggaatttgaagggaaaattgtgtatcgccacttgaaggatggtgatgttgtgcttgtcaatcgacagccaacactccataaacctagtataatggctcacgtagttcgtgttctgaagggagagaaaactgtacggatgcactatgcaaactgcagtacatataatgccgattttgatggtgatgaaattaatgtacattttccacaagatgaaatttctcgggctgaagcttacaatattgtaaatgctaacaatcaatatgtgaaacctacaagcggggatccaatcagagctttgattcaggatcatattgtaagtgctgctcttcttaccaaaaaggatactttcataacttatgaagtgttcattcaactactctacagttctggtgtatctatgactgggctaggctcattctctggcaaacacgggcagaaagttttcatgacaaattctgagtttgaaatgtttttgtttcctccagcaatatggaagcctgaacccctatggacaggaaaacaggttatcagtgcattgctatactatatcaccagagattcaccaccatttacagttgagaagaatgcaaaaataccatcaaattttttcaaaactcaggtcagggatggaaaaagacatacacgtgataagtcaaggaacaaggttgagcctgatgatgaggataaattattgatttataaaaatgatttggtgcggggtgtggttgataaggctcaatttggtgactatggtataatacatacagtgcaagaactttatggatccaaggttgctggtaacctactctcagcattaagtcggttgtttactacctttttacagatgcatgggttcacatgtggagtagatgatcttatgataactgaagaaaaggatgttgaaagaatggatcaactcagaagttgtgaggaaattggtgacattgtgcatcgggaattcattggagtaatgaatagtgatattatagatccaataacattgcagttgaatattgagaaaaaaatacgcagtaatggagaagcggccttaacatacttggataggaaaatgacaagcaatcttaactcaagaacaagctcaggaatattaaaggatctactatctgatggaatattgaaaccttcaggaaaaaattgtatttcccttatgactacatctggagctaagggtagtatggtgaatttccagcagatatcttctcatctaggccagcaagagttggaaggaaaacgagtcccacgcatggtttctggaaagaccttgccctgctttgctccctgggattgttcccctagggctggagggttcattattgatcggtttcttacaggccttcatccacaggaatattactttcattgcatggctggtcgtgaagggttagttgatactgcagtcaaaacatctcggagtgggtacctgcaaagatgcctgatgaaaaaccttgagtgtcttaaagtttgttatgatcatactgtccgagatgctgatggttcaattattcagtttcactatggtgaagatggtgttgatgtccatcatactagctttatcaacaaatttgaagcattgtcaactaataaagaattggtttatggcaactgttgccgtcagctagacagatcaagtccatatattaacaaattgcccgatgctctcaaagaaaaagcagagaatttctttcgtgactccttaaaacagagaaatcttggttctctgaaacgagcagaattcttaaagttgatggagcataagtatgtctcttgtcttgctcaaccaggtgaatcagttggtgtattagcttctcaatctgttggcgaaccagctacccaaatgactttgaatactttccaccttgctggtcgaggtgaaatgaatgtgacacttggaattccacgattgcaagaaattgtcatggctgctgcacgtgatatcaaaactccgtttatgacatgccccttgagatcgaataaatctatggaagaagctatttgtcttgctgacaaattgaagaaaatcactgtagctgacataattaagagtatgaaggtttctgttgtaccagtatccgttcttggtggtcaggtttgcagtatatataaacttgtgatgaagctatataaacctaaacagtatccaaaatacagtgatattacccttgaagattgggaggacactttaagaatttcctttgtgagagagttggaggatgccattgaaaatcacatggcactgctttctaaaattagtggcataaaaaaattcaagacagatccacaatcacattcaaacagctcagaagatgctcacggcaatggatcagaatcagagacaaaaggtaaaagtaatgatgatgacgacgatgatgatgttgttgaagacactgaagggtatgaagatctgggatcagatgcacaaaagagaaaacggcaaggtactgatgaggttgattatgaggatggtcctgaagaggaaacacatgatggtgtgctgtcagaggaaattgaaaatgatgaggataatgtggatgataacatgacacttgatgctagtgattctgaaggacttgacgaattatccgagtccaagtctatttttgaaaaagatagtttgaaacgggaaaagaaaaaatctagaccaacaacaagaaaatatgacagggcagtttttgtgaaagctaaagggatgcatttccagatccactttaaatttaccggtgaacctgatattttgttagctgagattgctttgagatcagccaagaaggtttgcattcaaaattctggaagggttggtgaatgtaaagctgttacatgtaaagaaagtggagtaatgtactatggtgaagatagcagaaaaagggatgatattccagcctctgtgaaagaaaaaataccagcactgcagacatcaggggtacattttaaaacattctgggagttgcaagatgatcttgatgttaggtatatttattcaaacaacgtgcatgctatgctaaatgcttatggggtggaagcagccagggagaccatcatcagggaagtgcaaaatgttttcaaatcttatgggatatcggtaaatatccggcacttgacactcattgctgactttatgacgcactctggtggctatcgtcctatgaacagaaacgggagcatagcagactgcacatcccctttcatcaaaatgtgctttgagacagcttccaaatttattgttgaggcagcttatcatgggcaggtggacaacttggagacaccatcttccagaatttgtcttggtttgcctgtgaagatgggaactgggtgccatgacttgatacagaaattggagatatgatgtagccggcatgttcttcagcaccacagctttggcccccgcatgcctggaggtcatgcgaaattttgataccataactgctactaagacaatttccgagtccatttttgtctgtggttcgaaattaaattgtttgaggtagaattagcttagtctgaaatgccattcattctccaatgtacacttaggtgctgtaatgactagtgttcctgtgaccttgattttccggttggtctatatttttttcacatatataatttgatattgattgtttttcttcaacaataatagtcttatctcaccaactgaaataggtt

SEQ ID NO: 338 - DNA, 2018 bp, Phaseolus vulgaris
ctctcagtgcgcgctcacttcttccaccttctccgggtttcactgcgccgatgacttttcttctgattgtaaagggatcgtcatccatcgtgtgccattttgcctgcatgaaccggggcaggctttggcgttcttgggatttcttccgccactggacttgacctgaccccaattagggttatacattcactcactctcttctcatttttcctttcaaactcctccttcctcttctcttcctgtccacctctttctctctcttccattgctttggtttgcttcacaaagcgcttaatatttcgctttttcattttcatttcttattatttttgtttttctctggatggcccgaagaaattccactccagggtttcggttccggcccactgacgttgagttgattgagttttttctgaagaggaaggttcggggtaaggtaattcccagcggagtaattgctgagcttgacttgtacaagtatgctccgtgggatcttccagataaatctgccctccagagtggggatttggagtggtacttcttttgtccgaaggggaagaaatattcgactggagggaggtttaatcggtcgacggaggttgggtactggaagactactgggaaggatagagcggttgaacacaagaatcgagttgtggggatggttaaaactctggtttttcacaccggtaaagcccctaagggagatcggactgattgggttatgcatgaattcagagttgatgacaaggagatggttgacgaaggcagttcgcaggactcctatgtaatttgtaggatattccgaaaggaaggtcctggtcccaggaatggtgcacaatacggtaaaccatatgatgagaaagaatgggatacagatgaggaaattgactctgtgcaatctgaacgtgttgcttctatgtcgacacctgttcctatacaacccagtgaaagtcatatttctattgcaaatgacatcaatccctctacaagtggatgtgctggattgacctctgtatcatgtgcatcaaagttgatgccttcctgctcagcatattgtgtgccttctaacaatcaaattgactctgtgtcatgtgtatcagaattgatgccctcttgctcagcactacctttttctccaaactgtgcatttgattctgtatcaggtctatcaaaagtgacaccctcttgttcaacagttcctttaactccaaactatgatgttgactctgtatcatgtgtatcaaaattgatgccctcttgctcagcattttcttctgctccaaacagtgaagttgactctgtatctgtatcaaaaatgccttcttgcttgccacttgcttcagctccaaacaatctagttgacactttatcatctgtatcagaattgatgccctcttgcacggcaccatctccaaaccatcaagatgatgaaaacattttatctttgctagattatttcaaagaagatgacgacacaatggctgtgaatgaaaacaatggaattaagaaggttgaccctgatcaggcgaacaatgctgaatgcgcaccatgtttggatccaaatgtgatttttgagaacctaggagaccttgacagcttggttggattgggtgaaggcagtttttcctctggccagaaaaacggactttctacaagcgatatgttttatacaggtggtgattatatgcttgggtcttgggaaccccaagactttttggagttgacggacctagcggggccacagccctggcagaataagcatggaagttctggcgaatataagtaaaggttagaaaattgatacaactaaagccacaagtaactaatgtggacccgaaaaagctgcgattctcgtttttcatttaaaaactaccatgaccagatatgcctattttagcattagtttctggaattatttaaacaatctgtacggataggatgttgattaatctagtgatgtttgatcaagtgttatatttgattaaaatctaattatgctgcaatttgttccaaaa

SEQ ID NO: 339 - DNA, 1206 bp, Phaseolus vulgaris
ggcacttcactccgttgcaaccaaaaccagaaataactgcacagcgaaagcttctatattgtattgtattgcatcgcccagcctcatgttggtgttcttcatttgtgtactccttttcttcgtctttttatacaaattcatcgccgcttatggcgatttcactctgatgtctaagaagcaacctaaacgcgaagaaattgaagataaggttgtttggattactggcgctagccgtggaattggggagattttggctaaacagcttgcaagtttaggggccaggcttataatctctgcgaggaatgaagttgagctaaaccgagtaagggcacaactgaaaggtaagcatgcacctgatgaagtcaagattttaccattggatttatcgtctggagaggattctcttaggatagctgttgagaaagcagaatactttttttcggattctggtgttgattacatgatccataatgcagcttttgagcgacctaaaacatcaattttagatgtaactgaggaaggtcttaaggctacatttgatgtcaatgtttttgggacaataactcttacaaagctcttgacacctttcatgttaaagagggggcatggtcattttgtggtgatgagtagtgcagcaggaaagacacctgccccaggtcaggctgtatactctgcttctaaatatgcgctcaatggttacttccataccttgcgttcagagctctgtcagaaaggaatccgagtaactgtggtctgtcctggtccaatagaaacatcaaataatgctggatcaaaggttccatctgagaagcgtgtatcatctgaaaggtgtgcggagctgactatcattgctgcaacccatggcttaaaggaagcttggatatcatatcagcctgtgctcgctgttatgtatcttgttcagtacatgccatctgttggttattggctcatggacaaggttggcaaaaatcgagtagaagctgctgaaaagaagggaaacacatattctttgagcttactgtttggaaaaaagaagggcccttgatgcccatctgtgcatggtttttttcaaagatttgtgtcaaatgtattttagttaaaggttctctgtcaaaatgaataacaccttttcgggcaattgacagaatagagttatatgttattccaaaatgaacaatgaaggtttataaattttcaatgggcgag

SEQ ID NO: 340 - DNA, 812 bp, Phaseolus vulgaris
gaggattgaataatctgaatttgagttgtgttagtttttcttttacatggcatgcaatctgaatcaaaatcagaggcagtagtgaagtgactttaaatttcgcttaccaaacaacaagattcaacaaaatctctgtcttgttaggtcatcgtagatcgcatagatggagacacagaacaacaatccaaaccctaaccctcatcatcggaattcgctaccgtcatcgttgccggtgtggccaacgatcgatgggtcgttggggttgtcggaggaagaatcggtgagctacgcccggaggttttacaagtttggcttcgctcttctccctcttctttgggccgtcaactgcttctacttctggcccgttcttcgccactctcactccttccctcgcattcgcccatatgttgttggatcagcagttgggtttgcagtgtttgcaaccgttctctgttcttgggctctaacatttgccattggaggggaacgcctcctcggacctgtttgggatcaattggttatgtacaatcttgctgataggttaggcctaacaagctggagctagttgtgtggcacctcttatacatgtattttgatcttttattaccacatttatcttcttccatgcctcgtgaatgcacttccatttacatatacatattacaatattctatcgttgaatagataagcaatgttttggaagtagatttagatcttggtttcttcaccccactgtgtgtgttataatttgttgtttatgaaagatttattatctcattttgctgtattattattattatcttatgtacaaa

SEQ ID NO: 341 - DNA, 1259 bp, Phaseolus vulgaris
ataggggaatagagagagagagagagagggtgtgtctaaaaagcttgaagatgaaggccgtagtgataactactccggggggtcctgaagtgctgcagcttcaagaagttgaagatccccaactccaagacaacgaggttctcatcggagtccacgctactgcccttaatagagccgatacccttcagaggaagggcttccaccctccccctaaaggtgccagtccttacctgggtctcgaatgttccggaactgtcctgtccgtcggtaaaaacgtttccaactggaaaatcggcgatcaggtctgtgctcttctcgccggaggaggttatgccgagaaagttgccattacggccgggcaagtgcttccgattccaccaggtgtttcactcacggatgcagctagttttcctgaggtcgcatgcactgtgtggtctactgttttcatgacgagtcgtttatctcaaggggaaaccctgttgattcatggaggttctagtggaattggtacatttgcaattcagatagccaagtatcgaggggctagggtatttgttactgcagggaatgaggagaagctagctttttgcaagagtattggggctgatgtggccatcaattacaaaacagaagactttgttgccagggtaaaggaggaaactggtggacaaggtgttgatgttattcttgattgtgtgggagcatcctactatcaaaagaatatcgatagcttgaatttggatggaaggctttttattattggctttcaaggtggggttactacacaagtagatctccgccctttacttgctaagcgtctcacagtacaaggggctggcttacgtaatagaagtgttgaaagtaaagccctaattattagcgaagtggagaagaacgtttggcctgccattgctgaaggaaaggttaagcctgtggtctacaaatctttccctcttgccgaagctgcggaagctcaccagcttatggaaagcagcgagcattttgggaagatattgcttgtgccatgatcattgtcataccgaagttcatgtgtttgaatcttgtgtttggacttcgttgtgatgatctcatctttctaataagattgtgctttaaagttacagcacgaattgacttgtcttggttcatttcaacaatcctacctgtaaacccattttaatctgcatgttcacgctacaaatgcattttaatctgcatgttattaaatgtgattagttattgtatgctgtactgtctat

SEQ ID NO: 342 - DNA, 3858 bp, Phaseolus vulgaris
gataacattatttcataaacaggtgggccttgctgataaaatcaacagtattgtgagaactctttctggtggcatgaagaggaaattgtcacttggaattgcattgattggaaacagtaaggttataatccttgatgaacctactagtggaatggatccatactcaatgcgcttgacttggcagttaataaaaaaaattaagaagggaaggataattttgctaactacacattctatggatgaagcagatgaactaggtgacaggatagctatcatggccaatggttctctgaaatgctgtggaagttcccttttcttgaagcatcattatggagttggttatactctaacccttgtgaagtcagctcccactgcttctattgctagtgatatagtataccgtcatgttccatctgcaacatgtgtaagcgaggttggaacagagatttctttcaggcttccaatgacatcctcatcagcctttgagaggatgtttagggaaattgaaggttgcatgaaaaaaccagttttgaacatggaattgagtggcaatggtgaaaaggagaatcttggtattgaaagctatggtatatctgtaacaaccctggaggaggtatttttaagagttgcaggatgtgatgatgatgaggttgaatgctttgaagaaaataagcattctctgatatctgactctgtggcttcacttcctactaatgatgatccttccacaaaaataagttatcttaaaacttttggaaattataagaggattctgggtttcatggctaccatgttgggaagagcttgtcgcttaatttttgctacatttcttagttttatcagcttcttgggtatgcagtgctgtagttgctgtctcattactaggtcaacattttggcaacattttaaagccttattcattaaaagggcaatatctgctcggagagatcacaaaacaattattttccagctaataattcctactctcttcctgtttgttggtcttctatttcttaagctcaagccacatcctgatcagcaatcactgaccctttcaacttctcactttaatcctctattgagtggcgggggcgggggaggtccaattccatttaatctatcttttccaattactgaaaaggtagcacaaaatatcatgggaggttggatacagaagttgaagtcgagctcgtacagattccctaattcagagaaggaattggctgatgcagtggaagtggcaggaccaactctgggacccgctctactttctatgagtgaatatttgatgtctagctttaatgaatcctaccaatctaggtatggggcaattgtgatggatgatcaaagtaatgatggaagcttaggatacactgtattacacaactgttcctgtcaacatgctgctcccacctttatcaatttgatgaattctgctattcttaggcttgcaactcaagacacaaatatgacaattcggacacgcaaccaccctttgccaacgacacaaagccagcgcttacaacgtcatgacctggatgccttctctgctgcagttattgtcaacattgctttctcttttatacctgcctcgtttgccgtttcaattgttaaggaacgtgaagtgaaagctaagcagcaacaactaatcagtggggtttctatcctgtcatattgggcttctacatatatttgggactttgtgggcttcttgtttccagcctcttttgccatagttctcttttacatctttggtctggaacagtttgtcggaggcgtttctttgttaccaacaatcctcatgctattggaatatggacttgcaattgcatcatcaacctattgccttacatttttcttttttgaccacaccatggctcagaacgtggttctgctgatccactttttcaccggattgatactaatggttatctcattcattatgggactcatgacatcaacaatgagtaccaattcttttcttaagaattttttcagaatatctcctggattttgttttgctgatggtcttgcttcgttagctcttctgcggcaaggcatgaaagataaaacaagtgatggagtgtttgattggaatgttactggggcttccatctgttatcttgctgttgagagctttagttattttctgttgacacttgcacttgaaattttaccttctatcaacttgacttcattcatggtcaagaagtggtgggaaaaaattaatatcttccggcatgatagtccttatttggaacctctgttggaaccttcttccgaaactgttgttatggactttgatgaagatgtagatgtaaacacagaaagaaatagagtactttcaggttcccttgataattccattatctacctgcgcaatcttcgtaaggtatattttgaggagaagcatcatggaagaaaggttgcagtagattctttaactttctcagtccaggaaggagaatgttttggctttttaggaacaaatggagctggaaagaccacaactctttctatgctatgcggggaagaatctccttctgatgggactgcttttatttttggcaaagatatatgttcccatccaaaggctgctcgtcgatatattggatattgcccacaatttgatgctctattggaatacttaactgttcaagagcatcttgagctttatgctagaataaaaggtgttccagattttgcaatggaaaatgttgttatggaaaagttggccgagtttgacttgttgaaacatgccaataaaccatcattttcacttagtggtgggaataaaagaaaactgtctgttgcaattgcaatgattggtgatccacctatagtcattcttgatgaaccatcaacaggtatggatcccattgccaaaaggttcatgtgggatgtaatatctaggatctcaacaagacgaggaaagactgcagtaattctgactacacacagcatgaatgaagcccaagccttatgtaccagaatagggataatggttggtggacaattacgatgcattggaagtccacagcatctgaaaacaagatttgggaatcatctggaactagaggtcaaacctactgaagtgagttctgtggacttgcaaaccctctgccaagctattcaagaaagacttcttgaagtcccgtctcatcctagaagcttacttaatgaccttgaaatttgcattgggggcactgactctgtcacatcagcaggaaatacctccattgcagagattagcttgacacgagaaatgataagcttaattgggcactggcttggcaatgaagaacgagtaaagacattaatctcttgtacgcctgtctgtgatggagcttctctggaacaattatcagaacaactatttcgaggtggtggcattccgttgccagtattttctgagtggtggctgtctaaacaaaaattctcagaaattgattcatttattctctcttcatttcgtggagcaagatgccaagggtgcaatggtttgagcatcagatatcagttaccatataatgaggatttttccttggcagatgtttttggacttcttgaaagaaataggaatacattagggattgcggagtacagcatcagccagtcaactctagagacaatatttaatcattttgcagctaatccatgaggtgtccccattttagaatccctttcacaaattgctgcttgttggctataacgtgttaaatgtatcaaaatgatgatactccttcacttctcctgcttggattaaacatagaggccttggacgagattctaaggccatggatattgtacagtcaaagattatagtgccattgaattgtaaatatattaattaatctt

SEQ ID NO: 343 - DNA, 960 bp, Phaseolus vulgaris
aaaatggtgggaatcggattacttgtgcacacacagacaaaaccctacctctcaaaaccctaatcttgaagcactgtaagtgtgatatggcaagagccatttccttatccggcgcacggttcaccatgcgccttatctccaccaccacatttaacgccacattacacaaaccctcatcactttcacttcgttcccgtcgttttcttttccctctctccaatgccatcgttcatccctccactcgcgttgccgggatccgctgccgcgtcaaccgcgctggcgactccgcctactcgcctctcaactcgggatcttcgtctttcagcgatcgccctcccaccgagatggcgcctcttttccctggctgcgattacaaccactggctcattgtgatggacaagcccggtggtgagggcgccaacaagcagcagatgatcgattgctatatccaaacccttgccaaagttttaggcagtgaagaggaagctaagaagaaaatttacaatgtttcctgcgagaggtactttggttttggctgtgagattgacgaggaaacctcgaataaattggaagggttacctggagttttgtttgtgctacccgattcgtatgttgatcctgaaaacaaggactatggcgctgaattatttgttaatggagagatagtccagaggtcacctgaaaggcagagaagggtggaaccacagccacaaaggcatcaagacagaccaagatacaatgatagaacaaggtatgttcgccgcagagagaacactcagtgaaggaccaaattgtgatcggcagagggatgtgatgtgtatataaaccatggaagtactgtgacatgcactgtcttagtcttgcttttgtagacattctatattatattttcaggttggacttctattggtgttagtgctcgaactcttatggtgtattaagatgaagtccttttgttac

SEQ ID NO: 344 - DNA, 960 bp, Phaseolus vulgaris
acatttttacaattcgagaaataaaagaaagggagtgccgggtgaagaagcatttcctctcctctaccatggacagcgtttgtgcttcgtctccgccgtttcagaccggaccgtccggccacccgcgccacttttacctcgctgttgacaggctccacttcaaaatgcaaacggtaatcgaactcgtggatctggtggctcgacgtccatccttgcccatcgtcgtctgttgcagcacgcgcgacgacctcgactctctctgctcctctctctccgctctccccttcgtttcctcctctgctctgtacagtgatctcgctgaagatgaacgcgctttcctcttggaaaagtttcgacaggtaacagctcagtggaatcaacgcagagtggccattacggccggggacgagattgggaaagacgagaggtctcatatgatcattgtaaccgacgcctgtctccctctcctttcttctggagaacttcccttgaatgctcatcttcttattaactacgagttaccagcaaagaaggagacatacactaggcgattgacaacttgtttaacagccgatggaattgttattaatatggtggttggtggggaagtggtgactctaaaaagtattgaagagagcagcaatattgtcatgcaagagatgcctatgcgaattcttgacattttatgaagatctttagtcttgctctttcctgaagagaagacatgaagctcgctcatttctctgaatattctgggagtagtcacttgtcagtgctccaaaaaaatactgtcttttattagtattttggatgtgtagatttttatgctagatgacatcttttattggttgtttaaaattagaacacagaaatttggtagaaatgacaaacttcttagtcttctcttttcttggaggtataattgtaatgtatagttcaacattgttaaaggtatttgag

SEQ ID NO: 345 - DNA, 569 bp, Phaseolus vulgaris
ttgttcatttcattaatttttcattacaaataaaggttcttctgttctggttaggttacgctggatgcagcacagtgataatgaaatggaagcctccaaactcagtaacagtattcaaaatattcgatgccatcactgcgcaggacccctttcaaaccgcatggaaactagtcactggaatgtttctcctctcatcagggatagcttttctatgattggttctgccgttggcggcaccacaagtgcattttatggattcaatcttgttatgcccattgtccagagaagaataaaaggacccatgtggttgcattttctcattggtgcaccccctgtgatagtattctcttcagcatgcgcgggactagcaggtggtgctgttcctgctgcggcacaacttgtttcctcctcttatcatgcagcataccctcccccatcaaaggatgaatatattcaaaagtcaataaaatgagataattgctttatttatgtgaccatgcattttaaaacgagtgtggtgatgagagttttgttttttccttgtgtaaatactgctggaggttggtacg

SEQ ID NO: 346 - DNA, 1182 bp, Phaseolus vulgaris
aactactttgacttgaattctttattaaaaaactctgcaagatgctccaagagagctacactgcaaggataaagaggcagtgggagagatcgagggcaaaacacagtgttgtgtttgaaattgtatattatgggaatgaaagctttcatatgtctgatgtggttgttgatgtgggtctctcaatccaaaggccgattactgttcatcccatcaaaacccgacccaaatgatgctgctgcctctgctcgttggctcgtctctctcaatttctggggagtcttgaacactatatcagctgatttgggtggagctccctttgggaatgtggtgtcatacagtgatggactgactggtgccggcactggaatcccttacttctacttgacaagtctagatccaacagcaagaaatgcactggaaaatgataaagcttcacttacagtcagtgaataccctcttgggacttgtggcacgaaagacccgatgaaccctacttgctcaaaaatttccctaactggaaagctgaaattggttgatcaacagtccaaggaagccgaatttgctagaaaagccttgttctccaagcatccagagatgaaagactggccgaagaatcacaactttcaattcttcaaattagaaattgaaaatatatttctaatcgactggtttggtggtccaaaaccactcacagtggaacagtaccttcatcctaaaatgaacaatgttggctttttggttcttaatctacagagtgctctttgaattgctattcctattgtgggctgtaaatgtgccatggaattgtaaatagatataccgtcttttgaattgtgtattccctccaaaatactcttgggccatggttctttatccttgtatatttgaactctgtacatgtttatgatcttgggttcttgcccattgtgttgtggctattatatctgaaaatactgtaatcattaagtggaacaaaaggcatcaaagagcaataattgattactatcagttgctaatgcttatctcttttatctgggaatggtttcagtcaaagcatttgaagctcccattgcggcacagcataaaaagattcttaataaaagtaatagattgttcaaatgcttcggtcattgcttctccctcttccatcctgggcatttgtattgcattgtagctgttggc

SEQ ID NO: 347 - DNA, 2608 bp, Phaseolus vulgaris
caatgaccatgccaagggtttctgccaatccttctccctcgtgcttagtctctatggcttccaccgtcagagcttacgcgctccctattattctctttgctggagccatgttctaccagctcttcattatccccaatgcctttcctccttcccattacgacgttctacaaattgagagctatagttcgattgacaaagtgcaggaggcttacgagaagcttgaatctaaattgaattctgctgaggaagcttttgatattcacaagtttttaaagattcgatatgcttatgagttgctgacagatcctttatggaaaagagactatgacacatttggtattgatgaacaacttcatattgttgagagtggtagcaagcgttatgcagggaaacatatttcagaattggacttccctttactacaggcccgatctggatttgtggatcactcttctaaagtcattacatccagtgacttccagtatatatttccagatgttaagccatggctaattcagttgttttcatcagggagcgaaaattgtgctcaattttccaagtcctggaataaaattgcttctttattggatgttgttgcaaacactggtgtggtggaacttggtgagaaggagcttgccatatatcttgctgataaatcatcaactggaaaaccattttttagaaatggtgttccatctcttattgtcattcctgcaggatgtagatctcctaaatgtatgacgaggtttaatggcgagcttagtgttgataaggttacaaattggttcgcaacaactatagtggatttacctcaaattaactactactcaagggaatctttggtgccaaattttcttggtaaaactagccatcataaggtaaaagtcctctttttctcaacatttggtgagcgtgctgctccatttatacgacaagcagctaaagactattgggcttttgcttcctttgcattcattctctggcgggaagaggaatcttcctattggttgggagcatttggagtgcattcagcaccagctattgtatttcttaaagacccaggtgtcaaacctgtggttcaccatggtctgtttcatcttttgtcatgttacctcattaccatacgaatatacgtttgctctttcattgaactggctatctatgcattgtgtattgcaggttctgtcaacaattcaatttttttgcagttgatggaaaataataaacagcaagagcttcgacaactaaggagtgtgacatcaatggagctaggttgtgatccccatggctattctcgtgctggttatgatacaatgatatggtattgtgctatcgtggttggaaggccaagtttggagctgaacaaaatgcgtgaaactatgtgcagggtccaagaaacattttttaagcacagccaagtggatgcatcatctgataatcaatccttaactccagctgtggatgcatttaaaagaaggcggctgacatttgcttggcttgatggtgaaaagcaaaaggattactgccaattttacattggtcaagcgggtagcgatcacacatgtgggcaacgacggagtgtgactgatattcctaggttatttgtcattcgttacctgaggaatggcagtgctgttgatttgagaacagaacaaaaaacggactggaaatcatcactggtccaagatctaatcagtgattctgatcttgcaggccagtttgtagctgggtacaagggagaagatgatgtttcacagataaccgcttggcttgcaaacattatttctgatggtgactccagagaattaccattctttactttacgaactcctaagcttgtcccagatgacacagaacctatttggtccataacagcacaaaatattcctctgaaaaatctgaaacagagtattcttggtagtcttagcggactctctatataccgtgaggatcctagagttggtccgtttttgcttctgggtgcattaatttctttgggtactatctggctgcgtaggagccaacaacaagttcagccatctgaacaaaatcaacctaattccaatcagccatctgaatcaaatcaaccaactcaacccagttccaaggatgaaagaaaacaaatgccaagagaccgggtcagaagtcggtcaaataaaaaaccaaccccttctatgactgattttgaaccatcggatgcttaccaggttccactatcagattctgattctcagtaatctcagtttggtttctccatgaaggaaaggaaaatgcacacagttacatggtctgaaggtgaaattcttgaattgtgttcttggtttggagcaagataatacaggattgtcaccatatctcaagaagaaattaggagtcacgtgttttgttttggttaaaacgaaaatttgactgttctggtgtatatttgtttaatacttcgattaggatatttattcacgaagtgcttttaccaaaattaagagccttaaatcaagtgaccataaaattgcctgacctgtgaagagtctgtcataattaattcgtggaatttctaattagtgattcttacctgactagctgcatgacacgtgtattttgctacgctggg

SEQ ID NO: 348 - DNA, 800 bp, Phaseolus vulgaris
catgttcttttctctttttggtctaagcaaacaccaccatggcagcatcagtctttaacactccctccttcacactctttgtttttctctctctccaactttatctctctttctcttcctcttcctctccctccatccatgaccttctccgttccaaaggactaccccctggcctcttgccagaagaggtaaagtcctacactttttcccggccgaatggccacttggaagtgttcctagatgcaccttgcatgaccaagtacgagaacagggtcctctttgaacaagtattcactgctaacctcacctatggtagtctcataggagttgagggtctccaacaagaagagctctttgtgtggctccctgtcaaggacataatcgtaaatgacccttcttcagggttgatactctttgacattggcctcgcccacaaacaattctctctctccctctttgaagatccacctcactgcaagcccgaaggtgggttgaggaatcatgtgaggaaggaaaaaggtttggaggtcctgaggtagaaaaagatgccaccctgtgtttcgggcttcacttgttgtctttttctatgtcatgtttatataattttagccttgcaatgcaactatagttaatgagcttgtagcgtagaggttgagcatgtaaaaaggtgaagagagagagatgaagagagaaaaaaaaactaaggaatcttgatgtcttaatcaaatttacaagttgtaattttcttctaacttttgtgcattatattcaccggtaattgctatgttgttccgttttga

SEQ ID NO: 349 - DNA, 576 bp, Phaseolus vulgaris
aacaacacaatggcttcggacgaaacccagaacaaagtgatcgagccctccagcagcgaccttctggccagcgcgaagctggtggcgaacgcggcgcagtctactctgcggaacgaaagtgacaaggtggacaagacgaaggtggccattacggcgggggaccttcttgacgcggcgggaaaatatgggaaactggatgatcagaagggcgtagggcagtacgtggacaaagctgccgattatctgcaccagtaccaggacaaggctgctgcaccttctcagcctgcagactccaaacctgaagaaagtggtggtttgggtggtcttgcaaacttggctggaggcttcttcaaaaagtagtggtagaagaagatgaaggtctttagtttctcagtttcgtgttgttcttgtatgatgtaagattgaataaatatgatacagtttggtgtttgtagaagaagaccttttcttagttccacaaacatgttcctccaagacactcttctctttctatgtatctgttcccttttgtatattaacgttgaatcatttaagattttcttgtccagtagattc

SEQ ID NO: 350 - DNA, 3524 bp, Phaseolus vulgaris
tttctgtgcggtgtaatggtgagtgacagttacagtaagatgatatctgatgtgacaattcgatcgatgatgaagaacggtgaatactgcggtgaagatttgggggttctgagggagagggaactcgctcggttgcgtagtgggtcggcccctccaacggtggaggggtcgttgatggctgtgggagggttgtttgaggggtcaccggctgctgtggggtatggtggcataaggggttttggaagcgaggaagagcttcgggctgatcccaattacgctaattattattactctaatgtgaatctgaacccacgtctgcctcctccgctggcctcgaaggaggactggcggttcgtgcagcggttgaggggtggttctaaggtggggggtgtcggggacaggaggatggccagtgatgacggtggaattgaaggtggccatagcaactctttgttctctgtgcaccctgctgggtttggtgtgaaggaggaaggtggtttgaagcaccgcaaagggggtgctgaatggagtggcgaggatgggttgatcgggttgccggcattaggcctagggagtaggcagcagaggagcattgcggaactgtttcatgatgaaaggaataatgcatcatctgcatccaagcaccctcataatctacctagcagtaacttatttgatgatattgctgaaaaatctgaaacccgtgttgcttatgtgcatcaagaactgaatgccctgcggtctggtggaaataagcagggtatatctgctgcccaaaattttgttggttctggacctcaaagttatgcttctgccttaggagcctccctatcaaggagcagcacccctgactctcagcttctaccaagagctgctagtccttgccttccacccattggtgatggcaggtccagttctgctgataaaaaaatttctaatggtcaaaatttactcaatgctgtctcatctaatttaaatgactctgcagatctggcgtctgctttggctagtatgaatttatcaacgaaagatataatagatgatgagaaacattcccagtcatctaggcacaacgagttagattatactcacagttttaaacagcagccttacttaaacagtcctgattccttggcttatcaacgtcattctgctacccaatcccatttaaaagtgaataagggcagcagttttggattggatctgaataaatcaccaggatatgcagatgaacagctagaaccccataaggctggtggagtttctgttaacacgcatttgaaaggaccttctacaccaacttttactaacagaggtagttcacctgctcactatcagaatgttgaagatatctcatatccaaactatggcatgactggatatagtgttaatccttcatcaccatccatgatggcaagccagcttgggagtgggaatttgcctcctttctttgaaaatgctgctgttgctgcatctgcactaggattgaatgctatggactctagagcactgggaagaggtgtagctttaggacctttattggctgcaactgaattacaaaattctagtaggcttggaagtcatgctgccggtagcactcaacagttgcccttgatggaccctttgtatcttcagtatctgaggtcgggggatgttgcttctgctgcacagattgctgcgcttaaggaatcagtgataaatagggaatgcacagatttacttggcctccaaaaggcttatgttgagtctttgattgccccccaaaattcacatttcaatgttccataccttagtaaatcagctaccttgagccctaattcttttggaaatccatcatatggtctggctacatcatatccaggaagcccactggctggttcccttttccctaactccctctatggaccaggtagtcctatgaaccaaagtgaacgaaatatgcgtttgtctgggatgaggaatgctgctgggggtttcatgggagcttggcattcagacacagttggtggcttagaagagaattttccatcttccttgcttgatgaattcaaaagtaataagaccaaatgttttgaactttcagaaattgccgggcatgttgttgaattcagtgctgatcagtacggaagccgatttatccaacagaaacttgagactgcctcaatggatgagaaaaacatggttttccatgaaatcatgccacaagcactttctctaatgactgatgtcttcggtaattatgtgattcagaagttttttgaacatggaacagcagcacaaataagagaacttgctgatcagcttacgggtcatgtgctgaccctaagtcttcaaatgtacggctgtcgggttatccagaaggctattgaagttgttgacatggatcagcagactaaaatggttacagagttggatggtcatattatgcgttgtgtacgtgatcaaaatggaaatcatgtcatccagaaatgtattgaatgtgtgccagaggatgcaatccattttattgtttcaacgttttatgaccaggttgtgacattgtcaactcatccttatggttgccgtgttatacagagagtcttggagtactgccatgatctcaaaacacaacagattatgatggatgaaattttgctgtctgtgtgtatgttagcacaagaccaatatggaaattatgttgtacagcatgtgctggagcatggcaagccttatgaacggtcagctataatcaaagaattaactgggcaaatagtgcagatgagtcagcagaagtttgcctctaatgttatagaaaagtgcctttcctttggaacacctactgagcgtcaagtccttgtgaatgagatgcttggctccacttatgaaaacgagcccctgcagattatgatgaaggatcagtttgcaaactacgttgtacagaaagtgctggaaacctgtgatgaccagcagcttgagctaatccttaatcgaataaaggttcacctgaatgccttgaagaagtatacctatgggaagcacattgttgcccgtgtagagaaattggtcgctgctggggagaggaggattagtattctgactctaaatcctgcacagatggtatagagaatgtacagctaactgaagataatagaagcacctgctcttttttcttttcatatgtggtattgctaatggccctgtctgtattcaggtagttaagtaataaattagttgtacttgaaattgtacatttgttagtgtgaggataatacagctagaatcaggttagccgaggcttggtactattaatggccttgccctgcctgattctctctcatgcggcagggatatataatattatttatgagctagttttcatgttgtaaagggaggtgatgactgtacaaattttactaggttatcagagtctttgtattcgggatcaccaaatgttttgacatatgaggctttactttttgccctatgttaaccttttcttttatctccccacgttttttttatctcacttctttctcttgttttta

SEQ ID NO: 351 - DNA, 1253 bp, Phaseolus vulgaris
cacccaacttcaatggagagcagtgcggccatggatgttgaggagcaaccttcacccaaccccactaacgtaaaacgcttcggccttaaaaactctattcaaactaacttcggcgacgactatgttttccaaattgtcccaaaggatgattggagtgcaatggcggtttcactgtcaacgaacgcagtgaaactatattcacctatggcgggtcaatatttcggagagtgcaagggtcacaccgcaaccatcaatcagattttattttcgggtacttcacatcaccaagttttgtgttcgtgttcttctgatggcactgtcagagcttgggacacacgcacatttcagcaggtttcttgcatcaatgctggttcttcgcaggaggttttcagcttctctcttggaggaactagtgggaatttagttgctgccgggtgtaaatcgcagatactgttctgggattggagaaatatgaagcaaattgcatgcctggaagactcccatgtggaagatgtcactcaggttcattttgtccccaacgaacaaggaaagcttatttctgcttcagtagatgggttgatctgcacatttgatactactggagatatcaatgatgatgatcatctagattcagtgattaatatggggacttcaattgcaaaggtggggatttttggagagagttaccagaagctttggtgtttaacacatattgaaaccctgggtatctggaactggaaagatggtagaaatgaaggaaacttctcagatgcacgtactttagcttccgaaagttggaatttggatcatgtagactatttcattgattgtcactactacagagaatctgaaaaactatgggtgattggtggcactaatgctggtactatgggctactttcctgtaaattacaaaggagtggcaacaattggagctgcagaagccattcttgaaggtgggcacacaagtgttgttaggagtgttttacccatgtcaaaaattcattctaatagtcctacccaagacatttttggatggactggtggggaagatggtcgactatgttgttggctctctgatcattcctctgaatcaaatcgatcttggatttcaagcacattgattacgaggccagaaaaaactcgcaagaaaaatcgtcatcaaccctactagcagaatccgttaactctaatagttcgataccgaaggagcaattttgtgttatttgccaatagttagttttattttcactg

SEQ ID NO: 352 - DNA, 2267 bp, Phaseolus vulgaris
atggaattgaaggtgctgacacagatgcaagtgaccctgctgctgctgctgattgtgttgacaagaacaggaactgcagcagatgaccaagacctgctcggctgcccgaacaagtgcggagatgtttcgattccatacccctttggcgtaggtaacgtcgaagttcagaacataaccctcgtcggtcaaatggagatgaatttcttcgtctccagtatctgcaaaatcaacatttctaacggaaaaaataaatccaacacacccacactccaaactgcatccttcactatttccagcacggacaacaagttcgtgagtataggctgcgacacgtacgggtatctcaacagttacgtcgaccaagctaaatactcaacagggtgcttgacaagatgtgacaagaatgacccgaatgtgaaaaatatgcagagaaatgatgggaaatgttcgggcatagggtgctgccaggtggatatacctcctggaatgaagaacatcagtatacaagcatcctcctttgatgatttcaaatccttttcgggtaacagctgcagcgtttcgtttgtggtgaaaaatggcgggtacagtttcaagatggatcatttgaaacacatcccattcgataaggctcccatggtggttgattggactgttggagatggtgcctgtaacgtttccaagaataacgacaactatgcgtgcaccagtaatcatagcgtttgcgaggacccaccctatgccaatcgaaatggctaccaatgcaaatgtaaacaaggttttgtgggcaacccttaccttcgcactggttgcacagactttttggaatgtacaacgggcaatcacaattgcgcaagagatgagtattgtcatgatattcctggctcttttgaatgtttatgtcctgttggactaaccggaaaagcaacaaacggaggtggaggatgccaaccaaaaaaggaggatgatgcatttaccaagatcgtcattggatcaggtgtaggattaattgctctatttgtgggggtttcttggctgtacttgatgcaccagaaaaggagactgctcaaattgaaggaaaagttctttcagcagaatgggggcatcattctaagacagaaactctctgcaagaggagaaacgtctcaatccgccacaattttcagtgttgaggaactaaagaaagccaccaacaattttgatgagagtttaatcattggtagaggaggttttggaacagttttcaaaggagttctcttaaataacgaagttgtggccatcaaaaagtccaaaataatggactcgagccaagtggagcaattcatcaacgaggtcattatactgtcacaaattaatcacaggaatgtggttaaactctttggttgttgtttagagacagaagttcctttattggtctatgaatttgttgaaaatggcaccctttttgattatttgcataagcaaggccaggtgcctaatgtaagttggaaaacgcgtttaaggattgctacagaagcagctggagctttgtcatatctacactcggaagcttccatacccatcatccacagagatgtgaaaactgctaacatactcttagatgaaagtaacacagccaaagtgtctgactttggagcttcacgattggttccacttgaccaaactgaaatagccacaattgtgcaaggaacctttggctatttagacccagagtacatgcaatcaggccaattgactgaaaaaagtgatgtttatagctttggggtagtgcttgtagaacttctaagtggggaggaacctttctcttctcacaagacagaagagaaacgaagtctcacatttcattttcttagtagcttggaaaaggattccctgattgatgttcttgagaatgatattctggatgaagaaaataagcaggagattatggaggttgctattcttgctgccaggtgcttgaaacttagaggggaggaaaggcctagcatgaaggaagtgacaatggaattggagggaataaggcatatggacaaacacccttggaccaatacaagccaagattttgaggagagtcaatacttgctttctgagccacaaagcactcctgaacatggttacagtagtggccaacaaagtactggatttgatagcttgagagaacttgaattaattaactttggtaatgggagatgacacaccacaccaacaatatcaattcccacttcactattttagttttctttatttattgttaagttagtctcattata

SEQ ID NO: 353 - DNA, 3351 bp, Phaseolus vulgaris
ctccttcgaattgtctaaaaacgttaccattttattttcttcgcttcacttcacttgccgtctctttcttcttacaatggaggtctcagacgacgacgacggtggccacgttttccttgtttgtactaacaccgattcaatccaagcagccgaaaccctaaacaatgagattctcgtgtccacaaccgatatcctcgcttgggatctcccaacgattctcacttttccgacgattaaagttcaggcacatcccaataggctcattgaacaatctttgtatttccgcggcctcctcagcgggaacttcagtgaatcatgcttgggctctatctctatcaattggaatgtgagcgaatttttgcaaattcttaagcatatgtgtgactgcgttttggatattacgttggataatttcttccctctttatgagggtgcgctttattttggagtggagtcacttctcttgaagtgtgaggtgtggctttctgaggtgctctcacccgaaggatttcaatctactcaaataaaaatggaggacttgatccaaatttggaaatttggttcagatcgcgcaagcgactatgtcctgcacttatgtatgggctacctagcaagaaattttatgtgggcaaagcatagcaatttttttgttaaacttccatttgacctgctgttatcttctgtaaagcaccctcatttgactgttgacagtgaactgcatctttctgatgcacttcttctctggcttgaaagtaacttggaaaatttggagaggccaagcaaaactgaagacaattgcaacggaattttgaaacaaattcgtgtgggccttttgcctttgtggtttgctctaggaaaaagaaactctttttattttagacagctggctgaggaaagccttgattcaattttcagactactgaatattgttcctatgggttcactagatactttcaagtatagtgacttgcatcatctcaggattaggttgacagaatattcaaagaaaatggacctttctggttgcccgcaaataacatctaccatacttcgtctgtcactcatccctcaatcatatttaacagttcccatgcaaaagaagattatagaaaatttatttattaattgtgaacatcctgtaagagataaatgggtgttcccccaaaatctgtcagaagaaaccttgagctttgaagcagttcaggaggtggatatgtctaagtgtcaaaaattgtgtgttgaacatgctgttgattgcttccgcaagtcctttccttctttaagaacattgaaagcaggttatcttttgaatattgggacaatcagtttccttcaattattggagaaatgtcccttggtttctgaaattgacttgactgttgatattaccccactgataccagcatcagttacagttttatcctctagtcctgctgagatacaaccaataccagagaagacttcgagtgttaaatatcaagcagtgcaaatcatgttatttaatgaatttggacctcctctttctaatgttacaaagctcacattggaaggaagaactgatgtcagtgatttgggcctccagtacatctccaaattatgtgtttcattgtgtcacctgaatattaaaggatgcatttctgtcactgatattggcatatcagatctcatatccacgagtaaaaaacttaattcaattgtggtttgtgatacttcatttggggtaaattcagttcaagctctttgctcagctatttctgatagtggcaacatctctctgcattctagagataagcgtttgaattcagcggtgtctaattttgaaacattgcatattggtggctgccagggtgtttctaagtcatctctaatagagcttatgtctcaaacacaagttttgaagagtttatgcctgagaggaactgacctgattgaccaggcactgtataactatgtaggttcttccttggagatgcttgatatttcaaatacaaagatttctagggctgcattagcttatgttattcaaggaaatccaagtttaaagtgtctgaaagcaagagactgtcgaaatttgtttcctggagacaattgtgctgaaaaaagagaatctgattttccctctttgcatgaaaaactacacgctgagttaggaaaaatgtatagattggaagagattgagtttgggtggggcttttcttccttctctttcatttctctggaacctgcactgatgtcattaaaggccatcaatataggtttaggtggaatgctaggtgaagatgctttgaaacggttacctgcaatctgtcccttgctagaaacaataatccttcattttcaggtcatatctgatataattgtgatgaactttgttgcatccttgaaaaacttgcaagtattagctatgtgctattgttttggtgatatatccatgtcaagcttcaaattcccgatgcaaaatcttagaaagctgaggcttgaaagagtaaccccatggatgacgaatgatgatttggttgttctaactcaaaactgcagaaatttggctgagctttcattgctagggtgttctcttcttgacgcagactctctaccgataatttcgtgtggatggccaggcttggtttctatccatttagaggactgtggagaagtaacagctaatggggcttctgctcttcttgactgcaaagctcttgaagatatcctgctgagacataatggccctgggctatgcagaaacttcgtttgttatgctacttcagagatgccattgcttcgaaaattgtcactggatatatgcgatgcaagggaaggtgattttgacattccaaattatgcaggcagatactctttgagtaccttaaacatagctagatgcaaatctaaaaaatgtgcatttaatctcccagcgtctacctcaggggctcgcagtagatccgtgcatatcgaaacgctggtgctcgtgtggaacaacagagatctaatcagaacagtggtgaaggaaagactttagtaaatacatgtctgggcattaatttgtgaggggtatcatcatccttttctcgaagatgattagttagtttttaaacaagtggtttggtggcaggaagtaaaatgcttagtgattaagatggtcacttgtgacgctaaaaagaagatcgtcatttgttagttaattagtaaaacaagaggcaaaacgatggttatgttgtgtgagagataactgtccttgttatgtttctctcatttgttttaattttttgagcaaagcgtcttcaaaattatttacttgcatgtttgttttttattgatctgaagataatttaaaaaaaaacattttcagtgagt

SEQ ID NO: 354 - DNA, 1490 bp, Phaseolus vulgaris
tacaagagatgaacacatatatataaaccatctcacaaagcttcgaatgcagattttatctcagccatgaaagttctgaatgggaaggggaagtatgcacaaggaaacctaaaccttctcaagagtgttgttatccttcttccattcaccctgcttattctcatgttgccgttttctcttacgataaactctagtttttcctctcctaatgaggtgtatgttagtagaagcagctatgattttaacgtgacagagataaaacgatgcaacgtgttttctggggagtgggttccgtacagtaaaggagcttattatgacaatgagacctgtgatttgataatagaccagcaaaactgcatgaagtttgggagacctgacagagagttcctcaaatggaggtggaaacctgatgaatgcgagcttccactcttcgatgcaacccttttcttagagattgtcagaggaaagtccatggcctttgttggagactccgtgggaagaaatcaaatgaattctttgttgtgcctcctaaatcctgttgctcgtcctgaggatatttcaagtagatatgctacagatcccatatatttcagaaggtggttctatgcggattacaactttacagttgtaacactatggtccccatttttggttagaagcagcgatgtccacagcagcctcacgaatctgtatctagataaggcagatgaatcgtggagtggagaggtgaaaaacttcgattttgtcattatctcagctgggcagtggttctttcggacagcattgttctacgaaaaaggacaagttgtagggtgccacaagtgtgagcaacgcaacatcacagagctgagtcactactatggatacagaaaagcattccgaactgcactgagaaccatagtaaagatgaaagggtacaagggggtgacatttttgagaacattctcccctgcacatttcgagaattctgagtggaacaaaggagggagttgtgagaggagaaagccttatgggaaggaggaaatgaagtttgatggttacatttttgagacgtacaaggttcaagtggaggagttcagaggagcgagaagggaaggaaggaagaggggtttgaagtttttgatgttgaacacaactgaaatgatgctgcgtaggcctgatggacatcccaataaccatgtgtggggacatgaaatgaagaacacgcacagtgattgtgttcattggtgcttgcctggccctattgacacatggaatgagcttttgttctatcagttgaaaactcatcacaaatcttttatttcatcgtagggatttgtgtaggatacattagatttacaaaaaggtatattatttctcatagccttcgatcatggagatgtctcgaattcggcttttgcttcctggacaatatcactttgcaacatacactatataacatagataaaatgacagaaaccttcataagtcttttcaaaaaaattctccta

SEQ ID NO: 355 - DNA, 982 bp, Phaseolus vulgaris
gaattgggtggacgagactgaaacgacaaggaacgcatcagctctctcacattctcagaatgctaaccctcaatcacaatgctatttcttcttcgttctcaactgttccatttcatgccaattatgcactctctactccaactcaatttttattttcttccaatcttaattactcctttgctacaacagcaaccagaaagctcaagtcttttcagctcaaggctggattttgggaatcaattaaatctgggttgatgaagaataactcaatgcaagtcattgatccaccctctatagatgaagaagatgaagaacctctgcctcaagagtttgtccttgtggaaaagaccgaacctgatggaacaattgagcaaatagtattctcttcaggtggagatattgatgtttatgatcttcaggccctctgtgacaaggtagggtggccacgcagaccactgtcaaaattagctgcggctttgaaaaatagctatatagtggcctcacttcattctataagaaagtctcctggatcagagggggatgaacagaagagattaattggcatggcccgtgctacgtctgaccatgccttcaatgccacaatttgggatgttctagttgatcctagttaccagggccaaggtcttggtaaagctcttatagagaaactgattagagctcttctgcaaagggacattggcaatataactctgtttgcagatagtcaagttgtggaattttatcgcaatttaggctttgaagctgaccctgagggcataaaaggcatgttttggtacccgaatcactaattgcaacccccacaaagcttgctttttctgatgttaacgtttcaatttgcaaccacaaagtatataaaagagaagcagtggcaaatttacctattacttgtaccattaaggtgcaaagattggacaccaatcctgtgattgattattgcgttaggtgttagcaagtttttttt

SEQ ID NO: 356 - DNA, 3262 bp, Phaseolus vulgaris
catggagagtgtgaatgatctgatccaagaggccaagctccgcactctctggtgggccctctgtatatttgccgtttcctatttcctaactcatacaagtaaatcaatgtggatgaatctacccatgtcgatcatatttgttgcggggctgcgtattctttttaatagggtggagttccgttggaaggttcaagagcctaaaccgctgacctatttatcacatttggagaaaaaacagttgtctctgaaggattcacgcctcactagtttacctccccctgcgaaatggaagagaaaaatcgattcccctgctgtggaggctgcaatgagagagttcattgataagattttgaaggatttcgtggttgatttgtggtactcagatattactcctgataaggagtttccggagcagattcgggcaataatcatggatgttctagctgaaatatctggaagggttaaagagataaatctggttgacttgctgacaagggatgtagtagatttaataggtgatcatttagaacttttcagaagaaatcaagctgctataggtgttgatgttatgaaaacattatcttctgaggagagggatgacagattaaaattccatctattgaattctaaggagctacatccagcactaatatctcctgagagtgagtacaaggttcttcagcagctaatgagtgcagttttagctacagtactaagacaacgggaagctcagtgtcctgtgattcgttctatagctcgagaattattaacttgcttggtaatgcagcctattatgaatttggcaagccctgggtatattaatgaactgattgaagctcttattcttctccttaatgatgatggtacggaaggtatgggcagtaatcagtcaactaatgtagcaggtcaccatcatggacattctgttgtcagtgagggtggacacaacaatctcacaccctctaataagaatccatcattaaatcaaggaactgagatgatattggctaaaacgagtgatcaaggagggacatcattgcaaggtaacaatctccatcaagaatcttcacaggccaggcctgctgattgggcacgaatgttggaggttgcaactcagaggagaactgaaattctcatgcctgagaatcttgagaatatgtggacaaagggaaggaattacaaaaggaaagagaacaaaattatcaaagttggctttcaggatcttcctgctaagagcccctctacagacagtttgcctcctagaaaattggctcaggaaacatcagcaagtaaacgtggaaaatatgaagatgcagaggggaattctcctcttccaaaatttaatgccttgggttcagatcccctacaaaatgttgcaactgcaaaaatttcagaatcttctcaaaatcccgaaaaggaattatcttttgcgaaagatcttgctactgatggttatgaaagtccactgaagaggtccaatagtgcttcttccttaggaatcctaactaacaaaggaggctccataatttcagagttttataaccccgaacttgagaggcacagtgaaggatttcggggaaaaagttcttctgacatggttgtcaggaaagaaaggccgttggtttctaagctccggtgccgggtgttgggagcgtattttgagaaaattggctccacatgttttgctgtttattcaattgcagtgactgatgcacaaaataaaacttggtttgtaaaaagaagattcagaaattttgagcgattgcatcggcatcttaaagatattcccaattacacattgcatttgccacctaaaaggatattttcctcaaacacagatgacgcttttgtacatcaacgttgcgttcaacttgataaatatctccaggatctcctatcaatagctaatgttgctgaacaacatgaagtatgggatttctttagtgttacctcaaagaactactcatttgggaaatctccttcggtgatgaagaccttggcagtcaatgtagatgatgcaatggatgatattgtacgccagtttaaaggggtttcagatgggttgaggcgaaaagtcgttggttcatcatccctcatgagtgagggatctgttacatcttctaccacatggaacttgtccttgaattcagatgaaattgacaaaatcattccaaggcaaggtacttcagaaagtgtgttaagctccgatgaggaaggtgaaaagaacaacaattttgatgatgagaatattgttagcgaagtagcacaagttagtggattgcattttgacaatgcattgatcttaaagggttactcatctccattaaacaaccgtgatgaagagtccaacaacttggattttgatagaaagcatgatatggtggtggaagctagggttggcaatgatgttcctgctacgaatttcattctgattcctgataatttggaggatccagttggagggccacctgagtggtccccacctaatgttagtgtccctattttggatttggttgacaacatatttcagcttaagaaaagaggctggataagaagacaagtctattggatgtcaaaacagatattacaactagtgatggaagatgcaattgatgattggctcctgagacagatacattggctccggagagaggaaacagtagcccaggggattcgatgggtccaagatgttctctggccagatggtacgtttttcttaagagtagggattcctcggatgataagtagcgatgatgatcaaatgccttctcaaacaacaagcagatcaggcggaagcaacatcaagaaatctgagtcaggctcttttgaggaacagcttgaggctgctcgtagagcaagtgacatcaagaaactgttgtttgatggagctccaacaacattagtgagcctaatcggccataagcaatacagacgttgtgcccgggatgtatactactttagtcagtctaatacatgcgtgaagcaacttgcttatgcaattttggaacttgtacttgtatccatcttccctgagatgcggaatgttgtgttgagtgttcaccaacacgtcaagagttcttcttctatatgacataacacgttttatggctttgctggtgttgctggtgggatcatgaatgtccaactgtataaaacataggtttagggcgtgtacatacatacatagatacccattgtgatggggattttgtattgttacagactccagaaatgcatctactcaatattctttattcgttca

SEQ ID NO: 357 - DNA, 1294 bp, Phaseolus vulgaris
ataatgtccgaaacgataagagaaaacgatgccagattaacgtcccaaacgtcgacaagctccaggttctggcctcgttggattcccacttccattgatcatatcatcgctgccgagaagcgtcttctctccgtcgtcaaaaccggttatgttcaagagcatgttaacataggttctggtcctcctggttccaaagtgagatggttccgttcagctagtaacgagccgcggtttattcacaccgtcacgtttgacagtaaacctggttctcctacgcttgtgatgattcatggttatgctgcttcccaggggttcttctttcgcaattttgatgtgcttgcctctcgatttagagtcattgttattgatcaacttggatggggtggatcaagcagacctgattttacatgcaaaagcactgaagaaactgaggcatggttcattgattcttttgaggaatggagaaaagccaaaaacttgaccaattttatactacttggacattcttttggtggttatgttgcttctaaatattcgctcaagcaccctgaacatgtacaacacttgattctggttggatctgctggattttcatcagactcagatgcaaagtctgagcggattacaaggtttcgagcaacatggaagggagcacttttgaatcatctatgggaatctaattttacacctcaaaaacttgtcagaggtttaggtccttggggtcccaacatagttcgcaagtatacaagggctaggtttggcacacattctactggggaaatactgacagaagaggaatcaacattgttgacagattatgtttaccacacattggcggccaaagctagtggggagctgtgcttaaaatatattttttcatttggagcatttgccaggatgccccttcttctcagtgcctccaagtggaaggtgcccaccactttcatatatggtttcgaagactggatgaattatcaaggtgcccaagaagctcgtaagcttatgaaggttccatgcgaaatcatcagggttcctcagggcggacactttgtgttcattgacaacccaactgccttccattcagctgttttttatgcttgtcgaagattttttacacttgatccggacaatgaacctcttcctgaaggtttaaccttggcatagtttaggtcttattgacaatcattcctatatgtgtatgtattgtttcactgaagtagaatttacagagactaatttataattgtaatttcaacggaaaaaaaaataactagttgtattttattctttactg

SEQ ID NO: 358 - DNA, 873 bp, Phaseolus vulgaris
gaaaaacaaggagccagaatccatggaaacacagtatgaggaactcgcgagagaagactctattcccgacagttcctcagaagatgaggaggaggagatagagaaggagttagctgatgtaacgtttgaggagctgcagaaagcacgttcgaatggggcacatgcttttttccagaaacccaaagaagacaaaaagttaaaaagggctaacaagaataggcctatggaggccagtagcaagaagccggtttctgcttttagagaggccatccaagctccaaagaaggttatacgtgatccacgatttgaatctctttgtggtacacttgaccctgaagggtttaggaagaggtataatttcttatatgaaaacgatcttcctgctgaaagacaggctctgaagaaggaattgaaaaagtataaagatccaaagcgcataagtgaaatagaagaacatatatcatggattgataaacaaatgaaatctgattcaaggaagaatattgatacgcaaatattggctaagcataaaaagaaagagagagaagcagcaaaggaggggaaacgtcctttttatataaaaaaatctgaaatacggaagcaaaggctgattgagaaatataataatctcaagtcatctggcaaacttgaagcatttgttgagaaaagaaggagaaggaatgctgccaaggaccacagatacatgccgtatcgtagatctggtgatgtggaataaattttgtacctttaagactctttcttaagctataattataatagaatgtagcaccaaaaagaaaagtaatttatgtttttggctgccagttttggggattaaatattgacgtttgttgattatgtttgttgtgtgac

SEQ ID NO: 359 - DNA, 1988 bp, Phaseolus vulgaris
agtgtgaccctaacagcgtgaatgatgggtcattgctaaagtgtctgcctctgaagtgatcaccaacgacgcggaaactgggcgaaatatagcccacgccaccgtgtttgggtcagtcgtcatggaagtctcaaaagatcctaactcaaacccgggtcacttcgaagattcagattccgaactcgaactctacaccatcccaagctcttcaagatggttcgcgtgggacgaaattcacgaaaccgagagaacagcgttcaaggaatttttcgatgcgagctcgatttcgagaacccccaaaatatacaaagaatacagagacttcatcatcaacaagtacagggaagaaccttccaggaggctcacattcaccgaggtgagaaaatcgctggttggtgacgtcacgtttctgcacaaggcgttcctcttcctagagaattggggtttgatcaactacggcgcgccctctgctgcagacgtggagaaggaagaggaggaggaggaaccgtgcaaggttcgcctcgaagaaggaacccccaatgggattcgcgtggtggccacgccgaactcgttgaagccgatattggtgcctcgcggtgcgaagactggtggaaatgcgaccgcggcttctctcaaattgccaccgctcgcctcctattcggatatttatggggatttgattaggcagaaagaggggaactgtgggctttgcggtggcaaatgtggttcaggacattacctatgtactcaggataatatcattatttgtgcaaattgtttcaaaagtgggaattatggggagaaaaggtcttcagaggatttcgtattgagtgagtcaagtgaaaatagtggcaaacatgacactgtctggactgagggagaaattcttctccttttggaatctgttttgaagcatggagatgactgggagcttgttgctcaaaatgttcaaaccaagactaaacttgattgtatctcaaaactcattgagctgccttttggggagctcatgttgggccctgctcacagaaatgtcaacattaatagtgctaatggcgttgtggtgaacaatgccaaacaagttcagtcatcttcgtctgacaaccaagaaatttcaaagacaaaggatcaacctcctgagcctacaaatgaaaatgagcagaatggggatgctgtgaaggaaagtccttcaaaaagacagcgtgttactcccctgtcagattccagttgttcactaatgaatcaggtgggactgatctctaatgtggttgaccctcatatcacagctgccgcagctgatgctgctgtttcagctctttgtgatgagaatttgtgtccaagggatatatttgatgttgaagaagattcagcaagagatcttgagggtgaaggtttagagatggagaggtcctctctatcagaaatacctttgccactgcgtgtaagagctgccactgcaactgctcttggagctgcagctgctcgagcaaagttgttggctgaccaggaagtcagagagattgaacatttagtagcaactataattgaagctcagatcaataaattgctgtacaaggttaaacattttgacgatctggagctgttgatggaaaaggaacatgctgaaatggaaaatataaaagattctatcttgactgaacggattgatgtgttaaggagaacatttagatctggaatcactagatggaaggattattcttatgtaaaatcttagaccatgtatagttttggtactcgatgggtacgattggactgtcattttacctaagggccaacgaattactgtaagatttagtattcaatatcatttttcatcagtgccaatgtagtaatgtaaaattgattatttattacaccgtaatccagttatcagctaacagctttgaaaagttatatcttttatactatctaaacctttttgggtagcgcttacgtgccattgatatttctaattttggcttttgaat

SEQ ID NO: 360 - DNA, 1031 bp, Phaseolus vulgaris
accatgataggaactccaataagcaaaagccaattgatacttgcatatcacaaaacacacacacacactctctctcaaaaaaaaatctcctatcacctaactcacctatcctcaactcaaagccctttagtctcagcaagcagcaagtgagagtgttacacaacatggaatatacttattcagcagaggcagaaacttacaccagtagcagtaccaccccatcaagtgccatgagatcaaagaagaaagccaacaacaacacaagaaggttcagtgatgatcaaatcaaatcattggaaaccatgtttgagacagagtcaaggctagagcctagaaagaagttgcagctggcaagagatcttggattgcagccaagacaggttgctatatggtttcagaacaagagagctaggtggaagtcaaagcaactggagagagactatggtatactacaatccaattacaacagtttggcctcacgttttgatgctcttaagaaggaaaagcaaacattactaattcagttgcagaagctgaatcatctaatgcagaagccactggaagcaggtcagagtcgcacacaagatgaagcagcaaacagcatggacagtgaatcagaaaatggaggcaccatgaaatgtgaacatgaggaaaagccaagcccaacaatggaaagatcagaacatgtgcacggtgttctgtctgatgatgacgctagcataaaggtggaagactttggcctagaagatgaacatgatctcttgaactttgttgagcatgctgatgactccttgacttcaccggaagattggagtgcttttgaatccaatggtctcttaggccaaacgaccagtgattaccaatggtgggacttctggtcctgaatgaaacagaacaaccaaaattttgtggaggaatgtatacatattaatgcttcatgtttggttccatatttagcatgcaatttttcacattaaccaagatgcagctagttatagcttctacattttttttagcaaaattgacaaatt

SEQ ID NO: 361 - DNA, 1515 bp, Phaseolus vulgaris
aacatattacccaataagcttggacaagttagggataagtataagccgtaaaagaaatgggtctaattccttcagaaaccacaccttcccacgttcttcttttcccgttcatgtctaaaggccacaccataccccttctccacttcgcgcatctcctccaccgtcgttccatatccgtcaccgtcgtcacaacccccgccaaccaccctttcatcacggattccctaaagggaaccgccgcctccgtggtcacgctttccttccccaccatcacaaacatccccgttggagttgagagcacggacaagcttccctccatgtccctcttctacgagttcgtcactgccacgtcagcaatgcaaccgcagttcgaacaactcctccagacccttccacgcgtaaacttcatggtcaccgacggcttcctctggtggaccctagactcggccactgcgtttggaatccccaggtttgtctactacggcatgaattgctatattaaagccgttttaattgaagcaatgagaaacgggattcttaagggctcccaacccgacaacgagttagtcgagttgactcggttcccgtggatccgagtctgcaaagaagattttgaccccaccttcagaaaccctcaccccagtggtgttgaatacacgttcaccatgaattcgatatcatcctcacaacgcagtcatggcatgttggttaatagcttctacgagcttgagtctacctttgttgattacgtgaacgcggattcctctcctaaaagttggtgcattggccctctctgtttggttaaatggacaccgaaggtttactctgatgaaggtctgaaacccaggtgggtgacgtggttggaccacaagcttgaagagaagtgtcgtgttctgtacgtggcgtttgggtcgcaagctgagatttcatctgagcaactggaagagatagcattagggttggaagaatcggaggtgagtttcctgtgggtgatgagaaaggaggagtggggtgttcctgatgggtttgaagaaagagtgaagggaagagggatggtggtgagagagtgggtggatcagatagagattctgatgcatgggagtgtggaagggtttgtgagccactgtgggtggaactcggttctggagagcgtgtgcgctggggttcctattctggcatggccaatgatggcagagcagtatttgaatgcgagaatggtggaagaggaggtgaaggtggggttgagggtggaaacatgtgatggttcagtgagagggtatgtgaaaagggaagggctgaagaaagcggtgatggagatgatggaaggggagaaggggagaaaagcaagagaaaaagtgagggaattggcggagatggccaaattggctacgcaagagggtggttcatcgtcgtcgacgttagagtcacttcttaatcaggcatgagcttgtcataaagactggcttaaaaatattattatattattataaattgttgttaaaggtatgtttttat

SEQ ID NO: 362 - DNA, 1783 bp, Phaseolus vulgaris
atggtagtagtcacccctccaacagcgtctaacaaatggacacagttatcttctcttgcatctcagatagatgatcgcaaggcctctatgggaagagtcatggaaaaaccaacccaagatcttcttcagcagcagcaacaagccctcaagtgccctcgctgcgactcttcaaacaccaagttctgctactacaacaactacagtttgtcacagcctaggcacttctgcaaagcctgcaagcgatactggaccagaggtggaactctcagaaacgttcccgttggtggtggttgcagaaaaaacaagcgtgtcaaacgtccaaacggtgacgcttctgctaactcccccccttcttcctccactcctagctccaattcaaaccctccttcacggccccacatcccttctagttcaaccgcaaaccatgtcaatgtaaaccctttgttttatgggctacccaatagtaacggttgtgatgtcatggatgttcctttcccaaggtttaatcttcagtctcagctgaatgcccttgggttaggtttttcgtccggggttaacgttatctcaagtgaacctagtgataatgggtttagtactactactactacttcaaatactaacaactttctttcggcttataattccatatttggttcttcttcctcctcaacttgtgcaccctcaactcctgttatggcttccttgctgagttctactctcctgcagcagaagtttatcggtggtgctggggtgaagggtcatcatgatggcaatggtttccagggttttgcaccgcttcaagggttgcaaatggaagggagtaataatattagctcaaaagaagtgaaagctgaaggaccaaacaggttggagttggagtggagtaataataacaataacaatggtggtggtggtgcttgtcaaaaccagatggagcatgtgggcttgtctgatcctaattcactttattggaacactgcaacaggtttgagtgcttggagtgatcaacctaactttggtccttcagtcacgtctctgatctagaaagatgaagcatcgttttcaaagctatatatgaaatctctctccctcgtttaattaagggcatgtttttgttctttaggcttagttttgctacttttcttttggggtcaaagttggttggatttactacttacaccgaaaagaaaaaaaataaaaaaagaagatacttgagatgagaggagtttgggatcggagtgatcatgtcagctgcaagaatgctactacacttcagcctgttagttttatgtgtcaaggttgagaattggttaattgcgctgagaggaacctcggatcctcttctctcatcatagtctctgcacactgttttgtttcctgtggagatcaaaagaagatcctctggtgcaagttctccacagttgagtaagttggtccttttcatgaatgtatatacgatgcaatgacatgtcttcttttttccttttctactttctgatgtattgtgattagttagacgaggtggggtttaattactttgtataatatgatgctgagatattggtttcattttcgttaactttctcaacatttgtttaggaatatggcaagtggagagaagtagggtaattattattcggggtataatgatggtataggagagaggaagattaagtacttggatggggtgattaatgtatgtggggttggtttgggtcatgtactgtttggttttgtggttcatctctattggtaattcaagatagtttggtcctcaaaaaaa

SEQ ID NO: 363 - DNA, 1325 bp, Phaseolus vulgaris
gtggcagttattccgggattcatgtcttgcacgtgcgatcacgtcggcggctgtaccgctcccggctccagatcctccggcgagatcgctcccgttcatttcttcggcgtttacgacggccatggtggctcacaggtggctaagttctgtgctaagcggatgcacgatgttatagcagaggagtggaaccgagaaatggcagatggagctgagtggcagagaagatgggaaaccgtatttgctaacagttttgagaggactgacaatgaaatcctatcagacgcagttgcacctgaaatggtaggatctactgcctctgtggttgttctatctggttgccaaattattgcatccaactgcggcgactcaagggtagttctctgccgcaggacacaaactatccccttgtcagtggatcaaaagccggatagacaagatgaattcttgagaattgaaggagaaggaggaaaagtcataaactggaatggagctagggtgtttggtgttcttgccatgtccagggccataggtgatcggtacttgagaccatggattattccggtgcccgagataactttcacagcaagaacagacgaggatgagtgcttagttttggcaagtgatggactctgggatgtaatgagcaatgaagaggttggagaagtggcacgccacattcttagaagacgccgcagatccttgtcaggggaggaaacatctcctgcacaagttgttgccgacagcctgactgaaattgcatatggtagaaatagtaaagataacatttcaatcatagttgttgatctgaaatccaagagaaaacgtcagcaaaggcctcctttaatttcctaagaatctaattctctttaatctttttcaatcttgaattgaaaaggagaaagagacggtaatgaagttgtagagttgatctataaacaaacctttttttttctatttttcatacgaccccattggtacttggtatcacttcaccttgtatctcctaaccttctgtacagagttgattgggaaaaaagaaactgcttcgtgacgagagacaactacctagggctggcttgttgtaatgaagtatatcgttcagtaagtactactttttcttctccatttggtcttcattcctgaacggttatgttgataacacaatcaaatgccatcaattgtattgtttgaatttcttttattggaaggaatggaataaagatgatgaactttattccatttcattgcattcaatatttgaaaatatttcctttattttatttgaaaatataggatgaaattagacctacgaagtaataactctt

SEQ ID NO: 364 - DNA, 1331 bp, Phaseolus vulgaris
gagaagaagatgaagaagcagcagacgcagaaaagcgagttcgagttctgcaaagcgtgcggcataaaccacgaccaaggtctccgccacaagtacttccctaaccacaagaaatccctctccaccttcctatctcgcttccgtaaaaaactctccgatgttcgctttttcctcaacgcccctatccctctcaatccccaactggcttctcgcaatcgcttctggtgtgtcttctgcgaccaagacatccacgaacactccagttcctttgcctgcgccaatgcgattcgccacctcgccagtgccctacacctgaagaatttgaagcacttcttctggaaatacggtgctgcggcggatcaattggacgcgtttatgttttccgatgatgatgtgaccaagggggagaagaagtgcgtggcgcgaaaggatgaagcgaatgagggaagtcgcagaacggtggttggtccttcaagtgatgatcatatccataatcaactcaccagtggaaatagtaatagttttgaaacaaatgtttattcccattctgtgaagtcgtatccttcaaatcctgttttacctttaccaaactatacaaatgagtatcagatatctagttcaggactctctggaatcgccaatgttgctacctcgtcggaagcgcgccctgatgcaaaacctattgtttttcaagattttttggttgaaaggagaagccattctttccctcatgatggtagacaatcatcaagtaatggttactcctgtgataaacagatttcttctatgcctattgaaagtgctgagaaaaaagtttattctgaagcacctccaccatggattgacacaactgaggcagttcagatgcattctagttcaaacaagttagggaagtccaaaatgttgaatccaaatcgggtgggagcagcttgggttgaaaagagaaagattgaaatggagaaggagaaaaggggagagacgataaggaatggtcgtgatgccagctggcttcctaattttggtagagtctggcaatctggtagcagaagagaatccagaaaagaatttgagagggagaaacagttgcagaagttaaatgttgaaacagagtctgagatggcaatcaaaattcagccttatgtaagcaaaagaatgcggatggatagtgtaggtgataatgcaagcggatgaaatttcttgtcgcagtgatgtttttggggagtgtaatcaatataataaatatgcatactaacatctattgcattggaggggagaagactggaaaaagttcacataacgaaatgtcacgtttatgtcaatcctggaaaaaa

SEQ ID NO: 365 - DNA, 630 bp, Phaseolus vulgaris
atggactccttcagtttcaataacctccaagcagagaaagccaacgccatcctcaaacaccgcaagcttcgaagggtggcgagcttgttacgtatcatcgaagtgtgtgcggttttggtcttggtttcaaggttctccatgcagctcccagttgcagtgagaaactctggcgagtacttcagagacttgtcactcttcatgaacagtcctcgctttgttttcctcattggaaacatcataatcatcgcactcttcgcccagttctccgctcagggcaacaacgttgttcaggagcctaatctctaccaagagttaattcaaaacacaacgaaaaaccaagaaacagttgtggcagagtatagcagaaagaaacagaggatgaaaacaggggaagcgaaaattagtttggaaaagggttatagaaggtgtgagagggagaaacgacgtggtgtgatgcgtaggtgtgagagtgagagtgaaaagggaaggaagaagattgagggtgttgctgtagaagaagtggcgcggcctgaagatgggatgagcaacgaggagtttcgccgcactgtggaggctttcattgctagggaacagaggattcgaagagaagaagattattatttactgtaa

SEQ ID NO: 366 - DNA, 1378 bp, Phaseolus vulgaris
tattacttaggcacaatattttaatatgtaacgtcataaaggtctaaattccactataaatagaacatggctgagagggttgagatatagagtaagcagtgtgtagtgaaaactgaaggtgtagattctgtttccatgcctcctgttcctatttctcctgtcaaagttgggcacattgatgatgtccaagagctaagaaaaactaagccaaggacaattcctcaaagatttgtacgagacatgacagaaagaccaacactttctactacacctctccccccatcaaatactcacatgcctgtcattgatttctctaagtttaccaatggaaacaaagaggaagttcttagtgaaattttcaatcttgcaactgcttgtgaagagtggggattttttcaggtaattaatcatgagattgatctcaatctggtagagagaatagagaacctgagcagggagtttttcatgctacctttggaagagaaacagaaataccctatggctcctggtactgttcaagggtatggacaagcttttgttttctcagaggaccagaagttggactggtgcaacatgtttgctcttggacttgaacctgaatatgttaggaacccaaatctatggccaaaaagaccagaaagattcaggaaactgtgctataatctgttaaagtatatagctctaggcctggatttgaaaggggatgtgtttgagaagatgtttgccctcactgtgctgcagcaagcaaagggaggcccagtgggacttcagatactcaaagacaatacatgggttcctattcagccaattccaaatgctcttgtcattaacattggagacacaatagaagttcttacaaatggaaaatacaggagtgtggagcatagagcagtggctcatgaggagaaagatagactctcaattgtgacattttttgctcctagctatgatgtggagcttggtccaatgccagaatttgtggatgaaaaccacccatgcaagtatagaacatacaatcatggagagtacagtaaacactatgtaaccaacaagttacaagggaaaaagacactggactttgccaagatccaaaccaaaaacacaaactaggatggtccccaactagctaggagtactataattagactgactatgtgtgtgtatataattgtgttccacataaaagtgcatcatggtcaaatctctcaattctatttctgttgaaaaataggcaaaggaattagttggggtgatgtaggagagtgtgaatgtgggtcacatacacaagactcagtgtttcttattctaaatatgcatatgctatgctttcaatggaaaattatagtgacatcttattttataaagctttattgcccaa

SEQ ID NO: 367 - DNA, 2146 bp, Phaseolus vulgaris
agtgctgtttttgacacactgacatatttttgcagattccaccgagtagatatacctataacaacttgataaatgcttgtggatctagtgggaattggaaagaagcactcaacgtttgcaagaaaatgacagaacacggtgtcgggcctgatcttgttactcacaatattattctatctgcatttaaaagtggcgctcagtatttgaaagctctgtcatattttgaactaatgaagggaactcatattcgtcctgacacaacgacacttaatattattatccattgtctagtaaagcttcaacaatatgacaaagctattgatatttttaattccatgagggagaagaaatcagaatgtacccctgatgttgttacattcacaagtatcattcacttgtattctgtgtgtggacaagttgataattgtgaggctgcattcaatatgatgcttgcagaagggctgaaacctaatatagtctcatataatgcactaattggtgcatatgctgcttgtgggatggacaatgaggcacttttggttttcaatgagataaaaggaaatggttttcggcctgatgttgtatcttatacgtctctccttaatgcttatggaaggtcacaaaaaccccaaaaagcaagggaaatatttgatatgatgaagacaaacaagttgaagccaaaccttgtcagttacaattcactgatcgatgcctatggatctagtggttttctgacagatgcaattgaagtcttgcgagaaatggaacaagatggaattcaaccaaatgttgtttcaatatgcacactcttggctgcctgcggacgatgcagtcggaaggtgaagattgacacagtgctaacagcagctaagatgcgaggaattaagttaaacacagttgcttataattctgctatagggagctatatgaatgtaggggaatatgacaaagctataaacttgtataaatctatgaggaagaaaaaaattaaaactaattctgttacttacactgtgttgataagtggttgttgtaagatgtcaaaatatggtgaagccctatcttttatgaaagaaatgatgcatctaaaacttcctttgaccaaagagctctactcttctgtcatatgtgcctatagcaaacagggtcaaattgaagaagcagaatctacatttaacttgatgaaatcatctggttgttaccctgatgtggttacatacacctccatgcttgatgcctacagtgcagctggtaaaataattttttaatgaattaaatattaggatgttattaatgtatgtatactgaataacaatattttctatcaggcaattgggagaaagcctatgcactctttgaagaaatggaagcaagtgacatcaagctagataccattgcctgtgcagctctaatgagatcttttaataaaggtggtcaaccgggaagggttcttaatcttgcagaaagcatgagagaaaaagaaattcctttcactgatactatattttttgaaatggtatcagcctgtagcatattacaagattggaggacagctgttgatttgatcaagtacatagagtcctcacttcctgtaatttcatccgggtgtttgaatcagttcctgcattctttaggaaaaagtggaaagattgaaactatgttgaagttattcttcaaaatcttggcatcgggtattgatgttaacttaaacacttactctattttattgaagaaccttttatcatctggaaattggaggaagtatttagaggtattgcaatggatggaggatgcaggaattcatccatcaaatgaaatgtaccacgatatatctgcgttttctcaaaaatgctgtgggcacgaaaatgctgctgttataaaagaaagacttgaatccttgaaaagaaaatctgaggatcaaatttctgccaaccgaccaggtgaaactcctgttcttagttgaccactgtcatggaatcacaattttttggcttagctgtgacacaccggtccaacttttgctgaacttctgcctgagattttgtgaagattgaagttggaactcaatgtgatggatcacacgctactcttgtataaagattaggaaaaatgctattaacacatttcattattgaatgaaattttg

SEQ ID NO: 368 - DNA, 1671 bp, Brassica napus
aacaaaacacacttgggtaatagaaatctgtctttctttgggtgaaatggcactagcgatcaacgtttcttcagcttcttcttctgtgatctcaacctctagcttcccttcctcagagctcaaagtttcggctccacggatcggttcattgaggttatccgatcgtgtcaatgtctcaacggcgtctctgagtctatccgggaaacaatcatcatcggtgaagcctctgaatgtgcagtcagttgcaaaggagtcgtttgttccttctcaagcagcgtccatggtgacttctgaggttacagagaaactagatgtggtggaagtggaagacttcgaggagctagcaaagagtctagagaccgcttctcctcttgagatcatggacaaggctcttgagaagttcggaaacgacatcgcaatcgcctttagtggagcagaagacgttgctctcattgagtacgctcacttaaccggaagacccttcagggtgttcagtttggacacagggagattgaaccccgaaacatacagactcttcgacaccgtggagaagcactacggtattcggatcgagtacatgtttccagacgctgttgaggtccaagctcttgtaaggaacaagggtttgttctctttctacgaagacggtcaccaggagtgttgccgcatcagaaaggttagaccattgaggcgtgcgttgaagggcttacgcgcttggatcactggacaaaggaaagatcaatccccagggacgagatcagagatccccgttgttcaagttgatccggtgtttgaagggttagacggaggagctggtagtttggtgaagtggaatccagttgccaacgtcgaagggaacgatgtttggaacttcttgaggactatggatgttcccgtcaacacgcttcacgctgcggggtatgtttcaatcgggtgtgagccgtgcacgagagcggttttgcctggtcagcacgagagagaagggagatggtggtgggaagacgccaaggctaaagagtgtggactccacaaagggaacatcaaggagaacagcaacgcaaacgcagcggctaatgtcaatgggacgtcatccacggttgctgatatcttcaaaagcgagaatgttgtgagcttgagcaggcaagggattgagaatctgatgaagctggggaatcgtaaagaggcttggatcgttgtgctttacgcgccttggtgcccgttttgtcaagcgatggaaggttcgtttgatgagttggcggataagttgggtgggagtggcgtgaaggtggctaagtttagagctgatggtgaccagaaggagtttgctaaaagggagttgcagcttgggagcttcccgacgatacttgtgttcccaaagaactcttcaagaccaatcaagtatccatcggagaagagagatgttgattctctgacatcgttcttgaatcttgttcggtaaaaagagcaaaaaatcagtcgactttgcaaaacaaaaccattcagtctagttctagagtgctagaacagatgaagtaagagcttgagattctctatttgaaagctttcacttttgtatagttgtggtctatccttttgtaaaacatttgcctttgtgatgatgatgatatgagcaagttttcaaacatcgattactcttatatggaattgatt

SEQ ID NO: 369 - DNA, 847 bp, Gossypium hirsutum
agctgaaaatggagaattgttacccttttagcttgcttgaacctccaaattgtgatggttgcaatgctgctgctataagcaatgagcctcctttcgtagttccatggccagtcgaacctcttttctcagcttctagctcggttcgttgccacgggtttacttcgccagcgatacctgataaagctacggtggcttccaagagccatagtgaagccgagaagcgtcggagggatcggattaactcgcagcttacagctttgaggaaattgattcccaagtctaacaagatggacaaggcagccttattaggaagtgcaatagagcaagtcaaggatctaaaacgaaaagcaacagaaatcggcaaagcttttgctataccgtccgaaaccgatgaagtatctgtcgattacaatgttcccgaagacaagacattcatcagggtttcgatttgttgcgatgatcggccggaagtgttttcggaactcatccgagtcctcaaagggctaaggcttagcattgtggaagctgaaatttcaagtgttggtggaagaaccaaaagcaatttgatcctttgcaatgagagtgataatagagaaggtgtttcaagcaatctaaaacaatctttgaatgtagttgtgaacaagattaatgctttatcatcggatgaatcgaaatcgaattatcggataaggagtaagagacaaaggttgttcttgtcttcttagtttactccgtaataaacaaggtgaatattaaatacattgtcagtgtaggtgtttttgtccgtgagcaaaaacagatcgctttgtatttagtaaaataaaaaataatggagggcttacaaata

SEQ ID NO: 370 - DNA, 1550 bp, Gossypium hirsutum
ttctcctcgtacatctagagctccaactcatcctgcatcttctgaaccatccacaaatagtacatatttaaggggtgctcctgttccacgacctccctctgctcctgcttctaaaccttctggaaatgatacagtacctaatacttctgctccatcaccatcgggaagcaatccttctattcctgactctaagtcaagtcatcaagcagcaatactagtcggaagcatagggggtggtacatttcttctaatattaataatcattgcctatctcttgaaaacttacaaggtatctactgtgaaaccttgggccacagggctaagtggacaacttcagaaagcatttgtaactggtgtaccaaagctgaagcgatcagagcttgaagcagcctgcgaagatttcagcaatgtaattggttctacaacgattgggacggtgttcaaagggacactgtctaatggagttgaaatagctgtggtctctgttccagttgaatctaccaaagattggtcaaagaatttagaaacacaattcaggaagaagattgacacattatcaaaggtcaaccacaaaaattttgttaaccttcttggatattgtgaggaagataatcctttcactaggatgttggtttttgaatatgctccaaatggcactctctttgagcatttacactttaaagaatctgagcatttggactgggctatgaggttgagaattataatgggcatggcttactgcctcgagcacatgcaccagctaaacccacccgtaccccataacaacctgtcatcctcagctgtcagtctaacagaagattatgcagccaaaatctcagatccgtgtttctggaatgagttgactgcatcagacagggaaggagacagaataaacctttcggataccacaatggcaagcctagaaagtaacgtatatacctttggcgtattattatttgaaatagtaacgggtaggatgccttacttggtggataatggttcatctgaggacatggcatcagactatttgagaagggagcaagccctcgtagagatggtcgatcctactctaaactctttcgacaaggaccaatttgacctgattggggaggtcataaaatcttgcatcgaccctgagcctggacacagaccggatatgagaggagtcagtgcaagattgagagagattactgcaatcactcctgataatgcgatccccaaactttctcctctttggtgggcagagcttgagatcatgtctagtgaagcaagctagaggatgaacttgacgctgtaagtaagaaacttggatgtttttttcttgttcttcatgtcagtggagaggcaaaaataagtttgcctgtaggttggtaccgtttgtatttatttcaagatattggaaagtttgttgtatatattcgagagagaaaatgtggtcctttgttttgggccatcagtgtgaaaatacataacagaaaggcataatggcaatcctcttgatttctaattgttcattgttaccaccattttttgcagcgatgaatcaattt

SEQ ID NO: 371 - DNA, 862 bp, Gossypium hirsutum
aaaccacgctaatgtagaagctcctgccacgtctccgtgtcagaaaccatggccatctctcatgttccgtattacttgtcaaaattgccttctccattgttcacttgccgtttggcggccaagaaaatctcagaattttccatggagaatccgcaacatcctgaaggcaaagaagcatgtgaatccaatccaaccaacgtgaagcgtgtatccgatgatataatgcctcaccttcttaacttatatggatctcgtgtcacaccacgcgactttgaaatatacgccgcggacgcttcttttgaagaccctctcatgtgtgctcatggagtgaaacaaatcaaatcatcattttattcactttctaaggtttttagtgaatcaagaatcgttgaatatagcatcaacgaaaaagaaatttcagctggaaagcatgagatattagttgacaacaaacaacaatacaagttcttgggaagaaacatagatatgatatcattgatcaggttgtttgtcaaggacggaaaggttgttcgtcacgaagattggtgggataagaagcctcttcggaatagagaaacagttaagcttccatgtgtcggccgaatgattgaactgactcgcaggggttcgatgttcgtaactcatgctttaatggggttcggaaaggatcctcctaccggatgatgctacaagtcgactgtatgcaagtctgtctcggtgtcatattcttagttatattcatatcaaatctcatattgttaaacttttttttattctgatcatgtgtaaatcttgaaattttaattagccgttaaaaaaataagaatcaaattgataaaaaatataaacattatgaactaaa

SEQ ID NO: 372 - DNA, 1179 bp, Gossypium hirsutum
actggcaggtgtaagcgatggaaggagtcatttagcgagtcaaagacgtggcaaatgggattctgaaggtaaaaaaatccttaggcaactcagtgaagaaattattgagatttgagatcaaacatcacatagatttcagagattttcaatggcagccgaagaaggcaaaacagcagatgcacagtttttccacctcctttccaatctactccatcaggtagaagcattgactaaccaggaagaagttgaactgcgttcgaaaatcgaagcccttggattggaggttacaaaagttccttccatgtctacacacagccttgatgagctggaaattgcgagagagttggacaagttatcggctaagttagacggtgtggatgagatgatatcctcagccatggcagcagacccgcaggtgcgatcccttttgagtggcactgctgatttatggatgccggttattactgccaatgctgatgagcgacgcaatttggctgcatcaatcagtactgataataacccgcttggcaacaatgaagacgacatcaaacccgacaattgatgtttcaccggtcagtcacctccgccatactttgttctaatactaatttgttttcgggtttttggggatatgtcatatgactagaatataccattgcattaatcattttgttttgtctattggggaacaaaaagtaagtttcttattctgttgtatccgtagttacattgggtctcattattttaaactcgaattgggttagacgcaagacggagaaagctcttataaagtgtttatttttacttattctctatccacaaaactcaaaaccgataccttgttttagaggcttcgaacttcaaaaacaatagtgttgctcatgttggaactaatggctgctcttcttcttcctcttgatgctgttgatgacgatgatgatgatgaccagcttcattggtttttttacctcatgggggagatgataatctgttagatatagagtaagggactttgtttattagtttaaattttattcctttctttttgttcctaattagtttaattaaggatcatcacacgttgctgctgatatataacctgggatatgttttctttttcgttatttaagatctagaaatatgaaaagggaaaatttttcccaagtccttatctcctaa

SEQ ID NO: 373 - DNA, 620 bp, Medicago truncatula
agaaagatagtcatggctagcagcagcatggcatcagcagctactggatttttgttgtcacttaatgttgctgccaacagcacaacctcttcagcttcttcaaggagtaccatgttgatgttccctttaaagtccaacaatattggttcttcttcttctagacttgttgtcagggcaaccgatgaggctgccccggctgcacctgctgcccccgctgctccagctgctgatgcagctcctactcctaaacccaagccaccaccaattggccccaagagaggttctaaggtgaagattcttaggaaggaatcctactggtacaaaggcactggatcagttgttgctgttgatcaagaccccaagactcgctaccctgtcgtggttcgattccagaaagtgaactacgccaatgtatcgacaaataactatgctttggatgagattgaagaagttgtttaatgagacaaatttaattgtaatttcaactcttgttatgatattgaagttactagcctaaggttttttcatgtcaaaaatatttgtatcatattctgtctgatatctatcttcttcttgatctctagaaactacattcattgtgcagttgcccataatcttaa

SEQ ID NO: 374 - DNA, 1307 bp, Medicago truncatula
atggcttgttgtgattggaatgtgttaaaagagagtgttagtggcttaaacgagaaagcggaaagtggtagaagatttgaggatgcggaggaatacgcaatggtgttgttttgtgtgaatcgtatttcgcatcattttcgagactgtgaacttctccattttggtgttggtttcagatttcatagttttcatctttctttcccacgctctctaaaaccctgtctccctggtaatgctatctccgttaccaatagaagcaacgaaaacaaatgctattcttctaagtattctggaggagcaggagaaattccccttcttttcgattcttctttcagccaacaagaagatgatcgtgaaattatatccgacgggatatctgcagttgcaggtggaattgtggcgctgggaaagtttgatgctctgcacatagggcatcgagaacttgcaattcaagcatcaagggctggacctccatttcttttatcatttgttggcatggcaaaagtatttggttgggaacatagagctcccatagtcgctaaatgtgatcgaaagcgcgttctttcatcttggtttccttattgtggtaacatggtcccagaagagtttgagattgagttttcaagcgtgcggcatctcagtccgcgacaatttgttgagaagttagcaaaagagcttagagtgcgtggagttgttgcaggtgagaactaccggtttggatataaagcagctggtgatgcatcagaattacaaaagctatgcgaggagtatgaaatggaagcttacataataaaatctgttatggacaagaaccaatactcaacaaatataaattccagtattggctccaaagagaggggtcaggtctcgtcaacccgtgtccgcgaagcgcttgctgtaggagacatgagatatgtctcagagcttttgggtagacaacatcgtcttgtattaatggccacagatcgagaaacgttcagctttagccagtataaggtgtctgctcctaaatcatgcttattgaatctagcaccaaaggaaggtctatatgagaagtgttcacttttacttggtcaagaaaatgttatgctatgtagggtaattattgacagcaagtttgtccatatagaaacagattacggcggttcgagtgatatttttggtactcacgatttgcagtacttgcttattgaatttggtgattccagtacttgattcagtttagataatgtttctatttaaattcttagtctacttaatcgcagatgattcttatatgtcccggatgaaaattctaagtcttaagc

SEQ ID NO: 375 - DNA, 2136 bp, Glycine max
taattttatttcccagcacagcaccatggaagcgttgcgcgtcgcccccacaaccccacctctcctccgccgccaccaccctctccgccaaatggcgcgccaccccctcacagcgcgcccccgccgcgcgcccctcatcgccgccaccctctccacgccgccggaggccgctcactcttccgtcgccgccgccgtcgccgaagatccctcggaggcggctcctcctccgcgcccccgcgtcttgccggattccctccagtacccgcccggcttcgtcggcgcgattcccgcccgctcccgctccgacggtggcggcggcgggattgatgccatgacttatttgacgaacattctctcttcgaaggtgtatgacgtggcgattgagtctcctctgcaattggcgccaaagctctctgcgagactcggggttaaggtttggctcaagagagaggatttgcaacctgttttctcatttaagcttcgtggagcttataatatgatggcaaagcttccgagggaattgttggaaaggggggttatatgctcgtctgctggcaatcatgctcaaggagttgcattggctgccaagaggttgaattgcagtgcggtgattgctatgcctgtcaccactccggaaatcaagtggaaatccgtggaggcgctgggtgctacagttgtgctcgtgggggattcatatgatgaagcacaagcgtatgctaagaagcggggggtagaggagggtaggacattcgtacctccttttgatcatcctgatgtcatcatgggtcagggaacagttgggatggaaattgtccgccaaatgcagggtccaatttttgcaatctttgtgcctgtgggaggaggtggtctcattgctggtattgctgcttatgtgaagagggttaatccggaggtgaagatttttggggtggaacccactgatgcgaatgcaatggcattgtcactccatcatgatcagagagtgattttggatcaggttggaggatttgcagatggtgtagctgttaaagaggttggtgaagaaacttttcgcatatgcaaggagttgatagatggcgttgttcttgtaagccgtgattcaatttgtgcgtcaataaaagatatgttcgaggagaaaaggaacatattagaaccagcaggtgcacttgcactagctggagctgaggcatactgcaagcatcatggggtccaggggaaagatattgtagtaataaccagtggagcaaacatgaattttgataaacttcgggttgtaactgaactcgctaacgttggccgtaaacaagaggctgtgctggcaactgttttgccagaggagccgggcagtttcaaacagttttgtgaattggtggggcagatgaacatcacagaattcaaatacagatataactccaatgagaaggctgttgtcctttacagtgttgggattcacacagtctccgaattaagagcaatgcaggagaggatggaatcttctcagctcaaaacttacaatctcacagaaagtgacttggtgaaagaccacttgcgttacttgatgggaggccgatcaaacattcagaatgaggttctctgtcgtttcacctttccagaaagacctggtgctttgatgaaatttttggaccccttcagtccacgttggaatatcagtttattccattaccgaggggagggtgaaactggagcaaatgtgctagttggaatacaggtacccaaaagtgagatggatgagttccacgatcgtgccaacaaacttggatatgattataaagtggtgaataatgatgatgacttccagcttctaatgcactgatgatggttttaggcacttgccattattgtgtattttagtcaacaagtttgccatatttaatatttccacggtcgtttctaaaagttggatggggaaaaaaggtggaaaggaagtggccttcagacatgtcattagttgattagaggaacaactagttctttttacctaatgcggcgtcttattacattttttataatctgtaatttatgtttttttgttgttgttaacattggaatcttataatgttgttgcctggtcttttgtgtctgtaatataagtgtcttcaaaaggttgtttgctaa

SEQ ID NO: 376 - DNA, 1509 bp, Glycine max
taataaacctgcaattattatatagcaacataaaaacggaaagacgaattattgcgtcaagttccactctatatccatcgtcaacagtgaagtgcgaatactcagcaactggagctggggaaccttgtctctactcgctctcgtccccgccggagatccaccatggccggcaaccccgccaccacttcctcctccgcattatctcccgagaaatttaatttcaatttctcccccgataacccctcccgaatcaccctcacttcggatcaggtcaaccactgcacccaagccctcaacattctgaaggagaagctccacgctcctaacgtgatcactcaggagttcgcacacttgcaggcgaacaggataacgccgagcgagatgaggagaagatgcaccgtcgcgtatgacgacgtcaatttgaggaaaaaccgatacaccgacgttctgccatttgacaagaacagggttgttctcaaatctagtactgattatagacctgaagcacaggggtatatcaatgcaagccttgtctcgacctcctcagctggaaacgtgtcccagtttatagccacgcaaggtccacttcaacatacttacgaggatttctgggaaatgatcatccaatatcactgccctgcaattatcatgcttactaggttggtggataattacaagatgacaaaatgtggagattattttcaagctgaggataggcctagagaagttggtaatatttctattattggtaaatgggagaacactactgaaacttcactcgtgctgcgccatttggaggtgaaccatagagaggtagaagatgcgccattatctgttttgcatattcagtatcctgaatggcctgaccatggagttcccaaagatacatttgctgtgcgtgaaattctgaaaagattataccatttaccaccaaactttggtccaatagtggtgcactgcagtgcaggtattggtagaactggaacatactgcacaattcacaacacaattcagagaatagttgctggtgatatgtctgctgtagatattgctaagacaatagctatgttcaggtcccagcgtattggaatggttcagacccaggatcagtacattttctgctataacgctatcatagatgaactggaagaccttgtatctcagcagcagtaggagtagaaggtgctggaacttggaaggatgttgaagctgcttgcctcattttgaagctaactatcaattcttcgaacgtttttatgttcctgcaatgctcatgttttccagcagctgaagtctgaaacattagcatctgggagattttatgaatttcaccgaattctgttattctcatgcttttttgtataattgcaggcagggaaagctgacaaatattaacatccttttgattatattgttagaattctattggggaacagaatggcataatgactacaataatgcattgtccctcctattgctatttttcattttctaaacccctcccctcac

SEQ ID NO: 377 - DNA, 800 bp, Solanum lycopersicum
gaactttccatacaccctttgttctccacattttaccagaactttctagattctctccgctatatataagagcctcctctgccatgtttttcctcaatcaaaagttcatccaactaacaaaaatcatattaatcaatcgacttagatattttgattgatcgaagatgccgatgcgaccaacaggcggattgaaacaagattgggatccaatcgtgctgcagaagccaaagatgaaggcccaagacctgaaggatccaaaaattgtgaatcaggcattgcgagctggagcacaagttcaaacggtgaagaaattcgacgctggtttgaataagaaggcggcgacgttggcagttaatgtaagaaagctagatgaggcggcggaaccagcggcacttgagaaattgccggtgggtgtaaggcaagcaatacagaaagcgcggattgagaagaagatgagccaagctgatctagcgaagaagatcaatgaaaggacgcaggttgttgccgagtatgagaatggtaaggcagtgcctaatcaactagtgttggggaaaatggagaacgttcttggtgttaaacttagaggtaaaattcacaagtcatgagaagtatgatttttaatttgtgtggaaatggaaaggccatagttgttgttgttgttcttgtataaatggttatatgttaattgtaagaggtaaaattcacaagtcatgatttttgatatctatgcacctctaattgtatcttaaattagtgtaaaattgaacaaataataacgtgacaacaaaaattattatatt

SEQ ID NO: 378 - DNA, 1521 bp, Solanum lycopersicum
gcagcatctcacagtcaaaactgcacatgtttttatagggtttttctctttaacactctttcttgaatcttgaaactcaaaaaatggcttcactacttcaattccttcctctcttccctttctttttcttggtttcattctgtgtttctcatggaccctttttaccaaaagccattattctccctgtaaacaaagatccatctacttttcaatatgttactcaactctacatgggtgttactcatcttgctcccatcaaattagttgtagatcttgaaggttcatttctatgggctgattgtgggttgacttctgattcttcaagtcaaaaacttgtaccttgtaattcactcaaatgttccatggctaagcctaatggttgtactaatgacaacaagatctgtggtttgaaatcagaaaacccctttacaagattagctgcaacaggggaattagcagaggatatgtttgctgtggagtttattgatgagttgaaaacaggctcagttgcttcaattcatcagttcttgttttcttgtacatcatctactctgttacaaggacttgctagaggtgctaaaggtatgttggggcttggtaattcaagaattgcattgccatctcagttgtctgatacatttggttttcaaaggaaatttgctatttgtttgtcttcttcaaatggtgctataatttctggtgaaagtccttatttgtcacttttgagccatgatgtttcaagatccatgctttatacacctttgatttcatctagaaatggggtttcagaagagtattacataaatgtcaaatccctcaaaattaatggaaagaaactatctttgaacacaactttgcttaccatggatggggaaggtcaaggagggacaagaattagtaccatttccccttttacaactatgaagacctcaatttacaagacatttgttgaagcttatgaaagatttggtttttccatgggattgactaaagtagaacctatagcaccatttgggctttgctttagcacaaaagtagaggagggactaaatgtgccaagtattgatcttgtgttgcaaagtgagatggttaagtggaggatttatgagagtaattcaatggtgaaagtaagtgatgaagtgatgtgtttgggattcttggatggaggggctaaccaaaaggcatcaattgttatagggggtcaccaattggaggataatcttttggagtttaatttgggaacttctatgcttggatttacttcttcattgtcaatggtggaaactagctgttctgacttcatgttctcaaaggattcttcaccttttgattcttgacatgaatccttaaccaaagattgacaattcccttttgtatagttgtgttaagaacatgtattggctcttaattatagataatcataacttaggccaatcttagtatattagaggagtactagtttattgtgagatagtgtttcttgactcacttttttgagttgtgagaaagttttgatatgta

SEQ ID NO: 379 - DNA, 1443 bp, Solanum lycopersicum
tagaacatttccaaaccttttttcaactattatttttccttaaataataggaaaaatttatttaacacgtttgaaacaaacaccaccaaatttggtgacgccccccatcttctttccaattttcacctaactatatattttcactctcacattataaaccctcaaaaaaatcaaaataaacacattttttctttccacaaatatggcttctttcttctgttcaaccaagttccttctactcctattttttctatctgcaattccaatcgcctttatcatccatctagaaacttcttctccgacgactcacgtttaccattatcacagtaccggctggttacgcgagtgttctaaatgggacgatgctaaccgccggttcattgtcagtttcttcgaaggtggtttgggtgtgattccggttgaggccgattattctcccggcgacgtactacaggaaatgccggtagtgaaagacgctgatttgaccggtaatgcgtcgctcggttttactatagaccgggaaaggaaccgggttttagtcgccgtcgcagatgttttggggaatcggtatagcgctttggctgcctatgatttgacatcgtggaaccgggtttttctcaccaaacttagcggtccagaggatgaaaaagcatttgcggatgatgtggtggttgatacagaagggaatgcatacataacagatgcaaaagcagacaagatatggaaggtaggcgcgaatggtgaacttaaatatacaatcaagaactcaatatttactcctaaagagtggtacaataaactggttgggctaaacggaatagtgtatcatccaaacggatacttactggtggctcatacattctctgggaatttgttcaagattgaaattgccaaaggtgataaagttaaactagtaaagattgacaatggatcgttgaaatttggtgatggcatggagttactatctccaaccaagcttgttgtggctggaaatccgacaaggctagttgagagctctgatgattgggagagtggcactattgtggggaaggccaaaggcgctattcatcgtttaagtacagcagcaactgtgaaggaagggactgtttatcttaatcatatgattggtttgggatatcctaggaagaaacatgttcttgttgaagctgttttttctgcttaattattgttccatccatcccttttcatttgtgtgtaagagtcaattttatacttgattaccacactactgatttatgttcctcacataaagaacagttgtatcgcatcgtatcgtaggatatacagtatttatgttgttatgcatcaagcattgcagtatttggatgtgtttttgctcttttactatcaaggaatgcaagcaaaaagtatccaactacaacaatttatcatgttgtccagtaatgctagtagttctctctt

SEQ ID NO: 380 - DNA, 1760 bp, Solanum lycopersicum
ttgaattattactttgcagggaaaagagttctatatcccggccatctcctcccgtcggtacagtacgacctccggcgtcggcagaagaagtaactctcttacgcggcctctgtaaggcatgccgggtccaacaatggaatcagaatttccagtggagccacaatcgctgaagaagctaagcttcaagtcccttaaacgatctcttgacttattttcacctatccatggccatttccctcttcctgaccctgaaagcaagaaagttcgaacgagctataagctaaatgtcgagtatggaggtataaaaggctcagcggctgaacctaacgccaaagcgggtgtgcagcatcaggctcaaccagcttctgcaccttccaatacccttgctcttccaggtcctgaaaatacaagagacgagaaaaccggaaatgaactggctcttggtccatccataccagcgaatggcccgactgatgttaggttctcagggaaaagcaatgctgttgttccttctcacggttcatctgaaagaaatttgtcaactgctgcaatcatggaaagaattccaagcagatggcctcgtccaatatggcgtgctccatggaaaaattaccgggttatcagtggccatttgggatgggtgaggtctgtcgcagtggatcctagtaatacttggttttgtacaggatcagcagatcgcactatcaagatatgggatttagcaagtggaagactgaagctcactttaacagggcacattgaacaagtccgaggccttgctgttagtaataaacacacatacatgttctctgctggtgatgataagctagttaaatgctgggacctggaacaaaataaggtgatccgctcctatcatggccacctcagcggtgtttattgcttggctcttcatccaaccattgacatcttgttcaccgggggtcgtgattctgtctgccgggtttgggatattcgtagcaaaatgcaaattcatgctctatctggacatgacaatactgtttgttctgtttttaccaggccgatggatccacaggttataactggctctcatgacagtaccattaagttctgggaccttagatatggtaagacaatggcaactctcacacatcacaagaaatctgttcgagctatggctcagcatcctacagaggattgttttgcttctgcatcagcagacaacataaaaaagttcagtcttccaaaaggagaatttatgcacaacatgctttcccaacagaaaaccatagtcaacgcgatggcaattaataatgacggtgtaatggtcactggaggtgacaatggaagcatgtggttttgggattggaaaagcggtcacaatttccagcaatctcaaactattgttcaacctgggtcactggacagtgaggctggcatttatgccctcacctacgatgtaaccggctcaaggctgatcagctgtgaagctgataagaccatcaagatgtggaaagaagacgaaactgctaccccagaaactcatcctcttcactttaagcctccaaaagacattaggcgtttctagttgtaatcgtaattcagaaagcaaccctttgtaatacatacaaatcgaacttcttctgtgcgtcgtttcggagtaagactgacccgataaaagcaccatgtccagagtagttcacttgcctctttgtatccatcatttacttgtgttttttatttagtgaaggattcatctttttcttcctaccacaagaggc

SEQ ID NO: 381 - DNA, 1903 bp, Solanum lycopersicum
acataaaagttttccgctctatgcactaaaaccaatctcacatggctactcctctcaaaaataccaatagactctctcttgcaatggaaagaactggccaatgggtattttcacaagaaattccaactgatgttattgttgaagtaggtgaagcaaactttaatcttcacaagttcatgctagtagcaaagagcaattacataaggaaacttatacttgatactaaagaaagtgatgtaagtcgtataaacttgtctgatattcctggagggccagagatgtttgagaaggcagccaagttctgctatggagttaactttgaaatcacagtacataacgttgctgctcttcgttgtgctgctgaatatcttcaaatgactgataaatactgtgacaacaatctcgcaagcagaacagaggattttctagctcaagttgccttgactagcctttctggtgcacttgttgtgttaaagtcatgtgaaaatcttcttcctcttgcacatgatctcaatatcattcaaagatgtgttgacatcgccggtgctaaggcgtgtgtggaggcgaattttcctagcagatcaccaccaaattggtggacggaagagttaactatcttagatgtagcttttttcgagagaattattgttgcaatgaaaactcgtggggcaaaagcgttaaccatagcaagtgccataatcacatatacagagagatctcttcgtgatcttgtacgtgaccactcaggaaacaacacgagattaatggtaccagaggattcggatatgagaatgcatcaacgggaacttctagagtcgattgtgactctgttgcccgcggagagagcagcttttccaatcaatttcttgtgttgtctcctgcgtacagctattttcttaagagcagccagtagctgcaagaatgaattggagaaaaggatatcagcaatactagaacacgtgacagtcgatgatctgttagtcttgtctttttcttatgacggagaaagactattcgatcttgagagcgtgaggagaatcatttccggatttatggagaaagagaagagtgtagctgtgtttaaaggtggtgattttggagacgtttgtaccaccgctatgcagagagttgcaaagactgtcgatgcttatcttggtgaaatcgctacatttggagatctcagtatatcaaaattcaatggaattgctattttggttcctaagggcgcgagaaaggctgatgatgatctttatcgagctgttgatatctacttgaaggcacatccacatttggatgaaattgaaagagaaaaagtgtgtagtgtgatggatcctttgaaactatcacatgaagcaagagtccatgcttctcaaaacaaacgtttgccggtgcaaatagtccttcatgctctctatttcgatcaactaaagataaggagcggggcagcagatgatactaataacaacatgcctgaagccatggcaacaaggaatcaattacaagctgatgtttccctcgtaaaggaaaatgaagttttgagaacggagttgctaaagatgaagatgtacatagcagatatacagaaaacaacaaattctagtcaaggaacatcaaaagggagtctgaagaagacaacattcttctcttctgtctccaaaacattaggcaaattcaatccctttaaacatggatcaaaggacacttctaatattgttgatgatgctgctctagatcttactaagcctaggagaagaagattttccatatcttaagccatttacattatttggtttaattttagttttatgttgtgtgagaaaactatgattgattttgtactgtaaaggattgattgattatgttgtttgattatattgttatgttaatatgttcatgtatcaca

SEQ ID NO: 382 - DNA, 2931 bp, Solanum lycopersicum
aaccagtaaaaaacatacaaaactccaaaaatcccacccctttcatacccataaacaccaaaccctaaccttataagaatgggataaaatacctgtactaaatttccaatttgttcacgatttcaaatttttgttttcaaatcatactagtctgttctctttaaggcctcgttgaacagccgtttcattgaaaggttggtacttgaagacaacggtatgtgcaatttttcttctaaattagaggtttgtgcgccaactcaatccgctgccttattcattattggactttttgaatctggttgatgaggagcgttcggatggactcaattggtcccccaactaaaaggttggtggaactcaaccgtcatagcatacaggatggtcagaatggtgtaagggatgggattactggtgatggacaggggctttcagaagaagatgagtcaaggattaatgaggatgtcgaaggtgggaatgaaacacagagggatttgttacaagtgcaggctgttttacagacacagcagcaacagcccccagggcctttggttaggtgggagcgttttcttcctcttagatccctcaaggttctgctggtagaaaatgatgattcaactcgtcatgttgtcagtgcattgctgcgaaactgcagttatgaagttatagctgtgggatatgcccttgaagcatggaggattttagaagatctaactaaccatgttgatcttgttctgacggaggtggccatgccatttttgtctggtgttggtcttttgtcaaagattatgaaccacaaaactctcaagaatgtcccagtgattatgatgtctgctaatgactctatgggtatagtctttaagtgtttgtcaaagggcgcagttgactttttagtgaagcctattcgaaagaatgagcttaaaaatctgtggcagcatgtttggaggaaatgccatagttcaagcggaagtggaagtgaaagtggtatacaaactcaaaagtcgacgaaatctaaaagtgttgaaatgtcgggaaacaacactgatagcaatgatgaagctgagaatggaagctttgatctggacgacagggacggaagtgacaatggaagtggcactcagagttcgtggtctaaaagggccattgaagtcgacagcccccaacccatgtcaccatggaatgaattggcagatccccctgatagcacttgtgcccaggttatccattcaagaccagaagcacttagtgctacctgggtgcctgcaaatgccacaagaagatgtctcaatgagaaggatgaactgggaaatgttagaacggttaaagatttgaacatgggcgttgctaatgttccagagctcgaaggcctatcaggtaaagttatggatggtttagcagcttctatgaaggacaaacatttggagttagatcctaaagataatgagaatatgggtagaaacctaaagctgaacaaggaaacacgggaagatgacctgaaggacaaggatgttggttatatgggtgacataaccaacacatgtacgcctcaagtagaaagtactgccaatgaagttccaaatgatccttccaagatcacaaacatcaaagaaattgccacctatgacagtaaagacatgccttcacttgaacttagtttgaagcaacttcgagatgttggagagaatgggactggtgtgcaagagcgaaatatactcaggcattcagatctgtcagcgttctctaggcatgtgattcatctgtataatgctgcttcaactgctaatcaggctccaactggaaacgtgggcagctgttcaccagttaataatagttcagaagttgcaaaagcagaatcaattcacaacttgcaatccaagtcgagcagtacccctaatcagcgctcaaatggaagtagtaacaacaatgacatgggctcgtcgacaaataatttcttcatcaaaccagacacattaattgacaaaccaataaacaaacctgcagtcaatgcccattcctgttctgcatttcaaccagtgcaacatggacatacttcttctcttcaagcaatggttccaggaacacaagatactgcaaaggcagccgtgggccaagcaagagcaatgcaccagaagttccaagttcagcaccaccatcatcactaccatcaccatcaccaccatgtgcttagcttgcagcagcgacaacagctgcttaacgctgatgcttcgtctttgcgaaatgctgttgaaactgctcccgattgtggaacatctgacatggtaggtactcctgttgaaggaaatgctgctaattatggaagtgcatcaggaagtaacaatggaagcaatgggcaaaatggaagcagtggccaaaatgggagcagcactgctgtagttgctgaaggaaccaatttggttgctgaaaatgaaactggtgaaaaatgtgaaattggaagtgggagtggaagtgcaactagaagtggtgatcactcggctcaacgagaggctgctctgattaaattccggcaaaagaggaaggagagatgctttgagaagaaggtccggtaccagagtagaaagagacttgcagaacaaaggccacgcatgcgagggcaatttgtgcgtcaagatgcagacaaaagtaaaagcaacaatacaaattcctgacccctaccgtttgaattggatggttgatgtcaaatgagttcaagaagctttaactttgatcgcctaggtagggaggaagcagttcggtaaaacagctaaatttatttagttgaagcattggtgtctagtaataattacttattggagatgttattaattggggagtcctatgaagacgtctttgttatatagtcagtttgaagatacttattttgcacttctagatgttgggaataccctaataaaattcttcagtatgttgtgcttt

SEQ ID NO: 383 - DNA, 1255 bp, Solanum lycopersicum
tgattcaaaaccccaaacaattgatattatccacattccacatacatacaacagtgccaaagaagaagtggaatcccttttccatggctatctctacatccttttgccgccccatttcctctttcaatgctctcagttcaccgtctctctgttacttcaaacccttgtacaaccacttgaaacttgatccttctttgcccctagtcaagtgttgctcctctcacattggacaatctccagaacacatcaacggcaggcaacctgatttatctcctatagcttcttttggtgtcacaatgacaaataatggaacatctaaaccatcatatagatggcgtagggtactgcttaaagttagtggtgaggcactagcaggagatcaagcacaaaacattgatccaaagatcacaatggccattgcgagggaagtggcagctgtcactcgacttggcatcgaggttgcaatagttgttggtggaggtaatatttttcgtggatcctcctgggcaggaagtagtggactagatcgttcctctgctgattatattgggatgttggcaactgtaatgaatgcaatattcttacaagctacaatggagagcattggaatccccacaagagtccagactgcatttagaatgtcggaagttgctgaaccatatatccgtagaagggctgttaggcatctcgagaaagggagagtagtaatttttgcagcaggaactggaaatcccttcttcacgacagacactgctgcagcactgcgttgtgcagagattaatgctgaggtggtgttgaaggcaacaaatgttgatggagtctatgatgataaccctaagcataatcctaatgctcgtcttcaggataacctgacttaccatgatgttatttcaaaagagctctcagtgatggaccttactgcgattactttgtgccaagagaataacattccagttgtcgtttttaatctcaataaaacaggtaacattgccaaagccattaaaggagagagagttggcacattgattggtgacacatggaatacagaagcagtagtatcttaagagtacaaaatagttggtttcagcagatggaagttggatcactgttcgtagcatttcaacacactcagatagctcatttggcagattgttccaagaagttggcactcaaatattgagtaaattatgtgccatttgcccttcgaaaactatggattcgaaagtactgaagataagcatataatctcccggaa

SEQ ID NO: 384 - DNA, 869 bp, Solanum lycopersicum
ccactcaattctcaaacttaacaatggcttccacaggtagccttttgtgcaaatgtagagtttcttctttgatgagtatctcttcttttcctttgatgcaacccataaccagaccagaaataacttactcccagagacatctcagagtcggaacttcctctgtcctaaggaatgtatcccacaacatgagcatgaagaaagttccacgtatgatcaccagagctagctcagaaccgagtggcagtagcgatggagctcttggacagaataaggcatacaccatttggatatacgagaaaggatgttatattgattggagttggagttacacttctaggggttggcttaaagagtggattggagttcttgggatttgaccctttacaagctggaaatgtcgttcaactagtcctggttttgggtctaacagttggatggatctcaacatacatcttccgggtttcaaacaaggaaatgacatatgctcaacaactacgagactacgaaagcaaagtcatggagaaacggttagagagcttaacagaagcggaattacaagtattgcttgagcaggttgaagaagagaagacccgcctgactagtggtgaagaggtcaaatagatattgttttccttgtggctacgtatcgttggaccttgttatccatgaattatggactagaccatactgaagtctgtacagtgtcgatatatgtttgcctagcattcgatgatcacatccaacttgataaaacaattctggaatgaaacaggttccaccaggtggggactggggagttcatgttatgtaaattgtttaggattatatagaaaatacatggtatacgaactattatttatcgcttgtgc

SEQ ID NO: 385 - DNA, 1436 bp, Solanum lycopersicum
agtcgcaaaataaacttacaaaacagcacatatatatagagacaaaatcacataatacgccctcgccggaatcttattttcactgtcgccggccgttaaaactttttttttctagttcggaggtcaaataattaacctccgatcggaagaagtagttattctaactgcttctatttaatctgaaaacgggaaaacccctgagctggttaaggtggatttcgtgatgggattttgtatttgtcctttggaaactcctgctagattactgtggagtactagtttcttccgccacaagcttatgctcttctaaaacttagtcaactctcttttttcatacacatccctgctaaaaaagaagaactctgtgctggagtttttgttttcctttttctgtttcgccggaaacatataaataatcttctgtgtgtaaataggcgattttccagatagttgaaaatatgggatctgggcatatatttttcgacccgtcgtcgtgtcacggcaacatgctgttccttgggagcggagatcctgttttccgaggaccaagatcgacgatgatgaagatggaggactcctcgaagaggcgacccttctttagctcgccggaggatctatatgacgaggaatactacgacgagcagtcaccggagaagaagcgccgtctcactcctgagcaggtgcacttgttggagaagagctttgagacagaaaacaagctggagcccgagcgcaaaacccagctggccaaaaagctggggctgcagcccagacaggtggctgtatggttccaaaaccgccgtgcccggtggaagaccaagcagctcgagagggattatgatcagctcaaatcctcttatgactcccttctctctgattttgactccgttcgcaaagataacgataagctcaaatctgaggttgtttcattgatggaaaagttgcaggggaaagtggttgcagttgcagggggaaatgaaaaatctgacatgttggaggtcgatgctatgacgacccttcaagtgaaggtgaaggctgaggaccggttgagcagtggcagtggtgggagcgcggtggtagatgagcatagtccacagctggtggacagtggggactcatattttcacactgatcatgaggagtatccagggcctggaggatgcaatgttcctccacccatggatggtttacaatcggaggaagatgatggtagtgatgatcatggcagttgccatggctacttctctaacgtctttgtggcagaagagcagcaccatgaacaaggagaagagcctattggatggttctggtcttaattgaattttagaatattatattacagtttttcttatctacgcgcgctttgtatgatgaaataagtgttgtaattccaacttcttatttaaacatctattaatatgcttttgcagctttta

SEQ ID NO: 386 - DNA, 1977 bp, Solanum lycopersicum
aatcttgtttggaacagagtcttcagttttattgctttcttgttttcatcgacatcatcaactttctcattcttcaaatctaccgcacacccacctcctcattcattctcatttctctgtcagagtagtaattgttcttgcaggaagacaggaatcggattacattgatcaggaaatggattctgcagccatgactagcgtttgtggcaaatctgctctttgctctactcccggtttatttttggggagaacgaacggtattaggagctcgcagtgtagctttatagctggaaataggataaactttccaaggcagacagctcaagcacacagagttcgtactaattctcgcaagggtcatggtgctcttactgtgacatgccgcgccgagaaaattctggtggcaaatagaggagagattgctgttcgcgtgatccgaactgcccatgagatgggaattccttgtgttgcggtttattcgaccattgataaagatgccttacatgtgaagctagctgatgaatctgtttgcattggagaagcaccaagtaatcagtcgtatttagtgatcccaaatgtcttgtctgctgctatcagtcgcggatgtacaatgttgcatcctggatatggtttcctttctgagaatgcaagttttgttgagatgtgcagagaacatggaatcaactttattgggccaaatccagacagcataagagtcatgggtgacaaagccactgctagagatacaatgaagaatgctggtgttccaactgtaccaggaagtgacggactattgcagagtactgaagaaggtgtaaagcttgccgaggagattggttaccccgtgatgattaaggcaacagctggtggtggtggacgtggaatgcgtcttgctaaagaacctaatgagttcgtaaaattattgcagcaagctaagagtgaagcagcagctgcatttggaaatgatggcgtttatctggagaagtacatcgtaaatcccaggcacattgaatttcaggttttggcggacaagtatggtaatgttgtacactttggagagcgtgattgcagtattcagagaagaaaccaaaagttgctggaggaagcaccatccccggcattgacaccagagctgaggaaagccatgggtgatgcagctgtggcagcagcagcatctataggttacattggtgttggaaccatagagttcctattggatgagagaggctccttttacttcatggaaatgaacactcgtattcaggtagagcatccggtgacagaaatgatatcctctgttgatctgatagaggaacagatccgtgtcgctatgggagaaaagctccgatacaaacaggaggatattgtgcttagaggacattcaattgaatgccgtataaacgcagaagatgctttcaaaaacttcagacccggcccagggagaatcacttcatatttaccagctggaggtccatttacgcgtatggatagccatgtttatcctgactatgtggttccacctagctacgattccctgctaggaaagctcatcgtatgggctccaacacgcgagagggctattgagcgcatgaaaagagcacttgatgacaccgttatcactggagttcctaccacaatagaatatcataaactcatccttgatatcgaggactttaagaacgggaaagttgatactgctttcattccaaagcatgaggaagaattagctccgcctcagcaaattgttccagcagcaagcaaggagctgatcaatgccaatgcttaattattcttctattttagttttagttttttcttctttgattttcttgcttcatcaagtgaatatagtttaagaacattactctcattggaacttgaagtgagtgcatttttggatataactttcatctccttttatctttagcttgttgtatttaaagatacacaagactgaatgaaattattctcttttta

SEQ ID NO: 387 - DNA, 1552 bp, Solanum lycopersicum
ttatgctgcacttgtgaccttgcaatagtagtgctttcaaagaggttgagctttgttgaaagtacacaatggaggcagtacgtgaactctacaacagagccaaaccctttcttgcagtcatttttctccaatttgggctagcaggcatggatattctcaccaaagtggccttgaatgaaggaatgagtaactatgtatttgttgtgtaccgccatgcagttgccactttggttattgctccttttgcaataattctagacaagaaagtaagaccaaagatgaccccctcaatatttgctaagttggtacttcttagcttactggagcctgtcatcgaccagaatctctactctattggcctgaaatacacaacagcaacgtttgcagctgcaatgtgcaacattcttcctgccattacttttataatggcctggatattcaggcttgagaaggtgaagcttacaagcatccgcagccaagccaaaatagttgggactgttgccacagtggcaggagccatgatcatgacactggtacgaggtccaatagttgaactattttggacaacaggaaatgccggtcataactctcaaagtggtgggttaaatctaagccatgctatcaaaggttccatcatgataacaattgggtgcttcagttgggctgcattcatgattttgcaggcaatcacactgcggacttatcccgctgagctctcgctcactgcttggatatgcttgttgggaacaactgagggagccatagtagcaatggtaatggagagaggaaaacctgcagtgtgggccataaactgggactctaagtttcttgcagctgtatacagtggaatattctgttcaggactcgcgtattatattcaaggagtcataatgaaagacaggggccctgtttttgtcacagctttcaatccattaagcatggttattgtagctgtattgagtacaattattctacgtgaacaactgaacctgggaagggtactcggtgctgttgtgattgttgttggactttacattgtcctatggggtaaaagtaaggatcacaaatctccatcaatcgatgaacaagcaataccaacacatgaaaccaaaattgacaaggaaccttttagtcagacagttacccacatcaattcatcgaaaggaacaactgctaccgaagatgaaggcatataatgattttctatttgaggctttgtcttccaaattccaaaaggaggtctggctatagagcagcctcttcatctaagaaatgagctcctcttcagctgcatcttgaattagtaattattagttaaagatggtttacagcgtgtggccaaatttaagccagttaaaccaccatttttgggaacttctttctgaactatagaatgactaaactatgttaagcctataggccttttcttttggtttttaatcgatattaaaccatgtataataaattatagtaacaacaataatcatgcccagacatgtggataagttggttctttaacttcagatctacaatctaaagttctatctggaaa

SEQ ID NO: 388 - DNA, 3572 bp, Solanum lycopersicum
atatttagattatactattttgaccaatcctcttcccctgttttcttctgtaaagacaccacctattcttggcaatttccaaataaaaatggcgaaaaagcaaaatgattcttcaagattttcaacaaatcttactccatctccccaaaaagacaaacccatttcatcttcatcagaattagctctgttttaccctcaaaatgaagaaccagttccattgatagtgttttatccatcatcagtcaggagaagatcttctagattcactaccaacaaattcagtactagtgctactgaattcatgacgaaaaatcgggacaccatttcccctgaaaaaactgtttttcttcttccatcaccacctacattggccggaaaaaatactccggcggaaggtacgaggaggtcgccgagattggtatcactgtcagctaggacgacgacggcgaaggagaagggcaaaaaagtaaattcaaggaaatcggagggtggaataaaacaagtggaactatcgaggaagcggaaaccggcaagttgtaaaatggatgaagaaacccgaaaatctccgaggttcaattccgattcctcaaatggagttcaactagcattgccggagatgagcgcgtgcggtgcactcgccgccggcggaagaaccggcacgaagagggaactgctggctctgatgatgacgacgccggcgaacagcagcgcgtcgaggaaacgcgctgccagggggagtgattcagtaaatgtagggaacaattcacgaggatcccggaggaaagatccagtttttgcagaatcgccgggaacatcggtaaaaataacggctgagagcaattcagcgggagagaagaatttaagatcgagaaaagcacaagggagtgttaattataatgagagtaaaggatcggaaacgaaacggataaaaagttcagcagagaaaagtgtgaggaagcagaagagtaatgcatgttttatcggtgagccgatagatacagaggaagctcaacagcaatggcaatggcgatacgaattgaagaatcgaaaaacgcagcgccaagggtggaaattaaattccggcgaagaagatgaaatcatattaaatgtggaatgccattatgctcaagctaaggttgctggtttcattttcaatattggagattgtgcatttgtaaagggtgaaggcaagaaaaaacatattggcaggatcttggagtttttcaagacgacagagggggaagattattttagggtacaatggttcttcagagctgaagatacggtgttgcaaggtgcggcttctttccatgacccaaagcgcgtattctattctactttggagaatgataatttactagactgcatagtttccaaagttaacgtggtagaattaccaaccaggcatgatttgaataaaaaggatgttccacctgctcacttttattacgacatggaatactgtgttgattattccacattccgtacgttgcataatgtcaaaagctctgtctccccttcgctagttgatgtgtcatataagcctatcactacatatcctctggaggtatcaccaagttgtgaacctatgaaagtggagttgtcattattggatctatatgctggttgtggcggcatgtcaatgggattgtgccttggcacaaaactctctggtcttaatcttgtgacgaaatgggcagttgattttaataaagctgcctgtgatagcctgaaactgaatcatcctcagacacatgttaggaatgaaggtgttgagaattttctagagctactgaaaagatgggagaagctaattaagtcgtacggctgtagtgatatcaaaacaagctctaatagtgagctagacgacagagatgaaggcgaaaacaatgatgattctcagtctggttccaatgcatcttctggagaatatgaggtattaagattcgttgacatatgttacggggatcccaacaatgacggaaaatctggacttcattttaaggtgcgatggaaaggttatggtccgagtgaagatacttgggagccaattgagaacttgaaaaattgcggagacagtataaaagattttgttcgaagggggcaacagttgaaaattctgcctctaccaggtgacgttgatatgatatgtgggggtcctccttgccagggcatcagtggatataatcgccacagaaatactgatgacccattgtctgatgaaaaaaatcgtcaaattattatatttatggatgttgtggaattcctacggcctaaatatgtgttgatggaaaatgttgctgacatattgaggttcgataaagcatctcttggaagatatgctttaagccgtttggtacatatgagataccaagcaagacttggaactatggcagctggttgttatggtcttccacaattccgattgcgagttttcttttggggtgcacttccaagtgagaggttgcccccatttccacttccttcgcatgacgtgattgttaaatattggccctcacctgaatttgagcgtaatactgttgcttatgaggaaggacaaccacgtgaccttgaggaagctcttgttcttcgtgatgcgatatctgatatgccagctgtcacatggcatgaaactcgtgaagaaaggccatatgagatgccccctgaaacagagttccagaaatacataagattatctaaacatgagatactgagttgtacatcaactggagtcaaggaaacaaaagaacctgttttgtctgatcatcggccttgccaactaaacgaggacgattacttgcgagtttgtctagtcccacgtagaaagggagcaaatttcagggacctccctggtgtaattgtaggaggggataatgtggctcgtcgtgatactaaagatccaaaggttctaccaaacggaaagcccatggttcctgactgtgcctttaactttgagcatggaaagtctaagaggccatttgcaaggttgtggtgggatgaaacagtagcaacattagtgacgtttcctaatcatcgcgcccaggctatcttacacccagagcaagatcgagtactgaccatacgagagtatgcaagattgcaaggttttccagatttctataggtttactggtactctcaaggaaagatattgccaagttgggaatgctgtagcagttcctgttggtcgcgcacttgggtacgcgcttggacttgcctatcagaggctagctggaaatgagcctcttattaaattgccatcaaatttctcattcttaacacctccaattgatgacattgttgtcttgcaaacataagctcatattcatcatttttttcctcaattggcgatttcggagctactgctgatacttagcagattactccatttttctagtatgaacttttatttaacagaacagatactagactggggcagccaagttgattaatttattgatcaatgaactagcattcctttaatgtgaacctgttttcttatatttataaattctcctttctgaaacagcttatttttggtgtttggtttatagttgtttggctttatacgta

SEQ ID NO: 389 - DNA, 2068 bp, Solanum lycopersicum
acttatatatatatatatatatatatatatatatatatttttcgataaaatataatcgttcaaataataacctcataaaatgacacaaacaacatgtatcatctgctataacaagttaaactatattactatacgatcggattacgcaaaagatatgccctagataaaagataataatttataatgataagatccttttttttaaattaaactttagttttctatattggtactatttaaattattttaattattggtgtggacatatatatacaactacttgcaataaaaatgacaaaaagtagtgataacctcaataagtttgtggccataaatgacatatcatatcataccaactttttattagattggaccatattgaattaattattatttgtccccaatagcagccataataatcaaaggtgacataaaaaaaaaaacaagattaaaaaaactcaagattatctagagaaagttgacttattcattaaatttttcaaagtcaaaatcaatgaatagtcaagttagaatattgatttttaacaaatatataatttttatactatgaatatattgcaggtgagatactacaagtaacgtccaatttctgtcgctaaacaataaaaatcaactgttaatcttatttaataacaaatcgagtactatttaacgataaagttcatatctaattattgcgttatattgcagatttgatagagatttgagatggagaacaggagtacaactttttcctgttgtttgtgagagttctaacaatttcaaggtaacaaaagaagccttagaagaagcatatagtaaagctcaagaatcaaatatcaaagtaaaaggattacttataaacaatccatcaaatccattaggtacaattttggacaaggaaacattaaaagacatattaagattcatcaatgacaaaaacatacatctagtatgtgatgaaatctatgcagcaaccgcgtttagtcaaccttcattcatcagtatctcagaagtcaagagtgaagttgttggatgcaacgatgatttagtacacattgtgtatagtctatcgaaagatctagggtttcctggatttagggttgggattatttactcgtacaatgatgccgttgtcaatattgcacgtaagatgtcaagttttggacttgtttcaacacaaacacaaagattgattgcttcaatgttattagacactatctttgttgaagatttcatcgcgaagagctcgatgagattgttacaaagacatggtttgtttactaaaggattaggtcaagttggaattacaacattgaagagtaatgctggtttgtttatttggatggatttaagaaggtttcttgagaattcaacatttgatgatgaattgaaactttggcatataattattgataaagtgaagcttaatgtttcacctggttgttcatttcattgctcagagccaggttggtttagggtttgttttgctaatatggatgatgctacaatgaagattgcattgagaagaattagacattttgtctatttacaaccaaataagggagttgaagttgcaacaaagaaacaatactgtagaacaaggagcaaacttgaaattagtttgtcatttaggagattggatgattttatgaactctcctcattcacctatgtcttctcctatggtccaagcaaggaattaatcgtacgtatgtggtgttctgatcagcttctacacacatcgttcaattatggacatgtcgactatttcactgagtacctgattgtaagtttacataacataacatagaatggaagtttatatatagtgattctttgtattcttttattaaaagttttttttttttgcctataatatactatggttgcaaaaaaaaaaaatcaagttatgggattttattatattgtgaaatgtgaaattctttttttcttgtgttatatatattttttttcctgtatagctttttgtaagttgaggaaactcaatttgtaatttgagttcaagaggcaaatgcagaggatatatacctatcaatttgtagcga

SEQ ID NO: 390 - DNA, 60 bp, Zea mays
cccgctcactccgagtctcactctcactccgtcctccctcttccttacagaaacacaact

SEQ ID NO: 391 - DNA, 2365 bp, Sorghum bicolor
gacacgcacaggcgtttaagaggggaggagattacggaaagcaaagcgcagcctcgatcgatctctggctgtcgactctgcaggcgtcgcgcctacctataaagccctaacctgcgacgacttcaccatgtgtcatcggagcgagctcctctccctcgtgctgtaccaaccagccatggtcgacaccgtcgccggcgccaccgactaccgcggccagccggcctctcgtgccgccaccggcggctggaaaccgtcggttttcgtcatggcgatggagatcgcggagcggttcgcgtacaagggcgtggccgcgaacctgatcacgtacctgacggggccactggggcagccgatggcgcgcgccgccgcgtccatcgacgcgtggaagggcgtctcccagatgctgccgctgccgctcgcgtgcgtcgccgacgcctggctcggccggtaccgggccatcgtcctcgcctccctcatcttcgtcgtgagcatgggctccctgtcgctgtcggcggcgttgccggccttgcgcggcggccacgtggccatcttctacgtggcgctgtacctggtggctctcggcgagggcgcgcacaagccgtgcgcgcaggcgttcgcggcggaccagtacgacgagaaggaccccaaggagagcgtggcgcggagctcgttcttcaactggtggtacttcggcatgtgcgccggcaccgctgtcaccaccatggtctccagttacgtgcaggacaacgtcggctggggcctcggcttcggcatcccctgcatcgtcatcgtcgcctcgctcgccctgttcttgctcgggaccaggtcgtaccggttctacaccaccacggaggccagccccttctctcgcgtcgggaacgcgttgctggcgttgatccacagctgggcgcccaagcatcgcaccagaaaattaggcgatggcgacgaggacaacgccgtcgccgtcgaggaagtgaagagcgtgctccgcctgctgcccatatgggcgtcgtgcataatctacgcgatcatcttctcccagacgtcgacgttcttcacgaagcaggccgcgacgctggaccgccggatcggcgcgaggttcaaggtgccgccggcggcgctgcagacgttcatcagcgtgagcatcgtcgtcttcatccctgtgtacgacaggctcttcgtgcccctggcgcgacgctacacgggaaggccgacggggatcaccatgctgcagagggtcggcgccggcctggcgctctccctcgtcgccgtggccctgtccgcgctcgtcgagatgaaacgactccgtgtcgcgacggaagccggcctggtgaacaccccgaaggcgcagctccctatgacgctctggtggatggtcccgcagtacatcctcatcggcgtcgccgacgtgttcgccatgatcgggctgcaggagttcttctacgaccaggtccccgacgcggtgcggagccttgggctggccctgttcctgagcatcttcggggtcggccacctcctcagcagcttgctcatctccgtcattgacaagacgacagcgaggagcgggacgagctggttctctaacaacctcaaccgcgcccacctcgactacttttactggctgctcactggcctctgcgccgtggagctcgtcgcctttgtgctcttctctcgagtgtatgcttacaagagaaagagtggcaatgatggtggcagtggtgatctcgtgtgatacatatgcagtttgagccgtactgatcactttgaggggtgcctgtagctgtagttgtttgtagagagccagccctctacggagtacggagttgctacgggattctggtgttaacacactacttttccccttatctcttgatttatgattccaaaatgggctagggaagaggacacttggtttaagtttccaaatgggctagttgaggctatatattctcaaatgggccatccccatattattttgggagttggcaaataacaaaatttgcaaaactattagagttgctataaggggatcttcaattgccaactttaaactagtattagatgccatgtggagtagagagaaaacacagatttttaagctagcgggaagagaagagctagttttttgagatataatatataaataaaaacactttacatatgaagcgtacaaataatatgagatgacatctagtatactattggaggtgtccttgttgcctgaaaaaaaaaagaatgtgtagcctctggacctctagatatcatctttggaaaacatatgtttttagaaggacttcaaaatgttgccgcaagtatattactaagaggagaataatgtgccattgcagctccaacattgtcttag

SEQ ID NO: 392 - DNA, 60 bp, Zea mays
gaaacccgcagatggaggtcgtcgtcgccgcgaagcagaaggcgaagaaacacatacacc

SEQ ID NO: 393 - DNA, 60 bp, Zea mays
actccctcgtcaattcacctccgccgccgccgccgcgccgcttcgaacacgatggatcta

SEQ ID NO: 394 - DNA, 60 bp, Solanum lycopersicum
aagaaaatgtttaaattgctgtttctgttggctatcttactgttgagcagcgatgccgct

SEQ ID NO: 395 - DNA, 1361 bp, Arabidopsis thaliana
tacccacatttctttcattctatcctaaatcctcatcactcaacctgagctcacaaagctaaacaaaaaaaaaaagagcttaggcggagaagaagaggagaccaaaacaccaaacaaacaacaatggctgtctcaactatctactcaacacaagctctcaattcaactcatttcttaacctcttcttcctcctccaaacaagtcttcctctaccgtcgtcaaccacaaaccaaccgtagattcaacacactcatcacttgcgcacaagaaaccatcgtgatcggactagctgctgactctggctgcggcaaaagtacctttatgcggaggctcaccagcgtctttggtggcgctgctaagccaccaaaaggcgggaaccctgattccaacacactcatcagcgacacgaccactgtgatctgtcttgatgattaccattctttggataggtacggtaggaaagagcagaaagtcaccgctttggacccacgcgccaatgactttgatctcatgtatgagcaagtcaaagctcttaagaatggtatagccgtcgagaaaccgatttataaccatgtcactggacttcttgaccctccggagcttattcagcctcctaagattcttgtcatcgaaggtcttcacccaatgtttgatgagcgagtaagagacttactagacttcagtatctacttggacattagcaacgaagtcaaattcgcttggaaaattcagagggacatggctgaaagaggtcacagtttggagagcatcaaagcgagtatcgaagcccgaaagcccgacttcgatgcattcatcgacccgcaaaagcagtacgcggatgcggtcatagaagtgcttcctacgactctgatcccagatgacaacgaagggaaagtgttgagagtgagattgataatgaaggaaggtgttaagtacttcagcccggtttacctgttcgatgaaggttcaaccatctcgtggattccttgcggccgcaaactcacttgctcgtaccctggcatcaagttcaactacgaacctgactcctacttcgaccatgaggtatcagttttggagatggatggacaatttgatagactggacgagctgatttacgtggaaagtcacttgagcaacctctcgaccaaattctacggagaagtcactcaacaaatgctcaaacatgctgatttcccgggtagcaacaacggtactggtcttttccaaaccattgttggattgaagatcagagatctctatgagcagctcattgccaacaaagccactgctcgtgcagaagctaaagcctaaaacaaacgaagcgaagccaaatagaacgcgtcgataaatacatccgcagt

SEQ ID NO: 396 - DNA, 2440 bp, Arabidopsis thaliana
ctgtctccaatggcgttcacctttctctctcctcacccagtctttctctctctaactggaacaacctcttccttctcctacaaaccagttctcttaccattctctcgaaattcccgtactctcacggttgcggcgggacctgctcgccggaattcgtacccgaaccctgctgatgacgatccacctgaagcaccggaggattcaatgcacggagtttcgaagtttcagcagatccagcgtcaagctgctcgtgcacggaagctagaggaagaagatttcgagaagaatcggaacacttatctctccgctatcgccgatgtggaagacgcggcggagacgggacgagatgacgaagaatctggtggagacttgttctctgatatcgatagagcaatctccatgaaacgtagtgagtttgttaagcaaggattgctcaaacctaatcctcccaaaacggcatcgcttaagaagattggggaggagggaaatgaggaagaaggtgatgttactgacgatgttgatgagcttgatgaagaagaagttgttgatttggatgaaattgataaattaactggattaacagagatttctgatgaagaagattgggttgatgaggaaggtaacactaggatcaacaagaagaaggagtttgggtctgatcatcaatttgaattcgatttggatgattttggtgaatctaaagcgagaatcgtggaacctaagttcaaaatgtgcttagctgagcttttagatgagagtaaagtggtaccaatctcagtttacggcgatttagatgtcgaaatcaccgggattcaacatgattcgcgcggtgtgagcgccggagatctcttcgtgtgttgtttaggaagtgaaaatttcttgagtgaagcagataagagaggagcagtggcggttgtagctagcaaagagattgatattgaagatactttaggttgcagagcacttgtcattgttgaagatacgaatgcagttttagcagctttagcttcttccttttataggcatccctcgaagaacatgtcggtgattggagttactggtacggatgggaaaacgactactacgtatttgattaagagcctctatgaagcgatgggtgtgagaacaggaatgtttagcacagtttcttgttatattcatggcgataacaaattggatacgcctaatgctacgatgaatcctgatgctgttttggttcagagtttgatggctaagatgttgcataatggaactgaatctttggttatggaagcttctcctcaagaacttgctttagggaaatgtgatgaagtggatttcgacattgcggttttcacaaatttgactagagaaaatacggattttcgtggtactgatgaagagtatagagatgctgaagccaagttgttttcaagaatggttgatccggaaaggcataggaaagtggttaacatagatgatccaaacgcagcattctttgtccagcaagggaatcctaatgttcctgttgtgacatttgccatggaaaacaccaaagccgatgttcacccgttaaagtttgagctttccttgtttgagacacaggttttggttaatacccctcaaggtatactggagatctcttcgggtttgttaggacggcataacatttataatattcttgctgctgtggctgttgggattgctgttggagctcctcttgaggatattgttagaggtgttgaggaagtcgatgcagtcccaggaaggtgtgagttgattgatgaggaacaagcttttggtgttattgtggatcatgcaaacacacctgatggcttgtcaaggctgctagattcaattcgagagcttaaaccgagaagaatcattaccgttattggttgtgagggtgagaatgaaagagggaaaagaccgcttatgacgaaaattgctactgaaaagagcgatgtgacgatgttgacatctgataatccgaggaatgaagatccattggacatcttggatgacatgttgtctgggattggatggacgatgcaagagtatttgaaacatggcgaacacgattactatccgcctttggcaaatggtcatagactcttccttcacgatattagacgtgtagctgtacgttgtgctgttgctatgggtgaagaaggtgatatggttgttgtagctgggaaagggcatgaagcgtatcagcttgaaggtgaaaagaaagagttttatgatgacagagaggaatgtcgggaagcattacaatacgttgatgagcttcaccaagctggaatagacacaagcgagttcccatggcggttaccagagagtcattaatatctctgtggtgaaatcattagaagagaagttagcttagtccatgaaaccagattttcttccaccatggtccaattctcttgcgaagatcgatttgcacagaggtaatgaa

SEQ ID NO: 397 - DNA, 797 bp, Arabidopsis thaliana
ggtcgaaagaagacgaacataaactcgtctccggtaaccaaaaatggtttccatgactacttcatcttcttcgtacggaacattctctacagtcgtcaacagttctagacctaattcctcagcaacctttctcgtcccttccttgaaattctccaccggaatatcgaatttcgcgaatctgagtaatgggttttctctaaaatctccaattaatcctgggtttctcttcaagtctcgtcctttcactgtccaagctagagctgctgcagaaaaaaccgttcacgatttcaccgttaaggacattgatgggaaggatgttgctttgaacaaattcaaggggaaagttatgttgattgtcaatgttgcttcaagatgtggtttgacatcatcaaattactcagagctttcacatctgtacgagaaatacaaaactcaaggatttgagattctagcttttccctgcaatcagtttggtttccaagagcccgggtcaaactccgagatcaaacaattcgcttgcacccggtttaaagcagagttccctatatttgataaggttgacgtgaatggaccaagcacagcgccgatctacgagttcttgaaatcaaacgcaggaggattcttgggtggtctcattaaatggaactttgagaagttcttgattgataaaaagggaaaggtcgttgagaggtaccctcccaccacatcccctttccaaatcgagaaagacatccagaagttgcttgccgcttaaaaacttttgctcatgagtgagcatatagagactgatggttaaa

SEQ ID NO: 398 - DNA, 616 bp, Arabidopsis thaliana
ctcacacgcgctaaaccataacccgatattactaatgacgaactacggtgcgattccgacgtcgtctcatgcatctccgttggtggatgtcgagtctctctcacgcgctaaacaccgtatcaaagccgggctagccacgcgccgtgcttggagagtgatgttcgatttccactccatgggactgcctcacggtgtctccgatgcgttcacaagaatcaagaccaatcttgcttacttccgtatgaactacgcaatcgttgtcttgatcgttatcttcttcagcttgatctggcatccgacatcgctcatcgtcttcaccgtcttggtcgttgtttggatctttctgtattttctccgtgatgagcctatcaagctgttccggtttcagatcgatgatcggacggtcttgattgttttatcggtgttaaccgtcgttttactcctgttgaccaacgcgacgtttaatattgttggagcgcttgtgaccggagctgtgttggttttgatccattcggtggttaggaagacggaggatcttttcttggatgaagaagcggcgacgactgagacttctgggctgacgtcatacccgtcgacttaaatcgtttcatcttaa

SEQ ID NO: 399 - DNA, 1423 bp, Arabidopsis thaliana
tcgaaatcgtcacactttgttgcgtgtcgtcttctctctctcataattcttgagtttcacgtctcaagatttgatcacttctgccaattttccagattgatctctctaattatggcttccatgagtttcgccttgaatcgcttctctggactctcctctaaaaccaccttatcagctgacttcgatccatcctctcgccggagttttctaccgccgactagagttggacttaagatctcttccgccgccgaatcggagcctgatctcagtgtcactgtaaatggcctgaaaatgcccaatcctttcgtgatcgggtcgggtccaccgggtaccaactacaccgtcatgaagagagcctttgatgaaggttggggggccgtcatcgccaaaaccgtatctttagatgcatccaaagttatcaacgtgacacctagatatgctcggctacgaaccggatccaatggctcagccaaaacagatgtaattgggtggcagaacatagaactcatcagtgacagacctcttgaaaccatgctcaaagagtttgagcggttgaaaaaagagtatcctgatcggattctgattgcttcagtcatggaggaatataacaaaactgcttgggaagagcttatcgaccgtgttgagcaaactggtgttgatgctttagaaatcaacttctcgtgtcctcatggtatgccagagcgcagaatgggtgccgctgttggacaagattgtgcgcttctcgacgaggtttgcggatggattaatgctaaagctacagttcctgtatgggctaagatgactcctaatattactgacataactgagcctgctagggtgtcactaaaatccggatgtgaaggaattgcagcgatcaatacaatcatgagtgtaatgggaattgatatgaagacgttgcgtcctgagccatgcgttgaaggttactccactccagggggatactcttataaggccgttcgcccaattgcactggcaaaagttatgaacattgccaaaatgatgaaatctgagtttagtgaggatcgctcgctttcgggtattggaggagttgaaactggctatgatgccgctgaattcattctccttggatcaaatactgtacaggtatgcaccggtgtgatgatgcacggctatggtcatgtgaaaaccctttgcgctgagctgaaagatttcatgaaacaacacaacttctctacaatagaagagttcagagggcattcgctgcagtactttacaacacacacagatttagttaagagacagaaagaagcagttgagcagagaaaagctgagaagagaggcttgaaatctgataaagattggaccggggatgggttcgtgaaggagactgagagtatggtttctaactaagttagtagcctgatgaagttatgaccaccca

SEQ ID NO: 400 - DNA, 1261 bp, Arabidopsis thaliana
ccttcaacgaattagcatcctgcgcaagaatgtctattgcatcatcacttacttcagccacactttgcggcgcctcagtttttcctaaagcattagcctgcagctctgagttccctatcaatcttcccagcccttttgaaagttcaaagatttgtttgacttcgtttcctgcctctagggatctcaagaaaaatgctactttgaatctgactcgaaatgttggtccagtcaggtgtcatgctatgcaagctgggacgagggagttgaagaaatttgaacttagtgatgtgattgaagggaaacagtttgatagagagatgctaagcgctatattcgatgttgcacgcgaaatggaaaagatagaaaagagctcttcacaaagtgaaatcctcaagggttatttaatggctaccctcttttatgagccttctacccgtaccaggctttcatttgaatctgctatgaaacgccttggaggtgaagtcttaactactgagaacgctagagagttttcgtctgccgcgaaaggggaaacacttgaagacacaataagaacagtggagggttattcagatataattgtgatgcgacattttgaaagcggtgctgcaagaaaagctgcagctactgccaatatacctgtcattaatgcaggtgatggtcctggagagcatcctactcaggctctattggacgtctataccatccaaagtgaaattggaaaattagatggcatcagtgtagccttagttggagaccttgccaacggaaggactgtgcggtctcttgcatacttgcttgccaagttcaaagacgtgaagatctactttgtttcccctgaaattgtgaaaatgaaggatgatataaaagactatttgacatcaagcggggttgaatgggaagaaagttcagatttaatggaagtagcatccaagtgtgatgtagtttatcaaacacgaatccaaagagagaggtttggagaaaggctggacctttacgaagcagctcgtgggaagtatatcgtagacaaggatctgttaggagtgatgcagaaaaaagctattatcatgcatcctttaccgagattggatgaaatcaccgcagatgttgatgctgatccaagagctgcctacttcagacaagcaaagaacggtttgttcattagaatggctcttctaaagctactgcttgtcggttggtgattggatagttcatggtcgttaagttaaatcctttaatggactgattctcaagcctacca

SEQ ID NO: 401 - DNA, 1719 bp, Arabidopsis thaliana
aagaatcgtggagatggcttcgaccccgaagcttaccagtacaatttcatcatcttctccatctcttcaattcctctgcaaaaaactcccaatcgcaattcatctaccatcatcttcttcctctagctttctctcgcttcctaaaaccctaacctctctctattctctccgtccccgtatcgccctactctcaaaccaccgctattaccactctcgccggttttctgtttgtgccagtaccgataatggagctgaatcagaccgccactacgattttgatctcttcactatcggtgccggaagcggcggcgtccgcgcctctcgcttcgccactagcttcggtgcatccgccgccgtttgcgagcttcctttttccactatctcttccgatactgctggaggcgttggaggaacgtgtgtattgagaggatgtgtaccaaagaagttacttgtgtatgcatccaaatacagtcatgagtttgaagacagtcatggatttggttggaagtatgagactgagccttctcatgattggactactttgattgctaacaagaatgctgagttacagcggttgactggtatttataagaatatactgagcaaagctaatgtcaagttgattgaaggtcgtggaaaggttatagacccacacactgttgatgtagatgggaaaatctatactacgaggaatattctgattgcagttggtggacgtcctttcattcctgacattccaggaaaagagtttgctattgattctgatgccgcgcttgatttgccttccaagcctaagaaaattgcaatagttggtggtggctacatagccctggagtttgcggggatcttcaatggtcttaactgtgaagttcatgtatttataaggcaaaagaaggtgctgaggggatttgatgaagatgtcagggatttcgttggagagcagatgtctttaagaggtattgagtttcacactgaagaatcccctgaagccatcatcaaagctggagatggctcgttctctctgaagaccagcaagggaactgttgagggattttcgcatgttatgtttgcaactggtcgcaagcccaacacaaagaacttagggttggagaatgttggcgttaaaatggcgaaaaatggagcaatagaggttgacgaatattcacagacatctgttccatccatctgggctgttggggatgttactgaccgaatcaatttgactccagttgctttgatggagggaggtgcattggctaaaactttgtttcaaaatgagccaacaaagcctgattatagagctgttccctgcgccgttttctcccagccacctattggaacagttggtctaactgaagagcaggccatagaacaatatggtgatgtggatgtttacacatcgaactttaggccattaaaggctaccctttcaggacttccagaccgagtatttatgaaactcattgtctgtgcaaacaccaataaagttctcggtgttcacatgtgtggagaagattcaccagaaatcatccagggatttggggttgcagttaaagctggtttaactaaggccgactttgatgctacagtgggtgttcaccccacagcagctgaggagtttgtcactatgagggctccaaccaggaaattccgcaaagactcctctgagggaaaggcaagtcctgaagctaaaacagctgctggggtgtagagaagtga

SEQ ID NO: 402 - DNA, 1583 bp, Arabidopsis thaliana
ggaaaatggagtgtgttggggctaggaatttcgcagcaatggcggtttcaacatttccgtcatggagttgtcgaaggaaatttccagtggttaagagatacagctataggaatattcgtttcggtttgtgtagtgtcagagctagcggcggcggaagttccggtagtgagagttgtgtagcggtgagagaagatttcgctgacgaagaagattttgtgaaagctggtggttctgagattctatttgttcaaatgcagcagaacaaagatatggatgaacagtctaagcttgttgataagttgcctcctatatcaattggtgatggtgctttggatctagtggttattggttgtggtcctgctggtttagccttggctgcagaatcagctaagcttggattaaaagttggactcattggtccagatcttccttttactaacaattacggtgtttgggaagatgaattcaatgatcttgggctgcaaaaatgtattgagcatgtttggagagagactattgtgtatctggatgatgacaagcctattaccattggccgtgcttatggaagagttagtcgacgtttgctccatgaggagcttttgaggaggtgtgtcgagtcaggtgtctcgtaccttagctcgaaagttgacagcataacagaagcttctgatggccttagacttgttgcttgtgacgacaataacgtcattccctgcaggcttgccactgttgcttctggagcagcttcgggaaagctcttgcaatacgaagttggtggacctagagtctgtgtgcaaactgcatacggcgtggaggttgaggtggaaaatagtccatatgatccagatcaaatggttttcatggattacagagattatactaacgagaaagttcggagcttagaagctgagtatccaacgtttctgtacgccatgcctatgacaaagtcaagactcttcttcgaggagacatgtttggcctcaaaagatgtcatgccctttgatttgctaaaaacgaagctcatgttaagattagatacactcggaattcgaattctaaagacttacgaagaggagtggtcctatatcccagttggtggttccttgccaaacaccgaacaaaagaatctcgcctttggtgctgccgctagcatggtacatcccgcaacaggctattcagttgtgagatctttgtctgaagctccaaaatatgcatcagtcatcgcagagatactaagagaagagactaccaaacagatcaacagtaatatttcaagacaagcttgggatactttatggccaccagaaaggaaaagacagagagcattctttctctttggtcttgcactcatagttcaattcgataccgaaggcattagaagcttcttccgtactttcttccgccttccaaaatggatgtggcaagggtttctaggatcaacattaacatcaggagatctcgttctctttgctttatacatgttcgtcatttcaccaaacaatttgagaaaaggtctcatcaatcatctcatctctgatccaaccggagcaaccatgataaaaacctatctcaaagtatgatga

SEQ ID NO: 403 - DNA, 1148 bp, Brassica juncea
ttcctctgcaatggcgagtgctttgaatgctgctgtctctctcacttctccgaaatcatctgctcttccagctacaagctgtgccattgctcctgaaaggatcaggtttggtaagggtgctttttactataaaagcaacaatgtagtgacaagctgcagaagagtggtttcggtaagagctgaagtcacaacagatactcctcctgtgaagaaagtagaaaaagagtctaagaagaacgaggaaggtgtgatcaccaacaagtacagaccaaaagagccttacaccggcaaagtccttctcaacaccaagatcacagctgatgatgcccctggagagacctggcacatggttttcagccatcaaggtgaaataccgtacagagagggccaatctgttggtgtgattgcagatgggattgacaagaatgggaagcctcacaaggtcaggctttactccattgcaagcagcgctcttggagacctcggcaactctgaaaccgtttctttgtgcgtgaaaaggcttgtttatactaatgacgcaggagaggttgttaaaggagtttgctcaaatttcttgtgtgacttgaaaccagggagtgatgttaagctcactggtcctgtagggaaagagatgcttatgcctaaggatccgaacgccactgtcattatgcttgccacagggacaggaatagctcctttcaggtctttcttgtggaagatgttcttcgagaaacatgatgactacaagtttaatggcttagcgtggctgttcttgggcgtaccaaccactagttcattgctctacacagaggagtttgataagatgaaagcaaaggcacctgagaatttcagggttgattacgctataagcagagaagaaactaacgataaaggagagaaaatgtatatccagaccagaatggcgcagtacgcaccagagttatgggagttgttgaagaaagacaacacatttgtctacatgtgtgggctcaagggcatggagaaaggaattgatgacattatggtctcattagctgctaatgacggtattgactggtttgattataagaagcagttgaagaaggcagagcaatggaacgttgaagtctactgatttaacattcagtggcaagtatagtggagcaaca

SEQ ID NO: 404 - DNA, 2261 bp, Hordeum vulgare
ctcggctcacacgccaccggcgatggcctcccgcctcctccgcctgcaccaccagctccggcgccggcgccaccacggcacgagccccgtcccctgcaggctcctctcctcctcctccgccacggagccgccgccgccgccccagacggtggagaaggtgctggtggccaaccggggcgagatcgcgtgccgggtcatgcggacggcgcgccggctcgggatcgccaccgtcgccgtctacagcgacgccgaccgcgccgcgctgcacgtgcgcgccgccgacgaggccgtccggctcggcccgccccccgcgcgggagagctacctcaacgccgccgccatcgtcgacgccgccctccgcaccggtgcgaaggcgatccaccctggatatgggtttctttcagagagcgcagattttgcacagctctgtgaatccgaggggctaacatttattgggcctccgccatctgcaatccgagatatgggtgataagagcgcctcaaagaggatcatgggtgctgctggtgtaccgcttgttccaggctaccatggggctgaccaagacattgagttgttaaaacttgaagctgataagattggatatccagttttgattaaacccacccacggtggaggcggcaaggggatgagaatagttcaagggcctgatgactttgtggattctgtacggagtgctcaacgtgaagctgcagcatcatttggtatagacacactgttgattgagaagtatattactcaacccagacatatagaagtccaggtatttggtgacaaacatggaaatgctattcacctttacgagagagactgcagcctacaaagaaggcatcagaagatcatcgaggaagcaccagctccaaatgtgacaactgagtttcggactcatattggtgaagctgctgtgtcggctgcgaaggcagttggttactacagtgctggaacagtggagtttatcgtggatactctttcaggagaattctatttcatggagatgaatactcgactccaggttgaacacccagtaacagagatggtcgttggtcaagatcttgtggagtggcaaatacgtgttgcaaatggagagcgcctgccattatcccaggagcaagtcccattaaatggacatgcatttgaagcccgaatatacgctgaaaatgttccaagaggatttcttcctgcaacaggaaccttacatcactatcaaccagtcctgtcttccccaacagtaagagttgaaactggagttgaagaaggagatgctgtcagtatgcattatgatcccatgatagccaaacttgtagtttggggtgaaagtcgcaatgctgcactagtcaagctaaagaactgtttgtcaaactttcagattgcaggtttgcctacaaatgttgctttccttcaagaactcgcaggccataatgcctttgaaagaggcctagttgatacacatttcattgagcggtacaaagatgattttcaaagcacttctgctaaggcctcgggtgaagcacatgatgcagctaagcttggtgcaattttggctgctgcctgcatttgtaaaaaggatcacagtacctctgaagaatcccttcgtgacaagacactttcggtatggtatacccgtccacctttcaggatgcatcactccgcgaagcgtttgatggaatttgagttagatgaagaacttgaggagttgagtgatgagcttcttaaattattggttacgtataaatctgatggaggctacttcattgagactgaagatggctcttctcctggttttgatgtcaaagtagatggtaggagtgaaaatgattttcgggttgaagttggtggtgtgcaaacagacgtgacattagcattttattcaaaggataatagcaaacatatacacatctggcatgggaagcatcaccatcattacaggcagaccgtgagagctgagcatttgcttgatgacagttctcagccaaggcaggcttccgagggaaggtcacatccaaaaggaagtgttttggcaccaatggctggtttggtcgttaaggttttgcttaaggatggggtacatgtggaagatggtcagcctgtcatggttatcgaagcaatgaagatggagcatgtcgtgaaggcgcctcgggcaggttatatagaagggctgaaggctaccgctggacaacaagtttttgactccagtgtccttttcactgtcaaggataagagcacaaactgatgaaccaagaaat

SEQ ID NO: 405 - DNA, 1530 bp, Hordeum vulgare
aggcctacgtgctggtgtaggccgacacgacccgctgacccgtgccgcatccttagccccggttgtgcgaaggatgctggcgtccagggtctgttctaggtccgcgtcgcagtcctcgaccgcctccccgcgtgccttgacttccgcagcggcctcggcggctaggtcccttctgctgcggtccggcatgcaggctacccctggtctctcagagcggccttgccccgggataggcgaggccggtgttcgcaaggccgatgcgccgccgccgtgttcttcttcaggcgattcgcgagaagaacatgcttgcagaaggcagacaaatcaaaggcatccggtgtctaatcgagccaagtctgtcggagggaaccgccatgttctttatgcaagttatctttcacagaaccaacaaaactacagatgtttttcggcttcttccgaccaagagaggatagaagctgcaaacaggataatacatgatctgccaaggtgtgtgaaaattgtagaagttgggcctcgagatggactgcagaacgaaaaaaatacagtgccaacacctgtaaagattgagctcataaagagattggcaacctctggattatcagttgttgaggcaacaagttttgtctccccaaaatgggtgccacagctagctgatgcgaaggatgttatggaagtggttcggaatattacaggtgtaaattttcctgtattgactccaaacctcaagggatttgaagcagcagccgcagcaggtgccaaagaagttgcaatatttgcgtcagcttctgaagcattttcaaagtcaaacataaactgttcaattaaacagagccttgttcgctataatgatgttgctcttgcagcaaaaaagcaagaaattcctgtacgagggtatgtttcttgtgtggttggatgcccagtagaaggatcagtaccaccttcaaatgtagcttatgttgccaaagagctttatgacatgggctgctatgaggtttcgcttggtgatacgattggagttggtaccccaggcacagttataccaatgcttgaggcagttatgtccgtcgttcccgtggaaaagcttgctgtccatttccacgacacctacgggcagtctctttcaaacatactcgtctctctccagatgggcgtcagtgtcgtggactcctccgtcgcgggcctcggtggctgcccgtatgcgaagggcgcgtcgggtaatgttgctaccgaggacgtagtgtacatgctaaacgggttggggatcaagacgggtgtagatctgggcaaggtaatggcagccggcgagttcatctgcaagcacctggggcgccagtctgggtccaaggcagctaccgccttgagcaaggtcacagcgagcgcctcaaagctatgaggctgctcttagtgctgttactccgtaacatcataatggcatgtccgtttatcgtatgcagtgaccccctgttgaagaagatacatgtacaataccgaaacccaaaaaagtactccctccgtttaagacgattt

SEQ ID NO: 406 - DNA, 1819 bp, Hordeum vulgare
gagagccatggcgacaaccgcggccctccctttctcctgcgccgccaccctccagaccctgacccgcaccctctccccgcgccgctccatcctcatccaccgccaccgcctccgctctctcgccgcctccccgcggctcccggaccgcccccgcgcccgcctatgccgccccgtctcggcgtccgccgcgcccaacggatcctcctccgcgggggagtacgactacgacctcttcaccatcggcgccgggagcggcggcgtgcgggcctcgcgcttcgcctccaccctctacggcgcccgcgccgccatctgcgagatgcccttctccaccatctccgcggacgacctcgggggcctcgggggaacatgtgtgcttcgcgggtgtgttccaaagaaactgttggtgtatgcatctaagttctctcatgagtttgaagagtctcatggctttgggtggacatacgatactgatccaaagcatgactggagcactctgatagccaacaaaaatacagagctgcaacgcctcgtcggcatttacaaaaatattttgaagaacgcaggagttgatctaattgaaggccgtggaaaggtggtcgatgcacatactgttagtgtggatggcaagctgtacactgccaagaacatacttatagctgttggtggtcgaccatcgatgccagatctcccaggaatagagcatgttatagattctgatgctgcactagatctgccgtcaaaacctgagaaaattgcaatagtgggaggtggatatattgccttggagtttgctggcattttcaatggcttaaaaagtgacgttcatgtgtttattcggcaaccgaaagttttaagagggtttgatgaagaggtcagagatttcattgctgaacagatgtctttgaggggtgtcacatttcatactgaacatagtcctcaagctataaccaaatcaaatgatggtttactatctctgaagacaaacaaagaaactattggtgggttttcacatgtaatgtttgcaacaggtcgtaaaccgaatacgaagaaccttggactagaggaggttggtgtcaaaatggacaaaaagggggctatagtggtcgatgagtattctcgaacctcagtggattcaatttgggctgttggagatgttactgataggatcaacttgactccggttgcactgatggaaggtggagcatttgcgaaaactgtattcggtgatgaacctaccaaaccagagtacagagctgtaccagctgctgttttctcccaaccacccattgggcaagttggccttaccgaggagcaggctattgaagagtatggagatgttgatgtctacttatcaaacttcagacctcttagagccactctttctggattacctgatcgcgtactaatgaagctcattgtgtgtgctaccacgaacaaagttgtaggagtgcatatgtgtggtgatgatgcccctgagataatccagggaattgcaattggtgttaaagctgggttgacaaagcaagattttgatgccactgttggcgttcacccgacatctgcagaggaatttgtcactatgaggagtccaactagaaaagtacgaagaaaaactgcagccgaggcagagtctaaggatgaggtcgtcgctcagaagtagataatgccgttgaccgctgtacatagaagtcattcttgaggacgagtccctgccaccacgcgaaacctgactggaaatacgcagctagacttgtgcacagttgcccgagaaatctgccacaatgattgtatcataacgatgaatgtccacctctgcttt

SEQ ID NO: 407 - DNA, 1845 bp, Lactuca sativa
aacaaatgacgtgaaagttcttcaaaattgaattatttgtaatcctgaaaacttgatttgtgatagaagaatcaatggagtgctttggagctcgaaacatgacggcaacaatggcggtttttacgtgccctagattcacggactgtaatatcaggcacaaattttcgttactgaaacaacgaagatttactaatttatcagcatcgtcttcgttgcgtcaaattaagtgcagcgctaaaagcgaccgttgtgtagtggataaacaagggatttccgtagcagacgaagaagattatgtgaaggccggtggatcggagctgttttttgttcaaatgcagcggactaagtccatggaaagccagtctaaactttccgaaaagctagcacagataccaattggaaattgcatacttgatctggttgtaatcggttgtggccctgctggccttgctcttgctgcagagtcagccaaactagggttgaacgttggactcattggccctgatcttccttttacaaacaattatggtgtttggcaggatgaatttataggtcttggacttgaaggatgcatcgaacattcttggaaagatactcttgtataccttgatgatgatgctgatcccatccgcataggtcgtgcatatggcagagttcatcgtgatttacttcatgaagagttgttaagaaggtgtgtggaatcaggtgtttcatatctaagctccaaagtagaaagaatcactgaagctccaaatggctatagtctcattgaatgcgaaggcaatatcaccattccatgcaggcttgctactgttgcatcaggggcagcttcagggaaatttctggagtatgaacttgggggtccccgtgtttgtgtccaaacagcttatggtatagaggttgaggttgaaaacaacccctatgatccagatctaatggtgttcatggattatagagacttctcaaaacataaaccggaatctttagaagcaaaatatccgactttcctctatgtcatggccatgtctccaacaaaaatattctttgaggaaacttgtctagcttcaagagaagccatgcctttcaatcttctaaagtccaaactcatgtcacgattaaaggcaatgggtatccgaataacaagaacgtacgaagaggaatggtcgtatatccccgtaggtggatcgttacctaatacagaacaaaagaatctcgcatttggtgctgcagctagtatggtgcaccctgccacagggtattcagttgttcgatctttgtcagaagctcctaattatgcagcagtcattgctaagattttaagacaagatcaatctaaagaaatgatttctcttggaaaatacactaacatttcaaaacaagcatgggaaacattgtggccacttgaaaggaaaagacagcgagccttctttctattcggactatcacacatcgtgctaatggatctagagggaacacgtacatttttccgtactttctttcgtttgcccaaatggatgtggtggggatttttggggtcttctttatcttcaacggatttgataatatttgcgctttatatgtttgtgatagcacctcacagcttgagaatggaactggttagacatctactttctgatccgacaggggcaactatggtaaaagcatatctcactatatagatttagattatataaataatacccatatcttgcatatatatataagccttatttatttgttttgtatccttacaacaacatactcgttaattatatgttttttaagtaatgctcacaatatttttttgaccaacttatactgttgtgtggactactttggaatgtg

SEQ ID NO: 408 - DNA, 1000 bp, Zea mays
actgctctcgctttcgctcgccatccgccgtcccgctccgcacaccggccctgcccgatgccttcgcccgccgcggccgcggcggcgcctttccaccgcatcgcatgcgcgcgtcagcacctccctcaaacccgtctcttcttcctcccatcccgcgcgctgctcaaatccggctgcctcaccgtcccggctccgctgcgcgtccacgcgctgaggctgcctccgacggtgccacgggcggcaagccacgacgccgccacgggcgtgagatcgcccacatctggcggccagatgctggtgttcgtcccgccacacccgctcataaagcattgggtctccgtgctgcgcaacgaacagacaccctgcgtcatcttcaagagtgccatggcagagcttggtcggctgctcatatacgaagcatccagagattggttgcctacaatcacaggagagattgagacacctgtagctgtagctagtgtagaatttattgatccaagagagcctgttctggttattccaatactgagagctggtcttgcactagctgaacttgcttcatcagttctgccagccaccaagacttaccacctcggctttcgtagggatgaagaaacgcttcaaccttcaatatacctgaacaacctgccagacaagattccagagggtactcgtgtgctagttgttgacccaatgctggccactggtgggacaatggttgctgctattgacttgttaatcgagtgcggagttactagcaagcagattaaagttatatctgctattgcatcacctcctgccctgcaaaagctcaataacaagttccctgggctccacgtgtacacaggaatgattgatccagaagtaaatgagaaaggttttatagttccaggactgggggatgctggcgacagaagctttgccacataatcagactgcccaatttgattgggtcagtgttcgacctgcgagaatctttgcttgagtttcacagaaacgg

SEQ ID NO: 409 - DNA, 1839 bp, Zea mays
atatagtgagagtgagagcccgaggagggggtggcgcgatggggctctcgggcgcgacgatctcggcgccgctcggctgctgcgtgctgcggtgcggggcagttggcggaggtaaggccctgaaggcggacgcggagaggtggcggcgggcgggatggagccgacgcgttggcggaccgaaggtgaggtgcgtggcgaccgagaagcacgacgagacggcggcggtcggggcggcagtgggcgtggatttcgcggacgaggaggactaccgcaagggcggcggcggcgagctgctctacgtgcaaatgcagtcaaccaagcccatggaaagccagtccaagatcgcttccaagctatcgcccatatctgatgaaaatacagtgcttgatttggttatcattggttgtggtccagctggtctttctctagcttcagagtcggctaagaaaggtctcactgtaggtctcattgggcctgaccttccattcacaaataactatggtgtgtgggaggatgaatttaaagatctcggtctagagagctgtatcgagcatgtctggaaggatactattgtctacctagacaataacaagccgatactgattggccgttcttatggcagggtgcaccgtgacttgctccatgaggagctgctgagaagatgctatgaatctggcgtgacatacctgaactccaaagtggacaagatcatagaatctccagatggacacagagtagtctgttgtgacaagggtcgcgagataatttgcaggcttgccattgttgcttcgggggcagcatctggtaggcttctagagtatgaggttgggggtccccgtgtttgcgtgcagactgcatacggagtagaagttgaggtggaaaataacccatatgatcctagcttaatggttttcatggactacagagattgtttcaaagaggaattctcacacattgaacaagaaaatcccactttcctgtatgctatgcccatgtcatccacacgagttttctttgaggaaacatgcttagcttctaaagatgctatgtcttttgatctacttaagaagaggctgatgtatcggttgaacgcgatgggaattcgtatcctgaaagtttatgaggaggaatggtcctacattcctgttggagggtccttaccaaacacagatcagaaaaaccttgcatttggtgctgcagcaagtatggtgcatcctgcaacagggtactcagtggtcagatctttgtctgaggctccaagatatgcttctgtgatatcggacatcttaggaaatcgagttcctgcagaatatatgctcggaaattcgcaaaattacagtccatcaatgcttgcatggagaacactgtggcctcaagagaggaaacgccaacgatccttcttccttttcggattagcgttgataatccaactgaataatgaaggcatacaaacattcttcgaagcctttttcagggtgccgagatggatgtggcgaggatttcttggctcgaccctttcatccgtcgatctcatactattctcattctacatgtttgcgatagccccaaatcaattgcgaatgaaccttgtcaggcatctcctctctgacccaactggctcatccatgatcaagacctacctgaccttataaaaccatttgcaccaggctgcaagcctgcaagaactcttagaaactgtacagttttgtagttgtacataagttagagaggatctggggggttacttggcggcggatctaggggttagcagcaatgctataatacactgtaaatcttttatggttgctatggtgattggatagagaagcacaccgtgtt

SEQ ID NO: 410 - DNA, 1505 bp, Solanum lycopersicum
actccgtctcaaagggaacagagaaattcatatatttttcggtattccttcttctctttgaatggccggccaaacagtcattgtttccggtttgaatccggcggccattcttcagtccacaatcggtggagctccggtggcagcggcggcggagaacggccatacgagaaaagttgttcctctgtcaaaagatgcccttcaggatttcatggtttcaatcataacacagaaattacaggacgataaacaacccttttatgttctagatttgggtgaagttgtttcccttatggaacaatggaactctgctttaccaaatatccgtccgttttatgctgttaaatgtaaccctgaaccttcatttctctccatgttgtctgctatgggttccaattttgattgtgctagccgtgctgaaattgagtatgttttgtctcatggtatctcgccggaccggattgttttcgctaacccttgtaagccggaatccgatattatcttcgccgagaaaattggggttaatctcactacttacgattccgaggatgaagtttacaagatccgtaaacatcacccaaaatgcgagcttttgcttcgaatcaaacccatgaccgacggcaacgcgagatgcccaatgggtccaaaatacggcgcattaccggaggaaatcgagccgctcctccgtacagctcaagccgctagactcaccgtctccggcgtgtccttccatatcggcagcggagacgccgattccaacgcttatctaggagccatagccgcagcgaaacaggttttcgaaacagcagctcaactcggaatgccaaaaatgacggtactcgacatcggcggcggatttacctccggccaccaattcaccaccgctgctcccgccgttaaatcagctctggaaacccacttccacgacttccctgagctaaccatcatcgctgaaccaggtcgtttcttcgccgaaacagcgttcactttagcaacaaccatcatcggcaaaagagtcagaggtgaattaaaagaatactggatcaacgatgggttatacggatcgatgaactgtgtactttacgaccatgcgacggtgacggcgacgccattagcgtgcatgtcgaatcgtaataacctcaactgcggcgggtcgaaaacgtttccgtcgactgtattcgggcccacctgtgatgcacttgataccgtgttaagggattaccagttaccggagctacaggttaatgactggctgatttttcctaatatgggtgcttatacaaaagctgctggatcaaatttcaatggatttaacacatccgccattgttactcaccttgcttatgcttatccaaactaatgattaattaggctttaattagcatggtcattgtaattttttttcttctaattttgttcttgtttggtaatttattttccaatcagcttgtagtttcttttttctttttggtctcataagataagcaaggattagtcaattggatttg

SEQ ID NO: 411 - DNA, 943 bp, Solanum lycopersicum
ggttccctcacagtttcagccatggcttccatgatcgaatctgcttgggcgtttcttcttgcaaattttagtgatttccaattgacttctcttggaggtttcattgttcatgagagcgctttcttcttgtctggaatccctttcatccttttcgaaaaggcagggtggtttggcaagtacaaaattcagaaaaagaccaacaccccggaagctcagcagaaatgtattactcgtctgctgatatttcatttttgtgttaatcttccaatcctgatagttacgtatccgctctttaaattcatggggatgcgatctactcttccattgccatcctggaaagtggtttcaacccaagttttattctatttcatcttggaggatttcgtattttactggggacacagagttttacatacgaaatggctctacaagcacgtccacagtgtccatcatgagtacgcgacaccatttggtttgacatctgagtatgctcaccctgctgaaattctcttccttggatttgctacggtcattggtcctgcaatcaccgggccacatttgataacattatatctatggatctctcttagaatcctcgagacagtcgaggcacattctggataccatttcccctggagcccgtcaaacttcttgccattatatggagggtctgattttcatgattaccatcatcgactgctctacacaaagtctggaaactactcatcgactttcgtttacatggactggttatttggtactgataagggttacagaaagttgaagatgctgaaggagcaagagggcaaagcaatgtaaacaagatgggaaagtagagggggaataaaattacatgtttgtttgagtgtataagaaatagtactgaacagattctattagtaatgatgagattaataacgtaaggattagttatgttggcatt

SEQ ID NO: 412 - DNA, 1665 bp, Solanum lycopersicum
gcaaagaagctaagataaaaggggatatacttgaaaatggagtgtgttggagctcaaaatgttggagcaatggcagtttttacgcgtccgagattgaaaccgttggtcgggaggagagttatgccaagaaaaaagcaatctttttggcgtatgagcagtatgaaagtaaaatgtaatagcagtagtggtagtgacagttgtgtagttgataaagaagattttgctgatgaagaagattatataaaagccggtggttcgcaacttgtatttgttcaaatgcagcagaaaaaagatatggatcagcagtctaagctttctgatgagttacgacaaatatctgctggacaaaccgtactggatttagtggtaatcggctgtggtcctgctggtcttgctcttgccgcggagtcagctaaattggggttgaacgtggggctcgttgggcctgatcttcctttcacaaacaactatggtgtatgggaggacgagttcaaagatcttggtcttcaagcctgcattgaacatgtttggcgggataccattgtatatcttgatgatgatgaacctattcttattggccgtgcctatggaagagttagtcgccattttctgcacgaggagttactcaaaaggtgtgtggaggcaggtgttttgtatctaaactcgaaagtggataggattgttgaggccacaaatggccagagtcttgtagagtgcgagggtgatgttgtgattccctgcaggtttgtgactgttgcatcgggggcagcctcggggaaattcttgcagtatgagttgggaggtcctagagtttctgttcaaacagcttatggagtggaagttgaggttgataacaatccatttgacccgagcctgatggttttcatggattatagagattatgtcagacacgacgctcaatctttagaagctaaatatccaacatttctttatgccatgcccatgtctccaacacgagtctttttcgaggaaacttgtttggcttcaaaagatgcaatgccattcgatctgttaaagaaaaaactgatgctacgattgaacacccttggtgtaagaattaaagaaatttacgaggaggaatggtcttacataccggttggtggatctttgccaaatacagaacaaaaaacacttgcatttggtgctgctgctagcatggttcatccagccacaggttattcagtcgtcagatcactttctgaagctccaaaatgcgcctctgtacttgcaaatatattacgacaacattatagcaagaacatgcttaccagttcaagtatcccgagtatatcaactcaagcttggaacactctttggccacaagaacgaaaacgacaaagatcgtttttcctatttggactggctctgatattgcagctggatattgaggggataaggtcatttttccgcgcattcttccgtgtgccaaaatggatgtggcagggatttcttggttcaagtctttcttcagcagacctcatgttatttgccttctacatgtttattattgcaccaaatgacatgagaaaaggcttgatcagacatcttttatctgatcctactggtgcaacattgataagaacttatcttacattttagagtaaactcctcctacaataattgttgaatcagaggcctcattac

SEQ ID NO: 413 - DNA, 968 bp, Arabidopsis thaliana
ttgaaatggacggtgtcacctaccaaagattcccaacggtgaagatccgtgagcttaaagatgactacgccaagttcgagcttcgtgaaaccgacgtttcaatggccaacgctctccgtcgcgtaatgatctccgaagtccccaccatggcaatccatctcgtcaaaatcgaggttaattcctctgttctcaacgacgagttcattgctcaacgacttagtctcatccctctcactagcgagcgtgctatgagcatgcggttctgtcaagattgtgaagattgtaatggagatgaacattgcgagttctgctctgttgagtttccccttagtgctaagtgtgttactgaccaaaccctagatgttactagtagggatctctacagtgctgatcctactgttactcctgttgatttcactagtaactcatctacttctgattcaagcgagcacaagggaattatcattgcgaaactacgcaggggacaagagttgaagcttaaagcattagctaggaaaggaattgggaaagatcatgcgaaatggtctcctgcagctactgttacgtatatgtatgagcctgacattattatcaatgaagagatgatgaacactttgacagatgaggaaaaaattgacttgattgagagcagtcctaccaaagtgtttggcattgacccagtcaccggacaggttgtggtggttgatcctgaagcatacacttacgatgaagaagtgatcaagaaagctgaagcaatggggaaaccgggactcattgagatccatccgaaacatgatagttttgtattcactgttgagtccacaggtgcattgaaggcttctcagctggtactaaatgccattgatatcctgaagcagaagcttgatgcaatccgtctctcagataacactgtagaagccgatgatcagtttggtgaactcggtgcccatatgcgtgaaggatgatga

SEQ ID NO: 414 - DNA, 968 bp, Arabidopsis thaliana
ttgaaatggacggtgccacataccaaagattcccaaagatcaagatccgtgagcttaaagatgattacgccaagttcgagcttcgtgaaaccgacgtttctatggccaacgctctccgtcgcgtaatgatctccgaagtccctaccgtcgcaatagatctagtcgaaatcgaggttaattcatctgtactcaacgacgagttcattgctcatcgattaggtctcattcctctcactagcgaacgtgctatgagcatgcgtttctctcgagattgtgatgcttgtgatggagatggacaatgcgagttttgctctgttgagtttcggcttagttctaagtgtgttactgatcaaaccctagatgttactagtagggatttgtacagtgctgatcctactgttactcctgtggatttcactattgactcgtctgtatctgattcaagcgagcacaagggaattatcattgtgaaactgcgtcggggacaagagttgaagcttagagcgatagcgaggaaagggattgggaaagatcatgcgaaatggtctcctgcagctactgttacgtttatgtatgagcctgacataattattaatgaagatatgatggatactttgtcagacgaggaaaagatcgacttgattgagagcagtcctaccaaagtgtttggcatggatccagtcaccagacaggttgtagtggttgatcctgaagcatacacttacgatgaagaagtgatcaagaaagctgaagcaatggggaaaccgggactcattgagatcagtccgaaagatgacagttttatattcactgttgagtccacaggtgcagtgaaggcttcccaactggtactaaatgccattgatcttctgaagcagaagcttgatgcagtccgtctctcagatgacaccgtagaagcggatgatcagtttggtgaactcggtgcccatatgcgtggaggatgatga

SEQ ID NO: 415 - DNA, 971 bp, Helianthus annuus
agaaaatggacggagcatcataccagaggttcccaaaggtcaaaatccgcgagctaaaagacgactacgcgaaattcgagctccgagaaaccgacgcaagcatggcgaacgcactccggcgagtgatgatcgcagaggttccgacaatcgcgatcgatctggtcgaaatcgaggtgaactcatcggttctgaacgacgagttcattgcgcatcgtctcggcctcattcctctgacaagcgagcgtgcgatgagcatgcgcttctcacgtgactgcgatgcctgtgacggtgacggccagtgcgagttttgttctgtggagtttcatttgagagctaagtgtattaatgatcagacgcttgatgttacgagtaaggatctctatagctctgatcatactgttgtgcctgttgatttctctgatgctacttctggttttgagaatcctgaagatcaaaggggcatcaccattgtgaaacttcgcaaaggacaagaactgaggctaagagcaatagctagaaagggtatcggaaaagatcatgcaaaatggtcacctgctgcaactgtgactttcatgtacgagcctgagattcacatcaatgaagaaatgatggagacgttatcacttgaagagaaaacaagtgttattgagagcagcccgacgaaagtctttgccttaaatccccatactcagcaggtggaagtggtggatcccgaggcatacacatatgacgatgaagtgctgaagaaagtggaagctatggggaaaccagggcttattgaaatctatgcaaaagaagacagcttcatcttcacggttgaatcaactggtgcagtcaaggcttctcagttggtgattaatgccattgatgtcttgaaacagaagctggatgcggttcgcttgttggaagatactgtcgaagcagatgatcagtttggggaattaggtgctcatatgcgtggaggttgatga

SEQ ID NO: 416 - DNA, 1088 bp, Solanum lycopersicum
aaccctcaatactcaaagcaagcaacaatggagggcgtttcgtaccagagattcccaaagataaaagtacgtgaagttaaagacgatttcatgaaattcgagctccgggacaccgacgccagtatagctaacgctctccggcgtataatgatagctgaagtacctactatagctatagacctagttgaaatcgaggtcaattcctctgttctcaacgatgagttcatttctcatcgtttagggcttgtgccgctaacaagtgaacgagcgatgagtatgcgtttctcacgtgactgtgatgcttgtgatggtgatggacaatgtgagtactgttcggttgagttttatctacgggtgaaatgtcttagtgaccagacgcttgatgttactagcaaggatttgttgagttctgaccatacggttgttcctgttgattactccgatgcttcctcgagttttgataatactcctaataagggaatcataattgtgaagctacgacgtggacaggagttaaggttaagagctatagcacggaaaggaattggcaaagatcacgcgaaatggtcacctgcagcaactgtgactttcatgtatgaaccagagatctatatcaatgaggacatgatggaatccttgactctcgaggagaaaacagaattagttgagagtagtcccacaaaagtctttggcattgaccccgagaacaaacaggttattgtcgttgatcctgaggcatatacttacgatgatgaggtgctcaagaaggctgaagccatgggaaaacctggagttgtagagatacatgccaaggaagatagttttattttcacagttgaaacaactggcgcagtcaaatcttcacaattggtgctcaatgcaatagaagtgcttaagcagaagttggatgcagtacgcctttcagatgacaccgttgaagcagacgatcagtttggagagctgggcgctcatatgcgtggaggttaaaaaccgcgaaaactgttcatgtttaatatatctcctgtaacaagacatccttaaactaacttacccattttccctttagcaacttacctcgactgatgatg

SEQ ID NO: 417 - DNA, 972 bp, Brassica napus
ctcttggtgtgatccatgggcgcgaatatctcaggcgttacgccggagtttgaccggagcagtgaacccagattatccgatttgccggagaactgtgtagcgctgatcatgatgcggcttgacccgccggagatttgtcggctcgctcgtctcagcagggtcttccgtcgcgcgtcgtcagctgatttcgtgtgggagtcgaagctgcctccgagttaccgagctattgcgcggaaggtgttcgacgaaattactctgaggaagttgttgataaagaaggatctttacgcgaagctctgtaggcccaatctcttcgagggtggcacaaaggagctgtggattgataagaacactggtcgtctctgtgtatcggtttcttcaaaggcgttaaggattactggaattgatgatcggagatactggagtcatatcccaaccgatgaatccaggttccactcagttgcgtatgttcaacagatatggtggttcgaagtaggaggagagtttgagatccagtttccatccggaacatacagtctcttcttccgcatccagctcgggaaaacatcaaagagacttggacggagaatctgcaactccgaccacatccacggatgggacattaaacctgttaggttccagctcgcaacttcagacaaccaacaagctgtttcgctgcgttatctgaacaacaaccctggacactggagtcactatcacgtcggggatttcaaagtggtaaatccagatgtatcaacaggagtcaagttctcgatgactcaaattgattgcactcacacgaaaggtggcttgtgcatagactctgttcttatagtacctaaagaaaatgcaagaaaggtcgttgaatcagaatagttatttttttgtgtagatatagagtgagattgttgtaaatggtgagaataatcttttttttttcatattgatctggaacttgtacacatggtttgg

SEQ ID NO: 418 - DNA, 1867 bp, Arabidopsis thaliana
acccaaccgcttaaacctctctctctctctttctctctaatttctaatggtacttcttccttcgatgacgtcgcttcttctggtgttcctcttcctctacggcgtttctccggttatctccgacggctccgatcaccgttacaaggtcggtgatgatgttcctctttacgctaacaaagtcggaccgtttcataatcccagtgaaacatatcgatactttgatcttccgttctgttcatcagctcctgttaaggagaagaaggaggctctaggggaagttcttaatggagatcgattagtcagtgcaccttacaaacttgagtttttgggtgagaagaactctgaagttgcatgtagaaagaggttgagtagagaagacgttgctaagtttcgtgatgtgattgcgaaagattattactttcagatgtattatgatgacttgcccatttggggattccttggaaaagttgtcaaggagggaaagactgacccatctgagtataaatattatctcttcaatcatctgcagtttgagattttctataataaggaccgtgttatcgaaattatcgtgaggacagaccagaatttccttgtggacttgactgaggacaaggaagtccaagtggatttcacatacacagttcgatggaaggaaactgaaattccattcgagaagaggatggagaaatactcactggcttcatcaatgccacatcacttggaaatccactggttctccatcattaattcatgtgtcacagttcttctcttgactggtttccttgcgacgattctcatgcgagtcttgaagaatgattttgtcaagtatgcacatgatgaagaggcagttgatgaccaagaagagactgggtggaaattgatccatggtgatgtatttaggttccccaaacacaaatccctgctggctgcagcccttggttctggcacacaattgtttacactagctgttttcatcttcatgcttgcattagtcggtgtcttttatccctacaaccgtggagcattgtttactgcattagtggtcatatatgctcttacttcagggattgccggatatactgctgcttctttctattgccagctagaaggaactaactgggttaggaatgttatactgactggaagcctcttctgtggacctcttttgatcacgttctccttccttaatactgttgcgattgcttaccaagccactgcagcgttgccatttgggacaattgtggttattttccttatatgggctctggttacttcaccattgttaatattaggaggtattgctgggaagaacagaaaatccgagtttcaagctccttgtcgtaccacaaaatatccaagagagatcccaccaatgcgttggtaccggagaacacttccgcagatggctatggctggttttttaccgttcagtgccatttacatcgagctttactacatatttgccagtgtttggggtcacagaatatacaccatctatagtattctgtctatcgtcttccttattctcgttatagtcactgcttttatcacggttgcattaacgtacttccaacttgctgctgaagaccatgagtggtggtggagatcattgctatgcggtggatcaacgggcttattcatatatgcctactgcttgtattactactatgcacgatcagatatgtcagggttcatgcagacttccttcttctttggctacatggcttgcatctgctacggattcttcctcatgctcgggacaatcggattctgtgcttcccttctctttgttcgtcacatttaccgctcaatcaagtgcgagtaaaacttgaagattcttcactccctcaactactagcgatgg

SEQ ID NO: 419 - DNA, 543 bp, Brassica juncea
aaaggatccattcctatggctgctgcttcactttctgcgaatcaaggtttactaggaacttccttctatggaggttgggggagttcaatctccggcgaggattaccacaccatgctcgccaagacaactgcgccacggcaaaactttgctaaactctcacggaaacccatcagagtacagccaatgatgaagaatgtcaacgaaggcaaaggcttgttcgctcctctagtcgttgtcaccaggaacatagtaggcaagaagaggttcaatcagcttagaggcaaagccattgctttacactctcaggtgattacagagttctgcaaatcgataggagctgatgcaaagcagagacaaggattgattaggcttgctaagaagaatggagagaggcttggcttcctcgcttgagatccctccctcttcttctcgtctctgtatacaatcatcttcttcttcttcttgtctcctgtctagatgtattttttccaaacctctttgaaaacataaactgccattctcattctcaaagttctcgagttt

SEQ ID NO: 420 - DNA, 2826 bp, Arabidopsis thaliana
ttcattactctgtttcgccataagaaagagaataaagaaacgttatggagaggccaagagcccctccatctcctttgaatgatgcggagtcattaagtgaacgtagatctcttgagattttcaacccttcgagtggaaaagagacacatggatcaacttcttcttcttcaaagcctcctcttgatggcaacaacaaaggtagtagtagtaagtggatggagtttcaagattccgctaagattacagaaagaaccgctgaatggggattgtcagctgttaagccggattcgggagacgatggcattagtttcaagctgtccagtgaagtggaacgaagcaagaacatgtctaggaggtcatccgaagaatctacatcttctgaatcaggggccttccctagagtatcccaggagctcaaaactgctctatccacgttgcagcagacttttgttgtctctgacgctacacagcctcactgtcccatagtctatgccagcagtggattctttaccatgactggttattcttccaaggaaattgttggaagaaactgccggtttctgcaagggccagacaccgacaagaatgaggttgccaaaatcagagattgtgtcaagaatggaaaaagttactgtggaaggctgttaaactacaaaaaggacggaactcccttctggaatcttctcacagtcactcctatcaaggacgaccagggcaataccatcaagttcattgggatgcaggttgaagttagcaaatacacagaaggggtaaatgataaagcattgaggcctaatggactctccaaatccttgattcgatatgatgctcgccagaaggagaaagctttggattccatcacagaggttgtgcaaactataagacatcgtaagtctcaagttcaggaatccgtgagcaatgacactatggtaaagcctgatagttctactacacctacacctggtagacaaacaagacagtcagatgaggcttcaaagtctttcaggacacctggacgtgtttctactccaacggggtcaaagctcaaaagctcgaataacaggcatgaagatcttttacgtatggaacccgaagaattgatgttgagcacagaagtaatagggcagagggacagttgggacctatcggatagagaaagggatatacgccaagggattgatctagctaccactcttgagcgcatagagaagaatttcgtcatcagtgatcctcgtctccctgataatcccattatctttgcatcagacagctttcttgaattgacagagtattcacgcgaggaaatattggggagaaattgtcggtttcttcaggggccagagacagatcaagcgactgtccagaagataagagacgcaattagagatcagagggagattactgtgcagttgataaactacactaaaagcggaaagaaattctggaacttattccacttgcaacctatgcgtgatcagaagggagagcttcaatacttcatcggtgtgcagcttgatggaagtgatcatgtagagcccctccaaaatcgtttgtctgagagaacagagatgcagagttcgaaattggtgaaagctacggcaacaaatgtagatgaagctgtcagagagcttccagatgctaatacgcggcccgaagacctgtgggctgcacactcgaagcctgtctatcctctgcctcacaataaggagagtacgtcctggaaagcaataaaaaagatccaagcgagtggagaaacagtgggactacatcatttcaaaccaataaaaccgttgggctctggtgatactggcagtgtccatttggttgagctgaagggcacgggtgaactatatgccatgaaagcaatggagaaaacaatgatgttgaatcgtaacaaggctcaccgagcgtgcatcgaaagggaaatcatttcccttctggatcatccattccttcctactctctacgcttcttttcagacctctacgcacgtctgtttgattacagacttctgcccaggtggagagttgtttgcactacttgacagacaacctatgaaaatattgacagaagactctgcaaggttctatgcagcagaggttgttatcggcttagaatatcttcactgcttaggaattgtatatcgagacctgaagcctgagaatatactgctcaagaaggatggacacatagtattggctgactttgatttatcattcatgacgacctgcacaccccagcttattattccagctgcacctagcaaacgaaggagatccaaaagtcaaccactacccacatttgttgcagaaccaagtacccagtcaaactcgttcgtaggaactgaagaatacattgcgcctgagataatcacgggtgctggtcatacaagtgctattgattggtgggcactgggtatcttgttgtatgagatgctttatggtcgcacacctttcaggggtaagaataggcaaaagacatttgccaacatcttgcacaaagatctcactttccccagcagtatccctgtgagtcttgtaggtagacagttgatcaacacgttgttaaatagagatccgagcagtcggttaggatccaaaggtggggcaaatgagataaagcagcatgctttctttcgcgggatcaattggcctctcatacgaggcatgagtcctccaccactggatgcaccgttgagcataatcgaaaaagatccgaatgccaaagatataaagtgggaagatgatggagtgcttgtgaattctacggacttggacattgacctcttctaatcctattcttcctctctctgcctttgattctcaa

SEQ ID NO: 421 - DNA, 798 bp, Gossypium hirsutum
tccacaatgcttttgagaccagtttcatctttgtgtgtgcaagccaagcaaggggataatctaatttgttcccttaagggctcccctgtaacatcatcatcatcatctgctctgagttttcttcccagaaaacatggaagggctttgggtgtttatgcatccataggaaccaacaatcatgcacttacaggggtagtgttccagccttttgaagaggtgaaaaaggaggaacttgatatcccaatcgctcctcatctttcgctggctcgccagaaatttgctgatgcctgtgaagccgccatcaatgagcaaatcaatgtggaatacaacgtttcctatgtgtaccactcgttgtatgcttacttcgacagagacaacgttgcgctcaaaggctttgccaaattcttcaaggaatcaagtgaagaagaaagagagcatgcggagaagctgatggaatatcagaacaaacgaggaggaagagtaaaactacactctattctgatgcccccttcagagtttgatcatgctgagaagggagatgcactatacggtatggaattagcattgtccttggagaagctgacaaacgagaagcttttgtgcctgcacaatgtagcggtgcaaaacaatgatgctcagatggccgatttcatcgaaagcgaatatttagctgagcaggttgaagccattaagaagatatcagaatatgtttctcaattaaggcgggttggaaaaggacatggcgtgtggcacttcgatcaaatgctactccacgaaggggcgtgatgctgcccataa

SEQ ID NO: 422 - DNA, 2334 bp, Brassica napus
tgagcaacctctcatcactacactgagaaaccaaagtaaaagattcacaagagtgagctacacagagagagtaacgatggatgatcatgaaagccctcttttgtccaaggagccatcatcgtcatcatcatcatccgtggtggcttcctcgtttaaatggattctgaaagttttaatgtccgtgattttcgttgcatggattgttttcctttttgtgtaccctgggaaactcggcgatggaattcttacaaattggagagctgtttcttccaacactctcttcggcaccacaggaagcatgttcttgattttcagtggtccgattcttgttatctccgtcttagcttctctctatctgatcatctccggagaagagaaggtgttcactaagaagaagatatcgaaattcccaaggttcaggctgtggacatttcctgttcttgtggatgggccatttggagttgtttctgcagctgagtttcttgtaattatgatcttctctgtgttcttcctctgggctatctatgcatataccatgagggatcttgaccttcttgatctcttccatgtgcttcccgaggatagaagtatgcttctgttggagataaccggtctgcgtttcgggatgattggactgttgtgtatggtgtttttgtttcttccaatctcgagaggctccattctcctccgtcttgtcgatatccctttcgagcatgctacaaagtatcacgtttggcttggtcatatcaccatggctttcttctcctttcatggcctttgttatgttgttgcgtggaccgttcaaggtcgacttttagagcttttatttgagtggaaagctattggaatcgcagtgttacctggagttatcagtcttgtagccggtttacttatgtgggttacatcgttacagtacgtgaggaagcattactttgagcttttcttctacacccatcaactctatattgtcttcgttgtcttcttggcgcttcacgtgggtgactacttattcagcatagttgctggaggaattttccttttcattctcgaccgtttcttgaggttctgccaatccagaaggactgtagatgtaatctctgcaaagagttttccctgcgggactctggagctcgtcctttcgaaaccaccgaatatgcgatacaatgcactgagttttgtctttctccaagtaagggaactatcatggctacaatggcatcccttcagtgtttcatcaagccctctagatgggaagcatcatgttgccgttctcataaaggttcttggtggatggactgcaaagcttagggaccagttgtcaaagctatatgaggcagagaaccaagatcagctcctttctcctctgtcatatcccaaaatcacaacttgcgtggagggcccttatggccatgaatctccataccacctggcgtacgagaatctggtcttagtagcaggaggaattgggatttcgccatttttcgccatcttaagtgatatcctacaaagaaaaagagatgggaaagcttgtctaccaaagaaggttttagttatctgggcaatcaaaaactcagacgagctctctctcctctcatcgatcgacattccttccctttgcccttctttctctcagaaaataaaccttgagattaacatctatgtcacaagacaatccgagcctctcttggaagatggaatggttcacaagatggtgaatccttctgtgaagccaaggaacaacgggtgtcccatgtcggtattagttggtacaggggataatatatgggctggactctatctggtatcatccaccatcgggtttgttttaatgatcacattgttggacatcttttacataaacaaattcaacataacggcgtggtggtacaagggacttcttttcgtggtttgtatggttgcaagtgtgttgatttttggaggtcttgttgttgttttctggaatctttggggtgaaaaagccggtgatgtagaaccaaatggccacgacaaggtgactacgaatggaggagaactacataatccatctgcggaacttaaaggccttaacacagaagacgatattcagagtttcatcactactcgttatggcacgagacctgattttaaagagatatttgagtcattgaatgagaaatggggaagtgttgatgttggagttattgtatgcggaccggccagtcttcagtctaccgttgccaaagagatacgttcacatagcatctggcgatccacgaatcatccacttttccacttcaacagccacagcttcgacttgtaactttgctttcaaggctgaagagaattatgtaatca

SEQ ID NO: 423 - DNA, 1846 bp, Brassica napus
tctctctctcctcattttctatcaaagagagagtaagaaaactatggaattaacactgaattcctcgagttctctaatcaaacgtaaagatgccaaaagctcaagaacccaagaaaactcctcaaacatgtcctttgccaaaacgaagccaccaacttatcagttccaggcaaagagctctgtcaaggaaatgaagttcactcatgagaagacctacaagccagaaagtgaaaccactgagaggtgggagaagctccacgttctctcctacccacaccccaagaacgactccagcgttcctgttttcgtcatgttgccgctcgacacggtaacaatgtcagggcacttgaacaaaccaagagccatgaacgctagtttgatggctctaaaaggagccggtgtggaaggtgtaatggttgatgcttggtggggattggttgagaaagatggaccaatgaagtataactgggaaggctatgccgagcttatacagatggttcagaagcacggtctcaagctccaggttgttatgtctttccatcaatgcggaggaaacgttggagactcttgcagtattcctttgcccccatgggtgcttgaagagatcagcaagaaccctgatcttgtctacacagacaaatctgggagaaggaatcctgagtacatctccttgggatgtgactctgtgcctgtcctcagaggaaggacacctatccaggtctactcagatttcatgaggagtttccgtgaaagattcgataattacataggaggtgttattgcggaaattcaagtgggaatgggaccttgtggagaactgagatacccatcataccctgagagcaatgggacatggaggttcccaggaattggagagttccagtgctatgacaagtatatgaaatcgtcgcttcaagcatatgctgaatcaatagggaaaacaaactggggaacaagtggacctcatgacgccggaaagtacaagaacctcccagaagacactgagtttttcaggagagacggaacatggaacagcgagtacggaaagttcttcatggaatggtactccgggaagctactagagcacggagaccagctcctgtcttcagccaaagcaatctttcaaggctccggagctaagctatcaggaaaagtagcagggatccactggcactacaacacaaggtcacacgcagccgagctaaccgcaggttactacaacacaagaaaccacgacgggtatctcccaatagccaagatgttcaacaaacacggcgtcgtgctaaacttcacttgcatggagatgaaagacggcgaacagcccgagcacgcaaactgctctcctgaaggtctagtcaagcaagtgcagaacgcgacgaggcaggctggaaccgagctagcgggggagaacgcattggagagatacgactccagcgcgttcgggcaagtggtcgcgacaaacaggtctgattcggggaacgggttgaccgcgtttacgtacctaaggatgaacaagaggctgttcgagggtcagaactggcagcagctggtggagtttgtgaagaacatgaaggaaggtggacatgggaggagactctctgaggaagacacaacggggagtgacctttatgttggtggatttgtgggaagcaagatctctgagacggttgaggaagccgttctagtgtaaagttcccactccacataggtacatatagtgtgtgtggtatataattataataaacaatagagatgactgagagagagagcaaaccagagtagtagtgttaaaaaaaagctttagaatgttgcacaattctggatctgggcaaagagaagatgatgt

SEQ ID NO: 424 - DNA, 954 bp, Sorghum bicolor
tcaacttcctcggcaagcagaagaggagggagggaggtcctgctcgctcgatccagacgcatccgccgaccgccgtcaccggagtcgccgacaggatgtttctcacgaggacggagtacgaccgcggggtgaacacgttctcgccggaggggcggctgttccaggtcgagtacgccatcgaggccatcaagttgggatccactgcgatcgggttgaagacaaaggatggtgttgttctcgccgtcgagaaacgtgtgacctctccactgctggaaccaagcagtgtggagaaaatcatggaaatcgatgagcacataggctgtgccatgagtggacttattgctgatgctagaacgctagtggagcatgctcgtgttgagactcagaatcataggttctcatatggggagccaatgaccgtagaatcttctacacaagctatctgtgacttggctctgcgctttggcgaaggtgatgaagagtcaatgtcacgaccatttggagtctctctcctaatcgctggacatgatgagaatggacctagcttgtactacactgacccatctggaaccttctggcaatgcaatgcaaaggctattggatcaggctctgaaggagctgatagctccttgcaggagcagtacaacaaggaactgaccctccaggaggcagagaccatagccctttctatcctgaagcaggttatggaagagaaggtgaccccaaacaatgtcgatatcgccaaggttgcccccaagtaccacctctacacccctgccgaggttgaagctgtcattgcgaggctgtaaaacacttcagatttctcgatttcccatcatcaatcacggtcgttgtatgaagcatggacatcttgatgctggcctgtcagcctagtgtgtgttgctatgtttgtcaccatgttctgtcaactccacaagggcagttcatgataga

SEQ ID NO: 425 - DNA, 1272 bp, Arabidopsis thaliana
tcgcaaactcgtttcttcattcgtcttcgtctttcgccatggctgctctacaatacttggaatctctgaaaaatacgcatccagagctcggcgaatggtacaattcccttgcagatctgtatcagaaaaagctctggcatcaactcacccttaagctcgaacagttcatcgctctcgctgtctttcaggctggtgatgctttgattcagttctatcacaatttcatcactgactttgagacgaagatcaatcttctgaagcttgcgcattttgctgtggtggtctctcgacagtactctgagaaagaagctgcagttagctatcttgaaagcgtgattgagaaacttagagctactaaagagcctaggattactgaaccaatcatttatattgaaacacaaaaagctttattcaagcttgagcaaggtgatcagaaggagtgcaaaaaaatcttggacgatggaaagagctctcttgatagtatgactgacattgatccatcagtctatgccaacttctattgggtgtcttctcagtaccataagtgccgtcaagaattttctgatttctacaaaagtgctctgctttatcttgcatacacgtctgtggaggacctttcagaatcgtttaagctggatttggctttcgatttgtcactatcagctctacttggggagaacatctataactttggggaactgttagcccatcccattttgaaaagtctccttggaacaaatgtggaatggctctaccacattctacaggcattcaaccatggtgatttagttcagtatcaagaactatgccgtgtgcacaacgcatccttgattgctcaaccagcacttgttgagaacgagaagaagcttttggaaaagatcaacattctctgccttatcgagatcatcttcagccgacccgctgaagatagaaccattcctttgagcatcatcgctgagcgtactaaactttccattgaagatgttgagcaccttctcatgaagagcctttctgtgcatttgatcgagggcatcatagaccaagtgaacggaacaatttatgtctcatgggcgcaaccgagagtactagggattccacagatcaaggctttgagggatcaattagacagttgggttgacaaagttcacaccactttactatctgttgaagccgagacaccagatcttgttgcagcataagagaaaagaaaaccttcttcctccttttgaagctactgaatgtaaaacaccatcttctctgggattagattca

SEQ ID NO: 426 - DNA, 1103 bp, Brassica napus
cgttcgtcagttagagcttcttcatcttcttcttcttcttctcgcttaacccttctttctctcattttgattacttttcttcgacaagggttttaacaatgaagcttgatactagtgggttcgagacctccatgccaacgattggattcggctccagcaacgatatgcttgatgggttttctacggtgccctcgtttgatcttccccggactacagattttgatgggtttcagaaagaagcagtacagatggtgaagcctgcgaaaggaacaacaacactcgcttttatcttcaaagaaggtgtcatggtcgctgctgattctcgtgctagcatgggtggatatatctcctcacaatctgtgaagaagattattgagatcaatccttatatgcttggtacaatggctggaggagctgctgactgccaattctggcacaggaatcttggaattaagtgccgtctacatgaactggcaaacaagaggagaatctctgtttccggagcttcaaaacttctcgcaaacatgctctactcataccgtggaatgggactttccgtcggcaccatgattgctggatgggacgaaactggtcctggactatactatgtcgacaacgaaggaggaaggctcaagggagacaggttttcagttggttctggttcgccatacgcttacggtgtactagacagcggatacaagttcgatatgtcagttgaagaagcttccgagttggcaaggagatcaatctatcatgcgacattccgtgatggagccagtggtggtgttgctagcgtgtaccacgtgggtcctaatggatggacgaaactgtcaggagacgatgttggggagctacactatcactactaccccgtgccaccagccattgcggaacaggtcatggaggaagcagctgccgagtaaaactaagactttcttttacttcctaatcaattcactccctttctttagcttaagctctggtgttcactctattaagattctcctttttattttctgcaaacacatattctctttactttgttcaaacagctttttcaactcttcactctttgtttcaaccgtgaaattaggaacataagt

SEQ ID NO: 427 - DNA, 984 bp, Gossypium hirsutum
ttcaccctccacgtttcatcccatccctctctcacgcttttcctttgctttcctgatctcacctctctttcctttctgctgcttcttccgctgtttgcatttgaaaaactctgttttcctttttttccttttcatcaaaagcttgggtttctttttcttcttttttgcgccatgttgctgaaagctgttccaactttttcttcgttaaatcctcaactggaaaatcagggtgccctgttttcctctttttcttcttcgattaatcatcagctatcttctctaagaaatggacctgggtctcttgtagtttgtgcagccaaaggagccaaccacaagccactaagtggtgttgttttccagccctttgtggaagtgaaaaaggaacttgatcttgtcccctccgtgcctcaactttctctggctcgccaaaagtttactgatgactgtgaagcttccatcaacgaacaaatcaatgtcgaatacaatgtttcctatgtgtatcatgctatgtttgcttacttcgatagggacaacgttgcactcaagggtcttgccaagttcttcaaggaatcgagtttagaagagagagaacatgctgagaaatttatggaataccagaacaaacgaggtggaaaagtgaagctgcagtccatagtgatgcccctctctgagtttgatcatgcagagaaaggagatgcattatacgcaatggagcttgccttgtccctggagaaactaacaagtgaaaagctctttaacctacgtaatgtagccgtgcggaaccatgctgtgcagttgacggatttcattgaaggcgaattcttagctgagcaggtggaggccatcaagaaaatatcagaatatgtagctcaattgagaagagttggaaaaggacacggggtgtggcacttcgatcaaatgcttcttcgtgagggagaggaagctattgcatgaagccccaacttgctgcttcgttccatgtag

SEQ ID NO: 428 - DNA, 1469 bp, Arabidopsis thaliana
agacgatggcgtcaatgtctctctccttttcttcttcgctatgttcatccagaatccccgaaggtaagcgtaggtttcgtcacagagatgtgggcatcgttagatgcgttttggctgcttcgaaatcttctccgggaagtgttacgaagaagaggctttggaaagacggcgaattccccggaatcacggagccggttaatcagagaagaactccgataaagaatgtgaagaagaaacttgacaggagaagcaaagctaacggatgggttaacaccgtcactgaaactttgtccgatctcatcgccaaaaagcagtggttacaagctctcgaggtttttgatatgttgagggaacaaacattttatcaaccaaaggaaggaacttacatgaagctgcttgttcttctcggtaaatctggtcaacccaatcgtgcacagaagctgttcgacgaaatgcttgaagaaggacttgaaccaactgttgaactctacactgctcttctcgctgcttacactcgcagcaatctcatcgacgatgctttttcaattcttgataaaatgaaaagctttcctcaatgccaacctgatgttttcacgtacagcactctgctcaaggcttgtgtggatgcttctcagtttgacttggtggattcgttatacaaggaaatggacgagcgtttgataactccaaacactgtgacccagaacatagttttaagtgggtacggtagggtcggaaggtttgatcagatggagaaagttttgtctgatatgttggtgagtactgcttgcaaacccgatgtgtggactatgaatatcatccttagtgtgtttggaaacatgggtaagatagacatgatggagagctggtacgaaaagttcaggaactttgggattgagccagagactcggactttcaatattttgattggttcttatgggaagaagagaatgtatgataagatgtcgtctgtcatggaatacatgcgaaagctagagtttccgtggacaacatcaacctacaacaatatcatcgaggcgtttgcggatgttggtgatgcaaagaacatggagttgacatttgatcagatgcgtagcgaaggtatgaaagcagacacaaagaccttttgctgtctcataaacggatatgccaatgccggtcttttccacaaggtgataagtagtgttcagttggctgctaagtttgagatacccgagaatactgccttttacaacgcggtgatatcagcgtgtgctaaagcagatgatctgatagagatggaaagagtgtacataagaatgaaggagagacaatgcgtatgcgattcaagaacgtttgagatcatggtcgaggcgtatgaaaaagaaggtatgaatgataagatctattacttggaacaagagaggcaaaagcttatggatcgcactgttgctacaaaagagatggagaatcttccggcaggatgatga

SEQ ID NO: 429 - DNA, 1481 bp, Cajanus cajan
tggctatggtttccatctctttctctttttcttcttccatagttcccactccatttcccctcgacaaatccaccaaaacccgcgcccaaaatcccatctttcgggtcacccgtttcgccatttcagctcctccttccaattccgttgtcaaaaagaggcactggaaacaaggagagtttcctggtacttccgaaacatcgttgccccacagtacgaggaggacccccattaagaacatcaagaagaaattggagaaaaagaatgaggcaaaggcatgggtcaacaccgtcaccgaatccttatctgaacgcatcgacaagaagcagtggcttcaagcccttcaggtatttgatatgcttagagaacaaaccttttaccaacccaaagaagggacttacatgaaacttattgtgttgcttggtaaatctggtcaacctcaccgtgctcatcagctttttaccacaatgattgaagagggtttagaccctactcccgcactgtacacggcgttgctctcggcgtattgtaggagcaacttgattgatgaggcatttttggttcttaatgagatgaagaagcttcctctttgccagcctgatgttttcacttacagcaccttgattaaagtttgtgtggatgctttcaagtttgatttggttgagttgctgtatgaagaaatggctgaaaggtcaatcatgccaaacacggttactcagaacattgttttgagtggttatggcaaggcggggaagtttgacctgatggagaaagtgctgtccagcatgctggagagcactacatgcaagcctgatgtttggacaatgaacacaatcatcagtgtctttggtaatatgggtcagattgatatgatggagaaatggtatgaaaagttccgtaattttggtatagaacctgagacacgcacttttaatattttgattggcgcctatgggaagaaaagaatgtatgacaaaatgtcatctgttatggagtatatgcgtaagctgcaatttccatggacaacctctacttataacaatgtgattgaggcatttgcagaagcaggtgatgcaaagcacatggagtgtacatttgatcagatgcgggctgagggtatgaaagcagataccaaaactttctgctgccttatcaatggttatgcaggtgcaggtctcttccataaagtaattagcagtgttcgcttggccggaaagtttgagatacccgagaatatagaattttataatgcagtcttatctgcgtgtgcaaaagcagaggatttgatggaaatggagagagttttcaagcgtatgaaagatagtcaatgtcagccagacgacacaacatactccatcatgatcgaggcatatagaaaagagggtatgaatgacaagatatactatttggagctggataagaagactatgatgactgatgataaacaagtgagccagtttgagaatgaaatctttagttgatga

SEQ ID NO: 430 - DNA, 1535 bp, Sesamum indicum
cgcaaatggcggccgccttacaactctccctttcctcctctttcctcgcatcccctctcccctcctccaccctcagacccaccgccagtcgcccactccgcagactccttatctcctccgctaccgctccttcatcatcatcatcaacaacattgaatttgcccaagaaaaagcactggaaagtaggggaataccctggtgtctctgaagcctccatcacacatttctccagcaataacaagaatagaacccccattaagaatatcaagaaaaagctggacaagaagaataatgccaaagcatgggctaatacagtcaccgaagctctctctgacgccattgacaaaaagcaatggctccgtgcccttcaggtgtttgagatgctaaaggcgcaacctttttaccaaccaaaagaagggacatatatgaagctccttgttcttcttgggagatgtggacaacctgggcaagcctgtcagctctttgatgaaatgcttgaagaaggactggaaccaacagcggaactctacacagctttggttgctgcgtgttgcaggagcaatctgattgataaagcttttgccattcttgaacaaatgaagtctcttcctctttgccagcctgatgtctacacctacagtatactgattaaagcatgtgttgatgcttctcgttttgaactagttgactctctttatgatgaaatggccgaacgattaattaccccaaacactgtaactcaaaatatagtgttgagtggttatgggaaggcaggaaaatatgaggagatggagaaggttctttccaggatgcttgagagtacgacaagcaaacctgatgtatggactatgaataccattattagcttgtttggtaacgagggtcagattgaaatgatggaaaggtggtatgaaaaatttcggaattatggaatagagccagaaactcgcacttttaacattttgattggtgcttatgggaagaaaaggatgtatgataagatgtcatctgtgatggagtacatgcgtagactttcatttccctggacaacctcaacctacaacaatgtaattgaggcattttcggatgctggtgatgcgaaacacatggaatacacatttgatcagatgcgtgctgaaggcatgaaggcggacaccaagaccttctgctgtcttatcagaggttacgccaatgctggcctctttcataaagtgatcagcagtgttcagttggctggaagattggagataccagagaatacgtcgttctttaatgcagtcatatatgcttgctcaagggcagaagatataatggagatggaaagagttttcaagagaatgaaagataagctatgccaaccagattgtacgacttactctatgatgatggatgcatacaggaaggaaggtatgagtgacaaggtctatgatttggagcaagaaatgcagatgatgactggtaagacttgcaaagaataccatgatgttgaaacagacgctgctcctgacggcgagaaagtgctgttaatctgatga

SEQ ID NO: 431 - DNA, 1553 bp, Cephalotaxus harringtonia
caccgatgagtataggcgcattcatcggagtcggggcaggaaaacaggttctacgctcttcatttcttccaacagagtttgcagacaaatcgatttcatttcctgatcaaggagctttacggtttaccactagtgtttggaaacatgtagtgcttgcaaagaaaggttcaaattctagaacacaaagtagatctgtcaaacaaatacaaagaaagactttgaaggcatttagagaggatgtagatggattctcaatatcttctgccaatgaagcatcaagcacaagctctgctgttatagacaaaaattataggcttgagcctgaggtagaacgatcactggaggctctctttctgctccagaagtctatgctggagaaacaatggtatctttctcttgatccaaccaaattcagagaatctgactctttgaacagccacaaaagaacagaagttttccgttcagggaaagtatctgctaggcagcgtcggcagcatgcaagaacagggtcttcaactcacaattttgttgaagtggaactcactgatcaaacagcatataaaagcaatcaggagcatgtggctgtgcaagtgggatcagtaagggataccatgacagattcaatgaaaggcatgccaaatcaaaagttgcttacacatgaagaggttttatgcctgtcaaagaaaatacagaatggccttactttacggaaacacaaatcaagattgaaagccaagttaaaatatgaaccttctaatgcacagtgggctgcttctatgaatatgtctgtaactgaactaaacagaaatctgatggagtcttccattgctggacaaaaattgtcaatgtgcaatatacgtcttgttgtctcgatagcccgaaagtatgaaaacatgggcgttgatctgggagatttgattcaggagggcttaatggggctgagacatggcattgagaaattcgattcgtctagaggcttcaagctatcaacttacgtgtattggtggatacgtcagggtattataaaagcactgattgactatcgaaggacagtaaaaatacctaatcatgtgcatgagagactgagtttaattaggaaagcaaagttatccctaatggagagtggtgtggtcccttctcttaagactgttgcagcaaccataaacatgtcagagaaaaaggtgaaaaatgcaacacaggcaatcaagaggacacgttctcttgacaaagaatattctggatacgaaaatagttcaggtcgaacttttcatagtagtcttgcagatcgtaatgatgaaaatcattcatggtttactgcagaaagggacactttaaaagaggatgtggataaacttattaatgtgacattaaaagatagagagaaagtaataatcaggctatattttggcttagatgcacatagccgtacatgggaagatgttagtaagagtcttggattgtccagagagagggtgaggcaaattgggcgtatctcattggaaaagctgagacgagcaactagacgtcataagctggaaccactattttaataa

SEQ ID NO: 432 - DNA, 1571 bp, Oryza sativa
acaagatgacggcgacgccagcggtgatcgggctgagcgcggggaacaggctgctgagcgcgtcgttcgggccgaccgacctgatgccggacaaggtcagcctcggcgtcggcggaggcgggggaggaggaggaggtggtggaggtggggacgcgatgtcgttcgcgccgccggcgcccgcgacgccgaagctcaccgcggtcgccgcgcacaggctcaagctctccccgcatggccgcgcgcaggtcatgcgcgcgctcaggcaccactcctccgcggcggccgcgctcgcgcccccgcccccgcccccgcccccgccgacgccgtcgcccgcctcgcgcgccgcccacgcccatgacctcgagtcctccctcgaggccatcgtgctgctgcagaggtccatgctcgagaagcagtgggagctccccttcgacgacgacaaccacgccatggccatcggcttggccgaggatgacgacgacaccagcaaggccaccgtcgtcgtggcgcggtccagtgtctcggcgcggcagaggaggatgagcgggcggcggcgggggaggaccaagaacggcgcggcgcacttcgccgtcagccccgagctgatccagagcaggaacaggatctacctcaggggcaccgtcagcaaggagctcctcacgcacaagcaggtcgtccacctctcccacaagatcaaggatggcatctggctgcagcagcaaagatcaaagctgaaagagaagctgggaaatgagccctcatacaaacagctggcgcattcgctgaagatatcaccgcccgagctacgatcaaggatgcacgagtcgtttcttgcaagggagatgctaacaatgagcaacctccgtttggtcatttccattgcccagaagtatgataaccttggtgttgagttggctgacctcattcagggtggtctgatagggttactccgtgggatcgaaaaatttgatgcatccaggggctttagaatttccacttatgtatactggtggatacgccagggtgtttcaagagcattagctgaaaactcaaaaacattcaggcttccaacttatctgcacgagcggctgattgcgattcgtggtgcaaagtatgagttggaagatcaaggaattgctccaacaatagaaaacatagcagggtcactcaacatatcagaaaagaaagtactcaatgctacagaggctgtgaacaaggttctttcgttggatcaacaagcatttccatccttaaacggcttacctggagagacactgcacagttacatagaggatcaaaatgtcgcaaatgatccatggcatggatttgaggagtggtatctcaaggaagaagtcaacaagcttttaaactcaactctcaacgagcgtgagagggacattatccggttatatcatggcataggaaaacaatgccatacatgggaggatattagcagacaattcgggttgtcgagggagagggtgaggcaagtaggactcatcgcaatggagaagctgaagcatgctgcgaggaggaaaaatttggaggcattgcttgaggattattgatga

SEQ ID NO: 433 - DNA, 1520 bp, Flaveria ramosissima
catatatgatggctacaaatgcagttgttggactaagagcaggagaatggttattaggttcaacttgttattactctgaggtcagtgaaaagctgtcctgcagtagcaatcttgggttcatatttgttccaactacaagttcaatcacttctaagaagtcacccaactatagccatagtcttgtgaacaaacgagatattcaccctactagagccgtgaaggaacatgtagatactgctctgaattcttcaagtacagatcaatgggatgattgggttcagaggcttgactatctgaatgaagaagtctctgaacatgagcttccagttgatgctttactcttattacataaatctttattggaaaaacaatggacactatcaacagaggagacaacaactacagaaaagaacagcaaaaaggtagtcactggttcagggatatcagctcgtaggcgtcgattaaatgctcagaataaaacaccagcaaaaagttgttctgtaaatcaagatggcagaaacaagcagttgcgatccataatcagttcagagctccttcaaaattgtcaaaaagggtatcttaaaggtgtaaaaaacgaagcgttgctaactcattcggaggttgttgctttatcagaaaagatcaaaattggtctacaattagaggaagagaagtcaagtttgagggaaagattgggatccgaaccatcagagaaacaactagcagattttctaaagatttcacaagttgacttgcaaaccaaacagatggagtgcgctttggcaagagagaagctgactctgagcaacattcgtctggtgatgtctgttgcacaaaaatataaacacatgggagcagatatgtctgacctaattcagggtggtctaattggactgcttagagggatagagaaatacgattcatctagggggcacaagatttcgacatatgtctattggtggatacgacagggtgtcacgagaaccttctttgaaaactctaaaacccttagattgcctacacatttgcatgaaagattgagtgcaatccgaactgccaaggccaaactggaaagaaagggaataactccatcaattgatagaattgcagaaagcctgcgtatgtcaagaaagaaagttacaaatgccactgaggcagtctgtaaagtgttctcgctcgacaaggaagctttcccttctttaaatggtcttcctggagatacgcttcatagttacattgcagatgattgcccggacaacaacccatggcatggagtagatgaaggggctctcaaggaagaagttagaaatctcattaaaaagactctaggggaacgggagagagagatcatatatctttactatggtctggacaatgaataccttacttgggaggatatcagtagaaggaaggggttgtcaagggaacgagttaggcaggttggtcttgttgcacttgagaaactaaaatatgcggccaaaaatacaaagttagctgcaatgcttgtctatgattgatga

SEQ ID NO: 434 - DNA, 1650 bp, Gossypium hirsutum
cggagaagaagctgtatgatggcaacagctgctattatcggacttactgttggaaagcgattcttgagttcttcgttttcgtattccgatatcattgagaagcactcgtatgccggtgattatggcggagctccacattatcaaactgctcccactaaaagtttaatagttgcaaagaaatcatctaattgtagccaaagtgttccttcatatgatcggcgtagtcggtcgatcaaagctcttaaggagcatgtggatgctgcttcccttgtttcaactgccgaaccttggtttcagggatccaatgattttgaagaagaaagctatgaacttgactactctgtggaggctcttcttttgtttcagaagtctatgctcgaacagcaatggactctttcattcgaaaggacggtgttcactgaatcaccaagtagaaaaactaaaaagaaggtacctgttacttgttctggggtgtcagctcggcaacggagattcaatactaggatgcaacctaatgctaagcagctaagatcattgatcagtccggagctgcttcgaagtcgtttgaagggttatgtgcgaggtgttgtaagtgaagagttgctcagccatgcggaagttgttcgattgtcgaagaaaatcaaagccggactttccttggaggatcagagattgagactgaaggagaggctcgggtgtgacccgtccgatgaacagcttgcaacttccctgaagatttctcgtgccgagttgcgttcaatgttaattgaatgttcattggcaagagacaaattggcaatgagcaatgttcgtttggttatgtccatagctcaaagatacgataacatgggtgctgaaatgcctgatcttattcagggtggtttgatcggactattgcgcggcatcgaaaaattcgattcttcaaagggatataaaatttcaacttacgtttactggtggatacgtcagggtgtatcgagagcattagttgataactcgagaactttaaggttgcctactcatatgcatgaacgactgggattaatccgaaatgcaaaatatagactcgaagagaaaggaataacgccaactattgataggattgccgagagtctgaacatgtctcagaagaaagtccggaatgcaacgaaggcagacagtaaggtcttctcactcgaccgcgttgcgttcccctcattgaacggtcttcccggagagactcatcatagttacattgcagataaccatgaagaaaacaatccttggcatggagtagatgaaggggcactcaaggatgaagtgaacagactcatcggtataacactgggagaacgagaaagggagatcataaaactttatcatggtctcggtaaagaaagtcttacatgggaggacatcagtaaacgcatcggtttgtcgagagagagagtccggcaaatcgggcttgttgcgctggagaaactaaaaaacgcagcgaggaagaatggaatggaagctatgctattgaaacagtgattttcgaaattcagatataaaaattggtaaaaatgattgtatatatatacagaaagcaaaattgtatcttcaatatcaagactaaaagggcatggctgccatgaacttaaaactccctgtaaccagagttcaaca

SEQ ID NO: 435 - DNA, 1933 bp, Physcomitrella patens
aaagtcgacgctgctatggcggtctcatctctggtcttcattgcccctacgtcgtcgtcgtgtggttgctctgggatccaatacagggctttgaatcttgcgcacactgctcgggggcggggattagagtcgtcatcgtcgctgtattttttcggagggaagttgcagacgtggaaatttgttgaaaatgcagctaagtggaggaatgcggcggggtcgctgcgggtgcgctgtgacgcgggcgtggcgctggtggagcagcgagtagaggaggaacagaagcagcggttgagctccgattttaccacggttatgaagtttgggggttcgtctgtcgcctccgcacaccgaatgagagaagtggcgcaactgattttgagttttccggatgagaggcctgtcattgtgttatctgctatgggaaagacgacaaacaaccttctgaaggcaggagaaaaagccgtgtcatgtggtgtcgaggagtccggcaatattgaggagctccaagttatcagagacctgcataagacgacagcacgtgaactcaaagtggatgaatctttggtcacagagctttttgaagagttggaacagctggtaatggggattgctcttatgaaggagctgacgctgcgcaccaaggattacctggtttcctttggagagcgcctctcaacccggctattcacggcctatttgaatagcatcgggacatacgctcgacagtatgacgcttttgacctcggaatcattacaaccgatgagttcacgaatgctgaaatcctggaggtcacatacccgacagtaagagagaggcttcttaaagatcttaaagccgacgctgataggggtacacccatatgcgttgtgacaggcttccttggtaagggggttgagactggttgtgtaacaaccttaggacgaggagggagcgacttgacggccacagccctcggtaaagcgctaggtctccgggaaattcaggtgtggaaagacgttgatggtgtcctgacatgtgatccccgtgtatactccaatgcattaccagttccattcctgacctttgatgaggcatctgagctggcttatttcggagcccaggttttacatcctcagtcaatgagaccagcccgcgatgcaaacatacctgttcgtgtcaagaattcttataacccacaggcacctggtactctcataacaggggaacgcgacatgagtgaggcagagatgacaagcatagtgctgaaaaaggacgtgacaatgttggatattcaaagcacacgtatgcttggccaagttggatttcttgcaaaggtgttcactacgtttgaacatttaggcatttcagtagatgtggtggctaccagcgaagttagcatatcattgacgttggacccttcaaaactttgggagcgtgaactcattgaacaggaattggacaaaatgaagtcagaattgtcaaaaatcgccaacgtacaacttttaaagaagaagtctataatttctctcattagcaatgtgaagcagtcatcagctgttcttgaaaaagtctttagggtcttcaagaagaacgacatcaacgtacaaatgatctcacaaggtgcttccaaggtaaacatatcaatggtggtggatgatgatgatgctcccaagtgtgtgcaagagctgcacaaagtattttggcctgatgctgacgaggcgacggaaagaaatggtcatgtctaagaacaagacgttccgttagtttttaacatccctgacttgggaagtctatacttttaagtcctcctcagagacatttttgtagatgttaatcaatccatggttacgcattgtttaagttctggctgtagagagggcttcctgtattcagttcaggcaggctctgattattagcaaaccattcaagtgctgatgtaatgctgatatcttt

SEQ ID NO: 436 - DNA, 1875 bp, Brassica napus
aaaggatcccagaacagagaactgttgaagaggtttcaacaaagtttccatctttggcgtctcactaaacattctcctcctcctccgatggcggcggctgctagggttcagtgtcataacaatacctctttcaccggatcaccactcccccgccgccaccgcaactcgtcgacgctacacgcttctccaaatcgcgtcaatttcacaccgctgaaatggatcggagacggctcatcctcctgcacaaggacggtttcaggtccacccctcaaaggcggcggcaccactactgtacgagctgcgtttgaagaggagaagaagacagacgcggtcaatgaggtagcagaagagaagaggagattcacgtgcgtgatgaagttcggaggatcgtcggtggcgacggcggagaggatgagagaagtggcggatttggttttgacgtttcctgaggagagtcccgtcattgttctttccgcgatggggaagactactaacaacctcttgcttgcgggagagaaggctgtgagctgtggtgtttctaatgcttctgagatcgaggagttgagcgttatcaaggagttgcatctcaggacagtgaaggagctcgagatcgacctctctgttgtttcgtcatttttggaagaactggagcaactcctgaaaggtatagccatgatgaaggagctgacacttagaaccagagactacttggtctcttttggagagtgcttgtccacaaggattttcgcggcttatcttaacaaaattggagtcaaggcacgccaatatgatgcatttgaaattggtttcatcacaacggatgatttcactaacggagatatcttggaagcaacttatccagctgttgccaagagattatatgatgattggatgcatgatcctgctgttccagttgtaacaggtttccttggaaagggttggaaaacttgtgcggttactaccttggggaggggtggcagtgacttgacggcaaccacaattggtaaagcattgggtttgcaagagattcaggtgtggaaagatgttgatggtgttctaacatgtgaccctactatttataaacgagctacaccagtaccatatctaacgttcgacgaagcagccgagctagcttattttggtgcacaggtgttgcatccacagtcaatgagaccagcaagagaaggtgggattcctgttagggttaaaaattcttataaccctaaagctcctggaactatcatcaccaaaacaagagacatgaccaagacggttttaacgagcattgttctgaaacgcaatgtgaccatgctggatatagcaagcacccggatgcttggtcaagttggctttcttgccaaggtattttcgatatttgaggatcttgaaatatccgtagatgttgttgccactagtgaagtcagcatatctctgacactggacccgtcaaagctttggagcagggaactgattcaacaggagcttgatcatgtagttgaagaacttgagaaaattgcagttgtgaatctcgcaaaaggaagagcaatcatctctctaatcggaaatgttcaacactcctccctgattctagagagggcgtttcatgttctgtggaccaaaggcatcaatgtccagatgatatcacaaggagcatccaaggtaaacatttcccttatagtaaatgatgctgaagctgaaggatgcgttgaggctcttcacaaatccttcttcgagagcggtgacctctcagagttattgatacaacccagacttggcaacgggtcacctgtcagggcaatgcaagtagagaactgacttgactagctcattgcttgaatctgcagtttccatcaagaactgcttgttggtaccttt

SEQ ID NO: 437 - DNA, 1721 bp, Oryza sativa
ggagaatggcgatcgctctccgattagcggccgcgccgctccgcctccgcctcgtctcgccggcccctccggcgatcggcggcgcgggagatggaggacgacgaggaggaggaggagcagctcgtatcggtgtcctgggcagggctcgctgccgccgccgccgcggcggaggcgggagactggaggtggcggcggcggccgccgatgactccgctcgctgtcgggccaagggagtgggcgccgccgccgccgcggcggaaaccctaggtgggatcggggtgggaggtggggaccagctgagcgtggtgatgaagttcggggggtcgtcggtgtcgtcggcggcgaggatgcgggaggtggcgggcctcatcctcgccttccccgaggagcgccccgtcgtcgtcctctccgccatggggaagaccaccaatctcctcctcctcgctggtgagaaggcagtgggatgcggcgtgatccgtgtttcggaaattgaagagtggaatttgatcaaagatctacacattaaaactgtggaggaacttgcactgccaagatctgtaatacacactatgctggatgaactggagcagctcttgaaaggtattgcaatgatgaaagagctgacacttcggaccactgactaccttgtttcatttggggagtgcatgtctacacggatttttgctgcttatttgaacaaaatcggagtaaaagcacggcagtacgacgcatttgatattggtttcataacaacagacgatttcggaaacgcggacatcttggaggcaacttatcctgctgttgcgaagagattacatggagactggattcgtgatccagcgatacctattgttactgggttccttgggaagggctggaaatcaggcgctgtaaccactttaggccgaggtggcagtgacttgactgctacaaccattggtaaagccctggggttgagagaaattcaggtatggaaagatgttgatggtgtactgacctgtgatccaaatatctacccgaatgcaaccactgtgccatacttaacatttgaagaggcagcagaacttgcttattttggtgcccaggtattacatccacaatctatgagacctgctagagaaggtgatataccagtcagggttaagaattcgtacaaccctaaagctccaggcaccctgatcactaaacaaagagagatggataaggttgtgctaactagcatagtgctcaagtcaaatgtcactatgttggatatagtaagcactcggatgcttggtcaatttggttttctggcaaaggtcttctctatattcgaagatctagggatatctgtagattgtgtggctactagtgaagttagtatttctgtgtcgcttgatccatcaaagatctggagcagggaacttattcaacaggaacttgaccatgtagttgaagagcttgagaaaattgcagttgtccatctacttcagcagagggcaataatatcactcattggaaacgtacggcgatcatctcttatactggaaaaggcctttcaagtgttgaggaaaagcggggtgaatgtccagatgatctcgcaaggtgcatccaaggttaacatgtctctgattgttcatgatagcgaggcaaagcagtgcataaaggccctccaccaggcgttcttcgaggacgatgtcctgacagaagtcgaggaagaagcccttcacatgagctgatga

SEQ ID NO: 438 - DNA, 1552 bp, Brassica napus
agagtttcgtctacgcaggaacattggagtcttctcgtctcccaatcttttgatggcattgatacaacaacctgttcaaggttcttcttctctttccgccaatgaaattatacaaacgattcactgcttttctcggcgtgtagcctctgtttcagcgatgcccacaacgtgctcgacgaaaagccccaaagaacgtaaagataaaaagacatctggcttaatatcaacaagacaccaagtagatcccaagagagaattatctcggattcttagaacagacgctgctgttaagagcatcgagaggaaagccaactccgaaaagtacaacactttatggccaaaagctgttctcgaagcacttgatgatgccatcaaagagaatcgatggcagtctgctctcaagatattcagtcttctcagaaagcagcattggtacgaaccaagatgcaaaacctacacaaagctcttaaaactccttggaaactgtaaacagccagagcaagccagcttactcttcgaactaatgctgtccgaaggactaaaacccaccatcgacgtctacacgtctcttatctccgtctacggcaaatgctctcttctagaaaaggcctttgcaactctcgaatacatgaaatcagttagcgactgcaccccggacgtcttcactttcaccgttttcatcagctgctgctgcaagctcgctcggttcgatctagtcaaccgcgtcctcctcgagatgtcgtaccttggagtcaggtgcagcacggtgacttacaacactatcctcgacgggtatggtaaagcaggcttgtttgaggagatggagaacgttttggctgatatgatcgaggatgaggattcacttccagatgttttcacgtttaattcaatcattggttcttatggaaacggtggaaacattaggaagatggagagctggtataaccggttccagcttatgggagtggagccagacatcaccacgttcaacgtactgatcctgtcctttggtaaagctgggatgtataagaagatgagctcggtgatggattacatggagaaaagattcttctcgccgacggttgtcacttacaacattgtgatcgagacgtttgggaaagcggggaggatcgagaagatggaggaggtgttcaggaagatgaagtatcgaggagtgaagcctaactccatcacttactgttcgcttgttgacgcgtatagcaaagctggtcttgtgggtaagatagattcggttttgaggcaggttgtgaattcggatgtggtgctggatacggtgttcttcaattgtataatcaatgcgtatggtgaggctggtgatctggctacgatgaaggagttgtatatacagatggaagagagaaaatgtaagcctgataagattacttttgcgactatggtgaagacttatgctgctcatgggatatttgatgcggttcgtgaacttgagaaacagatgatttccacttgcgagagttcaggcaagaagaggctcatggggtgatgtggtgatttggaagctgttcacagttag

SEQ ID NO: 439 - DNA, 2519 bp, Phaseolus vulgaris
gtgttgccatttcacattcaagtgaagtcttgtccctgaagatggcacatcatcctttgacccactctcactctttccgggagaggattgatgaaactctctctggtaacaggaatgaaattttggcccttctgtcaaggcttgaaggcaagggcaagggaatcctgcaacaccaccagatcattgcagagcttgaagaaatccctgaggagcacaggaagaagctacaagatggggcctttggagaagttttgagatctacacaggaagccatagtgctgccaccttttgttgctctggctgttcgaccaaggcctggtgtttgggagtatctgcgtgtgaatgcgcacgtgcttgctgttgatgagctacgtcctgctgagtatctgcgtttcaaggaggagcttgttgagggaagttctaatggcaactttgtgcttgagttggacttcgaaccatttaatgcgtctttccctcgtccaactctgaacaagtccattgggaatggcgtggagttcctcaaccgccatctttcagccaaactcttccatgacaaggagagcatgcagccactgcttgaattcctcaggcttcacagttataagggcacgactatgatgctgaatgacaaagttcagaacctgaattctctccaacatgttttgagaaaagcagaagagtatctaacttctgttgctcctgcaacgccctactcagaatttgaaaacagattccgggagattggtttggagagggggtggggtgacaccgccgagcgtgtcctcgagatgatccagcttctcttggatcttctggaggcacctgaccctttcacccttgagacattccttggaagagtccctatggtcttcaatgttgttatcctttctccccatggttactttgcccaagataatgtcttgggataccctgacactggtggacaggttgtttacatcttggatcaagttcgtgccttggagaatgagatgctcaaccgcatcaagaaacaaggcttggatatcactcctcgtattctcattatcactcgtcttctccctgatgcagtaggaactacctgtggcctacgtctagagagggtatatgatactgaatattgtgacattctccgaattcctttcagaacagaggagggaattgttcgcaaatggatctcaagattcgaagtctggccatacctagagacttatgctgaggatgttgctgttgaacttggtaaggagttgcaagccaagccagatcttattgttggaaactacagtgatggaaacattgttgcctctttgttagcacataaattaggagtaactcagtgtaccattgctcatgctctagaaaagaccaaataccctgagtctgacatttactggaaaaagtttgaagagaaatatcacttttcatgccaatttactgctgatctttttgcaatgaaccacacagactttatcatcactagcaccttccaagagattgctgggagcaaggatactgttggacagtacgagagtcacactgccttcacccttcctggtctttaccgagttgttcatggtattgatgtctttgatccaaagttcaacattgtctctccaggagctgatatgggcatatacttcccatacaccgaaactgagcgtaggttaacaaatttccacgctgagattgaagagcttctttacagctcagtggagaatgaggaacacatatgtgtcttgaaggaccgcaacaagccaatcatcttcaccatggcaagacttgaccgtgtgaagaacatcacaggacttgttgaatggtacggcaagaacgctcgcctccgcgagttggtgaaccttgttgttgttgctggagacaggaggaaggagtccaaggacttggaagagaaggctgagatgaagaagatgtatggcctcattgagacctacaagttgaatggccaattcagatggatctcctctcagatgaacagagttagaaatggagagctctaccgtgtgatttgtgacacaaagggtgcctttgtgcagcctgcagtttatgaagcttttgggttgactgtggttgaagccatgacttgtggattgccaacatttgccacattcaatggtggtcctgctgagatcattgtggatggaaaatctggataccacattgacccctaccatggcgaccgtgctgctgagatccttgttgacttctttgagaagagcaaagcagatccatctcactgggacaaaatctcccagggaggactcaagcgtattcaggagaagtacacatggcagatctactctgacagactcctgacactcacgggtgtctatggcttctggaagcatgtgaccaaccttgaacgccgtgagagcaaacgttacctggagatgttctatgctctcaagtaccgcaaattggctgagtctgttccccttgccattgaagagtaaaaccattgttgaagggaaaatcgaacggctttttggtctcatgcagctttcacaaat

SEQ ID NO: 440 - DNA, 2167 bp, Zea mays
gcagcgccttcttccttcttcccgcccaacctcggccatgcccgtagcggcgctccgtcctcccccggtcgctgtcggcgcgggacgccgcagcgcccgactccaggcgcggttcgccctccgcgcgagctccctcgaggcgtcggcggcagtgacggtgacagtgaacgggtctgcagaggccgcggtggagaggaaggagaaggtgcaggaggataaggacaacgagggactgccggtgaaggaggagcaggagagggggctggaggtcctctacgacgacggcttcggctccgtgaccgtcaaggactacttcgcggcggccaaggtcctgtgccgggacgacggtgggccgccgcgctggttctctcccgtcgagtgcggccacccggccgtggaccaagcgccgctgctgctcttcttgccaggaatggatggcgtcggcacgggactcatcctgcaccacaagtctttgggcaaagtgttcgaggttcggtgcttgcatataccagtcaatgatcgtacaccatttgaaggactagtacaaatcgttgaaaatttgatcaagcacgagcatgatttatccccggacagaccgatatatcttgtcggagattcatttggcggatccctggcactggcagtggcagctcgtaatccgcagattgatttggttctcatactagtaaacccagctacatcatttgcaaagactccattgcagccagtattgcctctactggaatcagtgccaagcgagtttcatgctacagtgccgtatcttctcagttttgtcatgggtgacccactgaagatggctgcagttagcattgaaaacaacctatctcctccagaaactctgcagaaattgtcagacagtctcacatcaatgcttcctttgctttcagaactgtctgatattataccaagggatactcttctatggaagctcaaacttctcaaggcaggagcagcctatgcaaattctcgtctccatgccgtgcaagccgaggttctacttcttgccagtggtaaggacaatcttctaccaagcggagaagaagcggatcgactcttcaaggcactgaaaaactgcagagttcgatacttcaaggacaatggccatacactactgctggaggatggcgtcaacctgttaactgtcataaaaggagcgaacatgtatcggcgtggaaggcaaagggattctgtaaccgattatctcccgcctactctaagtgaattcaggcaaacatttgatgtggatcacaggctgttccaccttgcactgagcccagtcatgatgtccaccctgaaggatgggaaaatcgtccgcgggcttgccggtgtccctgacaaaggcccggtcttgttcgtgggctaccacgcgctcatgggcatcgagctgagtcctctgtacgaggagttcctgagggagaagaggacagtcgtccgcggcatggcgcacccgttcctgtttgggaaaaagttcgagtcgtcgcgccaggagatgtcccgtttcgacactgtttctatgtacggtggactgccggtgaccccgatcaatatgtacaggttgttccagaggaaccaatttgttctgctctaccccggcggcgttcgggaagctctgcacaggaagggtgaagagtataagttgttctggccagatcagccagaattcgtaaggatggcggcgcgctttggtgtaactatcataccctttgggtgtgttggagaagacgacgttctcgagttggttctggactacaacgatcagaagaacattcccgggctccgggaatggatacagtcgatcaacaaagaagccgagagagtgagggacagcgtaaaaggagaggatgggaaccaggacatgtacctgccagctcttctcccaaaagtgcctggccgattctactacctgttcgggcagccgattgagatgaaagggatgggcaaccttgtcagagataggaagagcgcgaacgaggtgtatctacgcatcaaatcgcaggtggaggagatcatgtcgtatctcaagaggaagagggaggaagacccttacaggagcctaccgcagcgtgcactgtaccaggcaacatggggcgcctccgctcaggtccccacttttgagccatgaagattgggagtagggaagggctag

SEQ ID NO: 441 - DNA, 656 bp, Zea mays
cggggatggtgttctacttcaaggcgcggcccgaggccggcgactacaccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagcttgtcaaagctaattccattcaaggtaataaagtcaataacattgatgtagtttatactccatggtacaatttgaagaagaccccttcaatggatgtaggccaagttggttttcacaaccctaaattggttcgcactattaaagtggaaaagaggatcaatgagattgtgaaccgcttgaataagacaaaggtggaacggaaacctgatttaaaggctgaaagagaggctattagtgctgctgaaaaggcagaaagaaaggcacagcttagagacaagaaacgtagggaagagatggagaggcttgagaaagagaagcaggctgatatcaggagctacaagggtctaatggtccaagagaagatgacttccaacaagcaaatcgcttctggcagcaagaccctgcaggaacttgaagaagactttatgtgatga

SEQ ID NO: 442 - DNA, 407 bp, Zea mays
agcacatggctctcgagaaggccaaggagatcatcgcgtcctccccggtcgacctagctctccgaaaggccaaggagaccgtcgcctcccaccccgtcgtcgtcttcagcaaaacttactgtcctttctgcacccgagtgaaacaattgctagcaaagttgggggcaagttacaaggctattgagttggatgtggaaagtgatggcgctgagctgcagtcagctctcgctgaatggactggccagagaactgttcccaatgtcttcgtgaaaggggagcggattggtggctgtgacgcaaccatggcgatgcacgacggtgggaagctggtgcctctgctcaccgaggctggagcaattgtcactgccagggctactgcaactactaccactccgtctttgtagtag

SEQ ID NO: 443 - DNA, 1394 bp, Zea mays
gtcgaccctaatctcctctgagtccagcggccacctcctccaccgggagctccccgtaccataaccgcagtccgcagccattggaatttccgcttcatgcgtggatcctcgtagaccccgacccgcgtgcactcaatccctaggcggcggcctccggcgcgaggctagcgggcggcacccatggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaaggtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggtgaattcccatcagggcatacagctgatgttcaaagtgtgtccatcaactcatcaaatacaaatatgtttgtctctggctcatgtgatacaactgtgaggctgtgggatatcagaattgcaagtcgagctgttcgaacctaccatggacatgaggatgatgttaacagtgtgaagtttttccctgatggccataggtttggtactggctcagatgatggcacatgtagattatttgatatgagaacagggcatcaacttcaggtgtacagtagggagcctgatagaaatagtaatgaactacctactgttacatctattgcattttcaatatcaggaaggctactttttgctggttactccaatggtgactgttatgtgtgggacacacttctcgccgaggtggtacttaatttgggaaacctgcaaaactcccatgatggccgtataagttgcctcgggatgtcatctgatgggagtgcattgtgtacaggaagctgggacaaaaatttgaagatttgggccttcagtggacaccggaagatagtttgaaggccaacttttctcccccatgttgtatgttccttgttgccccttaacaacggacagtggtgattaggatc

SEQ ID NO: 444 - DNA, 1105 bp, Oryza sativa
gcagtccgtctaccgaatggccgcggcggcgcggcccgtcgacgtcgtccgccacttcccgtgctcctcctcggtcgccgcctcctcctccttgctgctgtcgcgctccaagtccaggctcgcgtctcctgcggcggcggcggcgagctccatgcggcgaaggcttgtgctcggcgtgggcgccgccgccgccccggccgtggcggcgctcgcggcctcggcgacgcccgcggcgctgcgggactgcgccgccacgctgctcatcaccgcgggcgcgtactccctggtgcgcgccttcgacgggctcacggcgcggcggctcatcgaacagaacctgagcagaaaaattgtgcatgtgctctccggagtcctgttcatgtcttcctggccactattcagtaattcgacagaagcacggttcttcgcggcaattgtcccgttgctgaactgcataaggcttctgacctacgggctccgcctttccactgatgaagctctagtaaaatcggtgacccgtgaaggaaaaccagaggaattgctgagaggtcctctgtactatgtcattgtgctgctggtcagtgttttggtcttctggcgccagtctcctattgggattgtttcgttgtcgatgatgagtggtggtgatggctttgctgacattgttgggagaaggtatggctccgcgaagctgccattcaatgagaacaagagctggataggaagcatctcaatgttcatttctggcttccttctatctgcactgatgctgttctacttctcttgccttggttacttcactgtctgctgggatctggcacttggtaaactggctcttgttgcattagcagctactgtagtggagtgtattcctgtcaatgatgttgtggatgacaatatctccgttcctttggccaccatgttggcagcctatctgttatttggctacagttcatgttgttgagactataaaatttctcccttttgcttttcatgtcctgaatttggtactgccaaacatcatagattggatctctttctgttgaatcaaaaggtattttgctcatgatcatgcatgcattttgggtgaacgctagccaaatcattt

SEQ ID NO: 445 - DNA, 800 bp, Oryza sativa
ccgcgatgttggagctgaggcttgtgcaggggagcctgctgaagaaggtgctggaggcgatccgggagctggtgacggacgccaacttcgactgctcggggacggggttctcgctgcaggccatggattccagccacgtcgccctcgtcgcgctgctcctccgctccgaggggttcgagcactaccgctgcgaccgcaacctctccatggggatgaacctcaacaacatggccaagatgctccgctgcgcgggcaacgacgacatcatcaccatcaaggccgacgatggctccgacaccgtcaccttcatgttcgagtcgcccaaccaagataagattgcggatttcgagatgaagctgatggacatcgacagcgagcacctcggcatccctgactccgagtaccaggccatcgtccgcatgccgtcctctgagttttccaggatctgcaaggatctgagcagcatcggagacactgttatcatctcggtgaccaaggagggtgttaagttctcgaccgctggagatattggaactgccaacattgtctgcaggcagaacaagactgttgacaagccagaagatgctacaatcatagagatgcaggaaccggtgtcactaacctttgccctgaggtacatgaactccttcaccaaggcaagcccgctctctgaacaagttacaatcagcctttcatctgagctgccagtggtggttgagtataagattgcagagatgggctacattagattttatctggcgccaaagattgaagaagatgaggaaatgaagtcgtgatga

SEQ ID NO: 446 - DNA, 998 bp, Glycine max
cactgccactttgatttgattcgtgtgcacatataaggtggggcatggcctacaccctttccaacactctcccactctcactcgccttcttcccagaccgcaccctccttcatccaccctccacacacctcttcctctctcgccccctcagattcaaaagtctttgcgtcgtcaatctcaagagacctgttcccccgctaaaagcatcgatggcggagaccaacaacaacgttgccgtcgaggtcttcgaaaaagaggatcttgccgtgtccctggccaaatacgtcgccgatctctccaacaaattcacttccgaaagaggggctttcactgtctgcttgtctggcggctctttgatcaattatctccggaaacttctggaacctccttatgttgatacccttgaatggtccaaatggcacgtgttttgggtggatgagagagtcgtgcctaagactcacgaagatagcaactacaagcttgctttagatggacttctctccaaggtgccaattcccccgggcaatgtttatgcaatcaatgatgcgctttcagccgagggagcggcagatgattatgagacgtgtctcagacacttggtcaagaacaatgtgatagcttcatcaccagccaatgaatttccaaaatttgatctcatgctgctgggcatgggccctgatggccacatagcttctctgttcccaggccatcctcttgtggaggagaaacaaagatgggttaccttcattaaggactccccaaaaccaccaccagagagaataactttcaccttaccagtgattaatacttctgcttacgcagcgcttgtggtgactggcaagggtaaagcagatgcagttcactctgtgttaggccaatctcaaaattctgttaagcttcctgttggattggtttcacctgaaggggagttgaaatggttcttagacaaaggtgcagcctcaaagctgtagatctagcagctaagccatgatcctata

SEQ ID NO: 447 - DNA, 618 bp, Glycine max
ggtttggagtatgacttcttgcacctcttttgcatcctttctcatttcttcttcttcatttccttcattgtgcttcgcgcaaacccactcaatcacatgtaaacaacgcttcccatttccttctgtaaagggaagaagaaagttctcaactttatcattttcatccaccaaaaggctcgttacaagagccgctgagtacaaattcccagaccctattcccgaatttgcagatgccgagactcaaaaattcaaaagccaccttctcaaaaagctttcaaagaaagatatgtatggagaatcaattgaggaagttgtaggaatttgcactgagattttcagcactttcttacactccgagtatggaggtcctggtacactcttggtccttcctttcgttgacatggccgatgccctaaatgaacaaggattgcctggtgggccacaagctgcacgtgctgcgatcaagtgggctcaagatcatgttgacaaagactggaaagaatggactaatggtgataacaacaaaaaatagggtacctcttgtatgttatttagtcgttataactggtgcttatgttgtaagagacctaaatgatcggttttgatatctatttctta

SEQ ID NO: 448 - DNA, 2737 bp, Zea mays
gtcgacaagcttgctttaggattggagggctctggttggttgcctagacgccggcgatggcgtcgccggccggcggcgagtctccggcgaagcccgtcctcctgcacggcgacctcgacctctggatcctcgaggcgcgcctgctgcccaacatggacatgttctccgagcacgtgcgccgctgcttcgccgcatgccgcccgccctcctcctgcgggaccaagcacccgccgcccgccgccgctggccgccgccaccaccaccaccaccggaacatcatcaccagcgatccctacgtcacgctgtccgtgtccggcgccgtcgtggcgcgcaccgccgtcatccccaactcccaggaccccgtctgggaggagcgcttcgccgtgccgctcgcgcaccgcgccgccgacctcgagttccaggtcaaggacaacgacaccttcggcgcgcagctcatcggcaccgtcgccgtccccgccgaccgcgttgtctcgggcgacgaggtcgaggactggttccccgtcataggcaccaacggcaagccgtacaagcccgacaccgcgctgcgcctccgcttcaagttccagcccatcgccgacaacccggcctaccgccacggcatcgccggcgaccccgaccacaggggcatccaggactcctacttcccgctccgccacggcggccaactgacgctgtaccaggacgcgcacgtcagggaaggcgacctgccagagattgacctcgacaacggcaagacgttccagcacaacgcgtgctgggaggacatctgccacgccatcctagaggcgcaccacatgatatatatcgtcggctggtcggtgtacgacaaggtgcgcctcgtgcgcgaaccatctccgtcgcgcccattgcccgagggtggagaccttacgcttggggacctgctcaagttcaagtcgcaggagggtgtcagagtgtgcctgcttgtgtgggatgataagacttcacatgacaagttcttcatcaagacgggtggggttatggcaactcatgatgaagaaactcggaagtttttcaaacattcctcagtcatctgtgttctctctcctcgatatgctagcaataagctcagcattttcaaacagcaggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcggcaggtgcaaagggtcccaggcaaccatggcatgatttacattgcaggattgatggccctgctgcctatgatgtcttgacaaattttgagcaaaggtggcgaaaggcaacaaaatggcgtgaccggtttagaagagtatcccattggaaagacgatgctttaattaaactggagcgtatctcatggattttaagcccttcacccaatgttccaaataatcatcctagtttgtgggtttcaaaagaagaggatcatgaaaattggcacgttcaggtattcaggtcaattgactctggttccctaaaaggatttcctagtgattgcaaagcagcttcaaagcagaatcttgtgtgccgaaagaacctggtaattgataagagcatccacactgcatatgtccgagcaatcagatctgcacaacatttcatttatattgagaaccagtactttcttggttcttcatatgcttggccgtcctatgtgaattcaggtgctgataatctggtaccaatagaattggccctcaaaattgcaagtaagattaaagcgggagaacgctttgcagtgtatgtagtgataccaatgtggccggaaggagtccctactgcagcatctgtgcaagaaatccttttctttcaggcccagacaatggagatgatgtataaaataattgcagatgagctcaaggcaacggacaataaggatatgcaccctgaagattacttgaacttcttttgtcttggaaatcgggaagaaccaccatctaatggtagcccagaatcagagaaatctacagataaaagtgcagcggccttagctacgaaatatcgacggttcatgatctatgttcacgcaaaagggatgattgtggatgatgaatatgtcattctgggttcagcaaacatcaaccagagatccctggctggttctagagatactgagatcgcaatgggggcataccagcctcattatgcatggtctacaaagaatggacatcctcacggccaggtatatgggtacagaacgtctctgtgggcagagcaccttggaacggttgatgatcgcttcaaggatccttcgagtttggagtgtgtaaggtttgtgaatcaaatagctgtagagaactggcaaaggtttacagcagaagaaatgagtacgttacaagggcacctcctcaagtacccagttaaggttgaggctgatggtaagatcagcccactgtcagaccaggagtgctttcctgatgttgggggcaagattctgggagctccaacttcacttcctgattcactgactatgtagtgttattacataaaaaaacttctttcagagttgaactttgtaattgtctaaaattggtgggtttatcgcagaacttgtactatatctgtaatcatcgatagttggcgaggatc

SEQ ID NO: 449 - DNA, 1678 bp, Glycine max
gtcgacgcaagggctagttagtgatttggtcttccctctgaaccagatggagttgttatgcactgccaacgcgattctcccctcacgcagcctctctattcccacaccctattcgctacccctcaaaacctcccttccgttcccgcgcttcaacttccccaaaatcgagagattacgagggttgcagccctgtgtgagtgtgagtgaaggcagttccgctgaggctgaggtgttggaggagagccgaattcgtcgagtttgcgacaagctgattggggtgttcatggtggacaagcccaccccaacccattggagaaggttgttggctttcagcagagaatggagcaacctcagaccgcacttttttgcccgatgtctcgaaagagccgatgccgctgaagaggatcccgccatgaaggagaagctgcttcgccttgcgaggaagctcaaacagattgatgaggatgtgcaaagacacaatgatcttcttgaggtggtaagacgggatccttcaggaattagtgagattgtctccaagcgtcgtaaagattttacagaagaattctttgttcactttcatacagtggctgaatcctactatgagaacaaagaagagcaaaatgaattggcaaagcttgggaatgcatgcttggcagctgtacaagcctatgatgctgcaactgaaagcgttgaaaagctgcaagctgcagagttgaaatttcaagatattatcaattctccttcgcttgatgctgcctgcaggaagatagacaatttggctgaaaaaaaagaacttgattcaacattggtattgatgatcaccaaagcttggtcagcttccaaggagtcgaacatgatgaaagatgaggtaaaagatatcctctatcatttatacaagactgcagtgggaaatcttcagagactcgtgccaaaagagattagaatagtcaagtatcttatacgaattgaggatcctgaggagcaactatctgccctcaaagatgcatttactcctggagaagaacttgaaggaacggatgtggataacttgtacacgactccagagaagcttcacacatggataaagagtgtgttggatgcttatcatttgagtggagaaggtaccctcattagggaagcaagagatctgttgaatccagaggtcatccaaaaattggaggtgctcaagaaggttgtggaaaaaaactttatgtgaataggagcttaagaaacatgctaaggtggttttcccactctgagatgccagaagaatacttcatgagattcttgatgtccatcaactacaggcccggatttacagtatcattgctgcaaggaaatatctaaattctggctagtgtttaaggacgtagaattctctttagcaatagaagaagcattttttggggtaaataatagaatgagcaatttttgttggtgagtagggaaatgtgttctatgcacgtaggagatggaactattacatggtagaccgctagataaatacaagatttgaggaactgaaccctcgcagagggtgacagttctaccaaaagtctaggcccttggttaagtcacttgaagatacaatgtatgcccgtgtttaattcctatacttgtattaactttttgttttagtctttgccatgagtcgggattcgttaattgcttaaggatc

SEQ ID NO: 450 - DNA, 1556 bp, Zea mays
accttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcggcgggccgcggggtgcggtgccgcgcaagcctgatcgagcccgacggcgggcagctggtggacctagtggcgcccgaggagggcgggcggcgcgcggcgctccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatccaggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggagattatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaacttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctgttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattg

SEQ ID NO: 451 - DNA, 794 bp, Hordeum vulgare
caggcttcgctccccacgaatgtcgcgtgcggccaccaaaattttcctgacgccatcgctgctcccactcccacttccccagtggcttcgtaggcggcggccaagcatctcctcagcgaggagagccttcgcgatggcggcgtctggattcggaggcggcgaggcgttcccgctgtcgtctgcggcgggggccggtgcgctgaagctgcacaagggcgacatcaccctctggtccgtcgacggcgccaccgacgccatcgtcaatgctgctaatgaacgaatgcttggagggggaggtgttgatggagctatacatcaagctgctgggccacaacttgtagaagcatgtcgtaaagttccagaggttaaacctggagtccgttgccctactggagaagctagaattactccagcttttgagcttcccgtgtcccgtgtgatccatacagttgggcccatatatgatatggacaggaagcctgaggtgtcattaaagaatgcatacgaaaatagcttaaagctggctaaagagaatggcattcagtacattgcattccctgctatatcttgtggtatttttcgttaccctccaaaggaagcatcaaacatagctatttcagctgctcaacaattttcaggcgatattaaagaggtgcattttgttctgttctcggatgatctgtacagcatttggcgtgagactgcccaggagatgctgatgcaatttgagaaatgagtaactatgatatcagtgtagtatgcacaagttatccagcatgtaatacgaccactgg

SEQ ID NO: 452 - DNA, 6102 bp, Phaseolus vulgaris
cttagcttggaagcaccttagcttcttcactcactcactctctgtgctagggtttcgtttcatcttccattcccattcagaatccgaatctcagcttcctttctctctcgctcgtgtcgtcggaatgtcctcctccagaggaggggcggggccgtcctccgaggcgccgcagccgaggcggatcattcggacgcagactgccggaaacttgggagagtcggtcattgacagtgaggtcgtgccttcctctctcgtcgaaattgcaccaattcttcgtgtcgctaacgaagttgagaagactcatcccagggttgcttatctatgtcgcttctacgcttttgagaaagctcacaggctggatcccaactcaagcggtcgtggtgttcgccaattcaaaaccgcacttcttcaacgccttgaaagagaaaatgacccaactctgaaaggaagggttaagaaaagcgatgctcgtgagatgcagagtttttatcagcattattacaaaaaatatatccaagctttacaaaatgctgccgataaagctgaccgtgcgcagctcaccaaggcatataacacagctaatgttctttttgaggttttgaaggccgttaacatgacacaatctatggaagttgatcgtgagattttggagacccaagataaagttgctgagaaaactgagatcttagttccttacaatattcttcctcttgatcccgatagtgctaaccaggctataatgaaatttcctgagatccaagctgctgtatatgctcttcgtaacactaggggtcttccatggcctaaggactacaagaaaaaaaaggatgaagacattttggattggcttgggtcaatgtttggatttcagaaacacaatgtagcgaatcagagagagcatttgatcttactgcttgctaatgttcacataagacaatttccaaagcctgatcagcaaccaaagttggatgaacgtgccctgacagaagtgatgaagaaacttttcaagaattacaaaaaatggtgcaagtatttgggtcggaaaagtagcctttggttacctaccatacagcaagaagtacagcagcgcaaactactatatatgggtctgtatcttttaatatggggtgaagctgccaacctacgattcatgccagaatgcctttgttatatatatcaccatatggcttttgaattgtatggtatgcttgccggtaatgtcagtccgatgactggagagaatgtgaagccagcttatggaggtgaagaagaagcatttttaaggaaagttgtcactcctatctacaacgtgattgctaaggaagctgcacgcagcaaaaagggaaggtcaaagcattcacagtggaggaactatgatgatttaaatgaatatttctggtctgctgattgttttcggttaggttggccaatgcgtgctgatgctgatttcttttgcctgccttccgaaaactcattttttgataaatctaatgatgacaaaccacctagcagagacagatgggttgggaaagtgaattttgttgagataagatcattttggcacattttcagaagttttgaccgaatgtggatttttttcattctgtgtttacaggctatgattattgttgcttggaatggatctggtgatccaagtgtgatctttaatggtgccgtgttcaagaaggtgttgagtgtgtttataacagcagctatattgaagtttgggcaagctgtccttgatgtgatcctgagttggaaagcacaatggagtatgtcgctgtatgtgaagttaagatacattctaaaagttgtttcagctgcagcatgggtgattgttctgtcagttacttatgcttatacttgggataatcctcctggatttgctcaaaccattaaaagttggtttggaaatggtggttcaagtgctccttcattgtttattttggctgttgtggtttacctgtcgccgaatatgcttgctgcaatattctttctgattccttttattcggcgtcatcttgagaggtctaactatagggttgtgatgctaatgttatggtggtcacagcctcgtttgtatgttggtaggggaatgcatgagagcacattttcccttttcaagtacacaatgttttgggtgcttctcataattacaaagttggctttcagttactatattgagataaaacctcttgtgggacctacaaaagctataatgagtgtaaaaatcacaactttccagtggcacgaattctttcctcatgcaaggaacaatattggtgttgtaattgcactttggtctccgattatcctggtatacttcatggatacccaaatttggtatgccatattctcaacattatttggtggtatttatggtgccttccgtcggcttggggagatacggacactaggaatgctaaggtctcgttttgaatcattgcctggtgccttcaatgccagtttgattcctgaagaagcaagtgagccaaagaaaaaaggattaaaagccactttgtcccgcagatttcccaatatctcatctaacaaggggaaggaggctgcaaggtttgcacaactgtggaaccaaataattactagtttcagggatgaagatcttattagtgatagggaaatggaccttttgcttgtaccatattgggctgatactcagttggaccttatacaatggcccccctttctacttgctagcaagatcccaattgcactagatatggctaaggacagcaatggaaaggatcgagagctaaagaaaagaattgggcttgatacttacatgtcttgtgctgtccgtgagtgctatgcttcatttaagagcattattaagcatttggttcaaggggaacgggagacaaaggttatagagtacatgtttgatgaagtggataaacatatagaatcagataaactgattgttgaattcagaatgagtgcacttcctaacctctgtaaacagtttgttcagctaatagagtatttgttggcaaatgatccaaaagatagggacctagttgtgattctattccaggacatgctggaggttgtgacaagagatataatgatggaggaccaggatcaaatattcagtttggtggattcaacccatggtggtaccgggcatgaggggatgcttcaccttgagcctgagccccatcaccaattgtttgcatctgaaggagctatcaagtttccaattgaaccatttactgcagcttggacagagaagattaaacgacttttcttgctgcttacgacaaaagaatctgccatggatgtaccatctaacttagaagcaagaaggcgtatatctttcttctcaaattcattatttatggacatgcctttggccccaaaagttcgcaacatgctttcattctcggttttgacaccatactatacagaagaagtactattctccttacaagacttagattcacctaatgaagatggtgtttcaatactgttctacttgcaaaagatttttccagatgagtggaacaattttattcagcgtgtgaagtctactgaggaggatattaaagggtgtgaatctgatgagttagtggaagaacttcggctttgggcatcatatagagggcaaacattgaccagaactgtaagaggtatgatgtattacagaaaagctctggaactgcaggcgtttcttgatatggccaaagatgaagatttgatggaaggttataaagccgtagaaaactcagatgacaattcaaggggggaaaggtcattgtggacgcaatgtcaagcggtagctgatatgaaattcacatatgtggtatcatgtcaacaatatggcattgacaagcggtctggttctcgccttgcacaggacatattaaggcttatgacaagatatccgtctcttcgagttgcctatattgatgaggtagaggaacctgtcaaagacagtaagaaaaagatcaacaaggtttactactcttgcttggtgaaggctatgccaaaatcaaatagtgcttcagagcctgagcagaatctggatcagattatatataaaataaagcttcctggaccagcaattttgggtgagggtaagcctgaaaatcagaatcatgccataattttcacacgtggagagggcttgcaaacaatagatatgaaccaggataattacatggaagaagctttgaaaatgagaaatttgttgcaagagtttcttaaaaagcatgatggtgttcggttccctagtatccttggacttagggagcatatatttactggaagtgtttcttccctcgcatggttcatgtcaaatcaggagacaagttttgtgacaattggtcagagattgttggctaatcctttgaaggttcgtttccattatggtcaccccgatgtctttgatagactttttcacctcacaagaggaggtgtgagtaaagcctccaaggttatcaatctaagtgaagatatttttgctggctttaactctacactacgtgaagggaatgttactcaccatgagtacatacaagtagggaagggaagagatgtgggtctcaatcagatatctatgtttgaagcaaaaatagctaatggcaatggggagcaaacacttagtcgagatgtataccgacttgggcatcgttttgacttcttcagaatgttgtcttgttatttcaccacagttggattttatttcagcactcttataactgttctcactgtatatatattcctctatggtcgcctttatcttgttctcagtgggctcgaagaaggtctgagcactcaaaaagccattcgagataataagcctcttcaagtagctcttgcatctcagtcgtttgttcagattggggttttgatggccctgcctatgttgatggaaatcggtttggagaggggcttccgaactgctctcagtgagttcatattaatgcaactgcagctggccccagtattctttacattttcacttgggacaaaaactcattattttggaagaacattgctgcatggaggtgctaaatatagaccaactggtcgaggatttgtggttttccatgctaaatttgctgacaactacagactttactctcgtagccactttgtgaagggtattgagctcatgatactgcttattgtgtatcaaattttcggtcattcttacagaagtgctgttgcatatatcttgattactgcatcaatgtggtttatggtgggtacctggctgtttgctcctttcttgttcaatccttctgggtttgaatggcaaaaaattgttgatgattggactgattggaataaatggattagtaatcgagggggtataggtgttctacctgaaaaaagttgggaatcttggtgggaagaggaacaagagcatctccaatattcaggactgcggggaatcatagtggagatactgttatcattgcgattttttatctaccagtatggtctggtatatcacttgaatattacgaaaaaaggccaaaaaagttttctggtctatggcatttcatggttggtgatatttgtagtattgtttgtaatgaagacggtatctgttgggaggcgtaaattcagtgcaaattttcaacttgtcttccgtctaatcaagggaatgatattcctcacttttgtctcaattctagtcattttgatagcccttccgcacatgacagtgcaggacatagttgtttgcattcttgctttcatgccaactggttggggaatgctgcagattgctcaagcattaaaacctttagtacggcgggctgggttttggggatcagtgaaaactcttgctcgaggttatgagattgtgatgggtttgcttctgttcactccggttgcttttctggcttggtttccttttgtttcagagtttcaaacccgtatgctgttcaaccaagcattcagcagaggtttgcaaatttctcgtattcttggtggccaaaggaaggagcgatcgtctcgcaacaaggaatagttttccaactatgatggcttagtattcggatgtaccaattgtaagtagttgtaacttgtaacttgtatctatgaatgacagattctacacttcgctttcat

SEQ ID NO: 453 - DNA, 2337 bp, Phaseolus vulgaris
ggaagtaaggtgaagaaaatgtggaggctgaagataggagatggaggaaagaatccatacatatttagcacaaacaattttgtaggaagacaaatatgggagtttgattctgaagcaggaactgatgaagaacgagcccaggtggaagctgctcgtcaacatttctatcaaaatcgctttaagctcaaggcttgtggtgatcgactatggcgatttcagattttgagggaaaagaaattcaaacaaaaaacaaggaaagtgaagatagaagatgatgaagaaataacatgggagaaggctactctcaccctaaagagaacctctcattacctgtcggcactgcaaactagtgatggccattggcctgctcatctcgggggttcccactttttcattcctatcatggtcatttctatctacagcacgggacatcttgattttgtacttccgaaagaatatcgtaaagaaattctccgttacttatataatcatcagaacgatgatggagggtggggattacacatagagggtcctagcacgatgtatggtaccacactaaattatataagtatgagacttctcggagaaggagctaatggaggtcataacaatgcttgtgttaaggctagaaaatggattcatgatcatggcagcgtaacacatgtgccttcctggggaaaattttggctttcggtacttggtatagttgattggagtggatgcaacccattgccgcctgaattttggatacttcccactattctccccatgcatcctgctaaaatgtggtattattgccgacatgtatatatgcctatgtcatatatatatggaaaaagatttgtgtgtccaatcacaccattgattagagaattaagagaagaactctttattcaaccgtatgatgaaagtatttggaagaaagcacgtcacaaatgtgctaaggaagatctctattatccccatcattggatacaagatctaatatgggatagtgcttatttagttactgagccacttcttacacgctggcctttcaataagttgattagagaaaaagcacttcaagtagcaatgaagcttattcactatgaagatgaaaatactcgatatatagatggtggttgtgtgaacaaggctctgtctatgcttgcatgttgggtagaagatccaaatggagatgcttttaaaaagcacgttgcaagggttccagattatttatggctttcagaagatggaatgtgtatacatggacttagtacgcaatcatgggatgctggttttattgttcaagctcttcttgctactaatctaattgatgatgttggtcccacacttgcaaaagcacatgattttatcaagaaatctcaagtagtagaaaatcgttcaggagattttaagagtatgtttcatcacatatctaaagggtcttggacctttgctgatagagaccatgcattacaactttctgatggcactgcagaatgtatgaagtgttgtttacttttatccatgttaccagaagagattgtgggagaaaaattggaacctgaaaggttatatgattcagtcaattttttattgtcacttcagagtaaaaatggaggtgtaactgtgtgggagccagcaatagctcaaaagtggttggaacatctgaatcccgcggaatttctggctgacatagtaattgagcacgagtatcttgagtgtactggatcaacaattcaggctttagtgttgttcaaaaaactatacccaaatcatagaagggaagagatagataatttcattgtcaaagcagcacaattcatcgaagatgaacaattaccaaacggaaattggcatgggaactggggagtttgcttcacttacggtgcctggtttgcagttggaggtttagctgctgctggaaagtcttacagtaattgtgttgccattcgtaaagctgtgaagtttctactctcaatacaaaatgaggatggtggttggggagaaagttatctttcatgtccaatgaagacgtacgtgcctcttgaagggaatcgatcaaatgttggtcaaacagcttgggctctactagctttgattcttagtggtcaggctgagagagatccaactcctcttcaccgtgctgcaaagttactcattaattctcagttagaagatggtgattggccccaacaagaagcattgggggtgtacaagagaagttgtttgcttcattacccattctatagaactgtttttccgttgcaggctttgtctgaatatcgtaacaatgttttagtgccatctacttgagaaactgtaagctcaaaacaacaatgtcaaacctag

SEQ ID NO: 454 - DNA, 974 bp, Zea mays
tctctatggcgcgcctgctcctcttcccatcccaagcgtgcgtcgatcctggccgccacctcctcctccacccgccggtctccaggccccgtgctgtccggtctgggcctcctcccgccgcgccacgccgcaccggggtcgtctctcttcccggccgttgcccaccgcccctttgctggaaccaccatccatttcttccttgcagatcatcaaagagaggatgggtcgtttttgcttcagaaaacgtacaagaaatttcttctcaccttcctcgcaaggatgaaaggagaagtgggaatttgcttctgcgattcagtgcactcccatattgcactatggcttggttgagcactgctcaattagcacaatctagtgttggggaaaagctaaatatggtttatgaggtcggggagctgtttgagctgggaattcagctgtcttatctgctcatacttattggactgcttggagctggtacattttttgttatccgtcaggttcttgttcgtagggagcttgatctttctgccaaagagttgcaagaacaagtgagaagcggtgatgcaagtgctactgagtattttgagcttggagcagtcatgctacggagaaaattttatccagctgctatcaaatatctgcagcaagcaattgacaaatgggacagagacgagcaagatcttgcgcaggtctacaatgccctgggggtcagctacaagcgagagaacaaacttgacaaggcgattcagcagtttcagaaggccgtggagctccagccaggctatgtgacagcttggaacaacctgggtgacgcatatgagcagcagaaggacctgaaatcggctctcaaggccttcgaggaggtcctcctctttgatcccaacaacaaggttgcaaggccacgcgtcgatgacctcaggccgcgcgtgagcatgtacaagggtgtgcctgtaaaatccgaaaagcgatagtag

SEQ ID NO: 455 - DNA, 2809 bp, Zea mays
tggtagatacaggtctgggattgccttttcctagttcaacatggagggcgctcttgttcagtctgctattgttccagccgtttacagaagcagctcaggtcggttccgtgtgcgtgcaagggccagaacaaatgctacaatggtgcggaatacgccaacaaggactcttactcttggtggcttccaagggctgcgtcagacaaactttttggatacgaggtctgtaattaagcgtgactttggatcaatcgtggcaagccagattgcaaggccacgcgggtcagcctcaagaggggtggtccgtgccatgtttgagcgcttcactgagaaagcaatcaaggtgattatgcttgcacaggaagaggcaaggcgcctgggacacaacttcgttgggacagaacagattttgctggggcttattggtgagggcacaggaattgcagcgaaggttatgaagtctatgggaatcaatcttaaggatgcccgagtggaagtcgaaaagataattggacgtggcagtgggtttgtggctgttgaaatcccattcacacctcgagcaaaacgtgtattggaattgtcccttgaagaagctcgtcagcttgggcataattatataggatctgaacacttactccttgggctacttcgtgagggtgaaggtgttgctgctcgtgtgcttgaaagccttggtgctgatccaaacaacatccgtacccaggtcataagaatggttggggaaagcacagaagctgttggggctggagttggtggaggaagcagtggccagaagatgcccacacttgaagaatacggtactaatttgacgaaattagcggaagagggcaaattggacccagttgttggtagacaggatcagattgagcgcgttacccagattttaggcaggaggacaaagaacaacccctgcttaattggagagcctggtgttggaaagactgctattgctgaggggcttgctcaacgtatttccaatggtgatgttcccgaaacaattgaaggaaagaaggttattactcttgacatgggcctccttgttgctggaaccaaataccgtggagagtttgaagagagattaaagaaacttatggaggaaattaagcaaaatgaagatattattctctttattgatgaagtgcacacactgattggagcaggtgcagcagaaggtgcgattgatgctgctaatattttgaagccagctcttgcaagaggtgaactgcagtgcattggtgccacaacactggatgagtataggaagcatatagagaaagatcctgccttggaaagaaggtttcaaccagttaaggttcctgagcctactgttgatgaaacaatacagatcttaagagggctccgtgagagatatgaactccatcacaaactgcgatacacagatgatgctttaattgctgctgcacagctgtcttatcagtatatcagtgatcgtttcctgcctgacaaggccattgacttgattgatgaagctggatcccgtgttaggctgaggcatgcccagctccctgatgaagccaaagagctggacaaagagctgcgacagataaccaagcagaaaaacgaggctgtacgcggccaggattttgagaaggctggtgaattaagggaccgagaaatggaactgaaggctcaaattacggccattattgacaagagcaaggaaatgattaaagcagagactgaatctggtgatgtcggtcctcttgttactgaggcagatattcaacatattgtctcctcttggactggaattcctgtggagaaagtgtcgtctgatgagtctgaccgtctcctaaagatggaagagacactgcatacacgtatcattggccaggacgaggctgtcaaagctattagccgtgctatccgccgtgctcgtgttggcctgaagaatccaaataggccaattgccagcttcatattctctggaccaactggagttggcaaatcagagctagcaaaggctctggcagcctactactttggctcagaggaggctatgattaggcttgacatgagtgagttcatggagagacatactgtctccaagcttattggatcacctccaggttatgttgggtacactgagggaggccaactaactgaagcagtccgtcgccgcccatacacagttgttctctttgatgagattgagaaggcacatcctgatgttttcaacatgatgcttcagatattagaagatgggcgattaactgatagcaaggggcgcacagttgacttcaaaaacacactattgatcatgacatctaatgtgggaagcagtgtcattgagaaaggaggccgcaagatcgggtttgaccttgactatgatgagaaagacaccagctataacaggatcaagagcctggtgaccgaggagttgaagcagtatttccggccagagttcttgaacagattggatgagatgattgtattccggcagctgactaaattggaggtgaaggagattgctgacattatgctgaaagaagtgtttgacaggctgaaggccaaggagattaatctccaggtcacggagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtgatagtcctgaatggtggtagcggtgttgctgagccactggaacctgctctcagtacctaataa

SEQ ID NO: 456 - DNA, 2127 bp, Zea mays
atcgccatttcggatccgggcccgctcagcgcgcgggttcccgaacccggccggccggccgcgctcctcgccaccgccgccgccggccatgaagcgcgcgcgcagctccgaggtattcatcggcgtaggccggctgcgcgcacgcaggggcctggcgccgttcctcgcagcggcggctttcgcctacctactgttcgtgtccgtcaagctcacttacctcggcagcgctgggcccgcgcctgccttcggccgcctggacaccaccggcgcgggcgagccagctgcgcgcgcgcgctcgagcggcggcggggccgtgtccgggtacggccgcatcaccggcgagatcctccggcggcacgaagccttcgaggagcggcggaagcggttggggcagctggggaacttcacggagctcgagcgcgtggcggccgaagcgtgggcgctcggggccgccgcgtgggaggaggcctctgcgttcgacggcgacgtcgactacatcgcctcccgcgacgtcgccggggagggcacggccaagtgcccaggctcgctcgcgctcggcgccggggagaccacggcgttcctgccgtgcgggctggccgccgggtcggcagttaccgtggttgggacagcgcggccggcgcggccggagtacgtcgaggcgctggagcggagcggcacgggcaacgggacggtgctggtggcgcagttcgcggtggagctgcgcggcctgcgcgctaccgacggcgaggagccgcctaggatactgcacctcaacccgcgcctgcgcggcgactggagcagccgccccgtgctagagatgaacacctgcttccgaatgcagtggggcagggcacagcgctgcgacagtaccccttccggagacgatgacctggtcgatggactaagaaaatgtgagaaatgggactggcaggacgtagttgaatcgaaagaaacaaagacaagctcatggttcaacagattcatcgggcgagcaaagaaaccagaaatgagatggccattcccattttcagaggggaagatgtttgttctcactatccaagctggagtcgaaggataccatatcaatgtgggaggccgccacattgcctcatttcctcataggatgggattcgccctcgaagacgcaacaggtttagccgtgacagggggcataaatgttcactctgtgtacgcaacagcgcttccaaaggcacatcctagcttttctctccagcaagtcttggaaatgtctgaaaggtggaaggctcgcactgtgccagaggaaccaatccatcttttcatcggcatcctctccgccacaaaccatttcgccgagcgcatggctattaggaaaacttggatgcagtttccggctatccaatcggggaatgcggttgctcggttctttgttgcgctgagccacagaaaggagataaatgcagcactgaagaaggaagcagagtattttggagacatagtcattctgccgttcatcgaccggtatgagctagtggttctgaaaacggttgcgatatgtcaatacggggtgcacaatgtcactgcagattacatcatgaagtgcgacgatgacacctttgtgcggctggatatagtactgcaccaaatcagtacctacaacaaaacctcacctctgtatctgggcaacctgaatctcttgcacaggcctctaagaaggggcaaatgggccgtcacctacgaggaatggccagaagcggtgtatcccccgtacgccaatggacctgggtacgttatctcggccggcattgcgagagacgtagcatcccggcatacaaaccactccctacggctgttcaagatggaggacgtgagcatgggcatgtgggtggaggactacaacgccagcgcccccgtgcagtatgtccacagctggaggttctgccagttcggctgcgtggacaactacttcacggcgcactaccagtcccccaggcagatgctgtgcctctgggagaagctgtcagcggggagagcgcactgctgtaactacagataacatgaggcccccaggggggaaatggtggcctagccgcctaggtgcacagaccttcgttccattcgcctggcttcggtagttcggttccatac

SEQ ID NO: 457 - DNA, 3095 bp, Zea mays
gcagcagggatctctaccgggcatggagctggcgctcgcctccgcgaagccctcgcctcgggcggcgggggccttcccgccacttatcttctcgccgcttaaaccattcccgctcctccgcttcccgccgcggaggaccgcagcggcggcgctgcggctccggctccggctccgcgcggctgccgctgacgcgggcgagacttcccctggcgaggaggtgttcggcgcgcggcgggagctaacgggcatccagccgctggtggaggcgctgccgcccgcagcgcggacggcggcggaactggccgtcgccgcggcagccgtggcggcgggatacggcatcgggctccgcgcgggtggcgggtcgcgcgccgtggcggtggcgggggcggcagtgctctgcgcggccagcgtggcgggagcagctgcggtgaactccgtggtcccagaggtcgccgccgtggggctgcacaattacgtcgcgggccacgacgaccccaccaacctggacaacggcgaggtggaggcaatcgcgaagaaatatggagttagcacacaggatgacgccttcaaagcagagctctgtgacttgtatgccaggtatctttactcagtacttcctccaggagatgaagatctcaaaggtacagaggttcaggcaattataaaatttaaaagtgctcttgggcttgatgatgtagatgctgctaacatgcacatggagattggtagacgcatatacagagagaggttggaaacgagtgatcgtgatgctgacatggaacaaagacgggcatttcagaagttaatttatgtgtccaatcttgtctttggagatgcatctgtattcctacttccttggaaacgtctgtttggggtgactgattctcagattgacattgctatgagggaaaatgccaagaatttatactcggtgcagctcaagtctattggaagaggtcttgacataggcacactcattgaagtaaggagagcacaacttgcatataaactttctgatgagattgctgctgagatgttccgtgagcacgcgaagcagctagttcaagaaaacatttcatcagcattagacatcttgaagtcacgtattccggatagtctaactcaggctgtggaagaagtgaatattgtaattaaatttaatagtttgcttacaacattaagcaaacaccctgaagctgataattttgctcgtggtcttggccctatttcattagctggagaggatgatcacgataggagagctgatgatttcaagatactctataaggcctatgctacagaagtactttcagatggaattgtggatgataagaagctttcccctctgaatgaactgagaaacatatttggactggggaagcgggaagcagaaggaatcttatctgatgccaaagctcacatatacagaaggacacttgctaaatcatttaacactgaattagcttcagtccctagcaaagcagcatttctccaaactctttgcgaaaagttacagtttgatcctgaactggctagtaagatgcatgaagaaatttacagacagaagcttcagcagtttgtagctgatggagagctgagcaaggaggaagtggaagctctgatggcattccaagtgcgtctctgcatccctcaagaaactgtggacgctgcacatactgagatttgtgggcaactgttcgaaaaggttgtcaaggaagccattgcatctgttgacggatataatgctgatagacgtgaggctgttaggaaggcagcacaaagtctaaacctgaaaacggaggctgtcatgacgatctttagtaaagcagtacggaagttattcttgagctacattcagagagcaaaagaagctggaaaccgcattgaaactgcaaaagaactgaagaagttaatttccttcaacatagttgttgttaccgagcttttagctgacattaaaggagaactatctccagttgctgaaactgaagcatcaagtgcagctgcagaatctgaaggagaggatggtgaacatgaatgggaatcattggatacactgaggaagactagacctgataaagagctcaaagaaaagctgagaaagtcaagccagaaagagataactctcaaggatgacattccattgagggatagggctgagctgtatgaaacgtacctgatgttctgcatcactggggagactactaatgtatcatttggaacagctatctctacaaagaaagatgattcagagtttttaatgctaaagcaattgggtgacatacttggtttaactcgcaaagaagctcaagatgttcacattaagtttgcagagaaagcttttgtgcaacaggcggaagtaattcttgctgatgggaaattaacagaggctaaggctgaccagcttgctaagattcaaaagcaggtcggtttgcctactgaacatgcacagaaaatcattaagggtattacaacgacaaagttatcttctgcaattgaagcctctgttgctcggggtcagatcggtatacagcaggtccgaggattgaaggaagcaaacttccaactagatagcttgattgtggagccgcagcgagaaagcatttataggaaaactgttgaagagctcttttcttcaggtacaggggatttcgatgaagaggaaatgtatgtgaagattccagctgatctcataataagttctgagaaggccaagtcaattgtacaggatattgcaaaggttaggttggagaactcccttgtccaggctattgcgttgcttcggcagaagaagagagatgatgtgctttcatctctgaatgacatgctcgcatgtgatgctgcggtccctgcatcacgacccttgtcatggcccacaccaggagagctagatgatctatttgccatctacctgaagagcattcctaagcctgagaagctatcaaggttgcagtacctgctcggcattagcaacgagaaggctaacgagatgcagtacgcagcctcggagggatcgctgccggttgcagctgaagagaaagaggagttggcgttctaggaagggagacagttttgttagggtagccaccggagtt

SEQ ID NO: 458 - DNA, 1581 bp, Zea mays
aatcgaagcaccgaaccagcggctgcggcagcggcggcggcgcggcaagggttgaccatggcggagctaaagcggttgtcggagagccgtgacctgacgcggattgagcgcatcggtgcgcactcccacatccgggggctagggttggactcgtccatggaggcgcgcgatacctcggagggcatggtcgggcagctccacgcgcgccgcgcctcggggctcatactccagctcatccgccagggcaagattgccggccgcgctgtgctccttgcgggccagcccggcaccggcaagaccgcgctcgccatgggtatcgccaagtcgcttggtgcggagacacccttcgcctccgtcgctgcctcggagctcttctcgctcgacctctccaagacggaggctctgacgcaggccttccgccgcgccataggcgtccgcatcaaggaggaggccgagatcattgagggcgaggtcgtggagatctcaatcgaccgccctttgtcggcctctggcgttggcggcagctcagttgctccttctggtgcaactgctgctggtaagtcagggcggctcacgctgaagaccacggacatggagactgtgtacgagctcgggggaaagatgattgaggctcttgggaaggagaaggtgcagagtggagatgtgattgcgcttgacaaggcctccgggaaggtcaccaagcttggccgctccattgggaggtcgcgggattatgatgccgtaggtccacacaccaagtttgtcaagtgtcctgatggtgagctccagaagcgcaaggaggtcgtgcactgtgtcaccttacatgagattgatgtcatcaatagcaggacacagggttttcttgcactgttcactggtgacactggtgaaattcgtgcagaggttcgggagcagattgacacaaaggttgcagagtggagagaggaaggaaaagctgatattgtccctggtgttctgttcatcgatgaagtccacatgctagacatcgagtgcttctccttcctcaaccgcgcattggaaaacgacatggcgccgatcttagtaatcgcaacaaaccgagggatcacgtctatccgtgggacaaactaccgctcgccgcatgggatcccgccagacttccttgaccggctactgattatcacgacgcatccctacacggaggatgagatccggaagatcctggatatccggtgcgacgaggaagacgtggagatgtccgcggacgctaaggttctgctcaccaagatcggtgtggagacctctctgcggtatgccatcaaccttatcacatctgccgcgctagcctgccagaggcgcaaggggaaggtggtcgagatggaggacattagccgggtgtaccagctgttcctggacgtgaagcgatcgacgcagtacctgatggagtaccagagccagtacatgttcaacgaagtgccggggcaagcagatggagaggacgccatgcaatcgtagatgaactttcctttacatggtgtgtgtgggttatagtatgtaccgcgtggcgtatatttatgatgcgtctttcttgttcaggttgct

SEQ ID NO: 459 - DNA, 1300 bp, Zea mays
cacattccgtttccattcgcgcggcccgcgccgcctccctcctcgaggccactcgcttcctctccaccccgcacccacgctcgcgctcgcgcccgctccctttcccgcccggcagcggcctacacccccacctcctcaggacccctcgcctctccactctccgcgcccacctccaccgtcccgctcctctcggcgcgcaggagccggcgaggcctggcgcgctcctggtcgtcgacgcgctcaggaggtccgtgctcgagtccctcgcggcgctcaagcggcccgcgctcgcgctcctcctggccggtgtgctgctcgccgcggcatcggcgggcgggccgcacgcggcggcgctggccgcctcgggcgggcgcgtcggcgggtcggccttctcctcgcgctcctcctcgcctcgatcctacgggtacagcgcgccggctcccaggggcgggtacacggccgctcccttctactctccttcgcccttcgtatccgtcggcccagccctcggcatcggcttcgggggatcggggttcctcgtgaccctcatgggtttcgcggctttcctctacctggccgggttcctgtccgactcgtccggcgctaccagtgtgctcacagagacggagaagaccaccgtcctcaagctacaggttggcttgctgggcatggcacgatcatttcagaaggagcttgatcaaatagctgagaaagcagatacatctaccccagctgggttgagctatgtgttgacagagacaacattggcattacttcggcatccggactgttgtatctcagcttactcatcggtggatgtgaaacgaagcattgataatggtgagaaacgtttcaatcagctttcaattgaggagaggggcaagtttgatgaagagacacttgtgaatgtgaacaacatcaagaggaataaaggaggcagccaaagatcaagtggttttagcaacgagtacattgtgataaccatattggttgctgctgagggagtacataaggtgccggttataaatagcagcaatgacttaaagacagctctacaaaagatgggtgccataccatcgcgcaaaatactggcagtcgaggtcctatggactccacaaaatgagaatgacactttgtcagagcgagagctccttgaagattacccgctcttaaggcctctgtagaaagaagctgctgtagattcagttttggcggttttcttattaactatagcgcagatcttgtgtttgtataaaagtgtataatttgttattgacgtcactgttagccttcatatcag

SEQ ID NO: 460 - DNA, 661 bp, Zea mays
gttcaacagaggaagaagcgagagagctgacaagaatcgactgccatcaatggctctggcgccggcgcctctccagtgcttcctcacgagcagcagaccggccgtatgcacggcgacgccgcccaataagcgcgcgaggaggccgtcgaggatctcgtgcagggcgtccggcgatgacaaggacaaggtcccgtcgtcgggagggagcgatcttggggtcaagcagctcgggaagctggccatggtcgcgctggccgccggcgtgctggtgctcggccccgtcgacggtgccgtggcggccaagtccggcggcagggtcggcgggcaggcgttccggtccgcgccccggtcgtccggccctcggatcaacaactccaggaccaacatctacatcaacccgccggtggcgccgccgctgggcggatacgggtacgggagcccgttcttcggcggctacggctacggctggtcgccgttcagcttcttcgcccccgggccgagcgtcgccgtcggggtcggcggcggcttcgacacgctcgtcctcttcttggtgctgggcgccgtcgtcggagctgtcaggcggttcctcaacaggaacaacgacgattacgacgactactgattatcagtgccaggctcctgctacgtacttcacctttag

SEQ ID NO: 461 - DNA, 1520 bp, Zea mays
gtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattggacctaggaggaacgaatttccgcgtcttgaaagtgcaactaggtgggaatgcgaagcatgtcgttgaccgtgactccagagaagtcggcattccgccacatctgatgtcagggagctcctcggagctttttggtttcattgcttctgaattggccaagtttgttgacgatgatgagaagtgcgctaacatttcgaatggcaagaagcgagaaatagggttcacgttttcgttcccagtgaagcagcgttctgtagcttccggtacgcttgtcaagtggacaaaggcattttccattaatgatgctgtaggcgaagatgtggtggctgaactgcaaacagccatggagaagcaaggtctggacatgcatgtagctgcattgattaatgatgctgttgggacgctggcgggagcaaggtactacgacaaagatgttgtcgctggtgtaatatttggcactggcacaaacgcagcatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggactccacatatttcagcaatgcaccatgacgaaacatctgatctgaagattgtggccgaaaattttgaagaaaacctagagattacaggcacatccttggaggctcgtaagctggtcgttgaaatctgtgacattgtggcgacaagagcagcccggctggctgctgcggggcttgcagggatcctcatgaagatcgggagagatcacagcgtcgaggaccaacggtcagtcatcgccatcgacggaggactgttcgagcactacaccaaattccgccggtgcttggagaccacactgggtgagctgctaggagacgaggcgtccaaggcggtggccatcaagcatgccgatgacggctcaggaataggtgctgccctgattgcagcttcacagtctcagtacaaaaacgacttagtggccgtcaagcatgcagatgacggttcaggagtcaagtatgcagaagacaagcgtgcagatgacggatcagaaataggtgctgccctgattgctgcctcgcaatctcagtagtag

SEQ ID NO: 462 - DNA, 5023 bp, Medicago truncatula
gaggctagaattgctcttgaaatcttgaaaaagtgccaaaagggtattgtgagagaaaaaaaaatggccccaaaatcagggaaaggaaaaacaaataaagctaagacagagaagaagaaaaaggaggagaaagcagtggcaccttctcttgtagacattattgtggtaactccttatgattctcaaattgtattgaagggtatctctactgataagatacttgatgtgaggaagctattggctgtgaaggtggagacatgccattttacaaactattctttatctcatgaggttaaaggtcagagattaaatgacagagttgaagttgttaccctaaagccatgtctactaagaatggttgaagaggattacaatgaagaatctcaagcaactacacacgtgcgaagactattggacataatagcctgcacaacaaaattcggaaagcccaaacgcaacattccaggcccagactcatcaaagcccaagaaaaacggaaaagcccataatcaaaacaagagcggtttgagcccacccgtaacacccaatggagaaactcgggtcgggtcaccgatgtcggagccaccggcatctccgatttcggagaatgtgggaatggtggcgattcatccgacgccgaagttatcggatttttatgaattcttttcgttttcgaatctcacccctccgattttgcatttgaagaaatgtgagctgaaggtagaagatgatagaggcaaaggagattactttcagcttcaggttaaaatcagcaatgggaaagtaattgaagtggttgcttcagagaaaggcttttacagtgttggaaagctgtctctacagagtcacacattggttgatcttcttcaacagcttagcagaggttttgctaatgcttatggatcattgatgaaagctttttcggatcgtaataagtttggcaatattccatatggactccgatcgaatacatggctagttgctccatccattggtgaatctctttcaaactttccagctctacctgctgaggatgaaaactggggtggcaatggtggtggccagggaagaaatggagaatacgaacgtcgaccatgggcaacagattttgaaatactggcttctcttccttccaaaaccgaggaggagagggtgatcagggatcgaaaagcttttctgcttcataatcagtttgttgatacatcgatatttaaggctgttgcagctatacagcatgtgatggagtccaagtctgctattaattcttctccaggttctgttctgcatcaagatcaagtgggagacttatccattgtagtcgaacgcggtggaaatggaaagtttgattctatactgaatgaatccagtaagcataatgacgctgttcagaagaatttaatcaaagggttgtctgcagatgaaagtgtcactgttaatgacacttcttccttggctgttgttgttgttcaccactgtggatatacagctacagtaaaggccattggtaattcgaacgcaaggaaacctaaagttcaggatatcgaaatagatgatcaactagaaggaggcgcaaatgctcttaacatcaatagtttgagggtactgcttcacaaatctggagctgattcatcagaagtgactttgacgtccttgtcaaattttgatgacttggatgcttctaaagatcttgttaggaaggtggttgaggaatccatcgaaaagataaaggaagagccaagtgtttcaaaacggtcgattcgatgggaacttggttcttcttggatgcagcatctgcaaaaacaggaaaattcaaccgatggcagttccaataacaaggatggaagtgatgttgagccagctgtgaaaggtcttggaaagcaatttaaattattgaagaagagggaaaagaaaccaagtgacttaaatgctgcagattctgtggagcaaaataacgatgagccaaataatgatgaaccaagtagtttgaatgaattagagaaactactttctccagaagcctttttgcgtctcaaagaatccggatctggtcttcatatgaagtcggtggatgagcttataaacatggcacacaagttttatgatgaaattgccttgccaaagctggttacagactttggatcacttgaactttctcctgttgatggtcgtacactaactgatttcatgcatttaagaggattaaagatgggatctttgggtgaagtggttaaactttcggagaatcttccacacatacaatcactttgtattcatgagatgattacgcgagcattcaagcatctacttaaagcagtcattgcttctgtagacaatgcagcagatttaccttcagtcattgcatcgacactgaattttttacttggagggtgtcaaactgaagatacagaccaaactttgggtgatgatcatcatctcaaaattcattggttacgtatgtttttgtcaaaaagatttggatgggccttaaaagatgaatttcaacatttgagaaagttatctattctcagagggctctgtcacaaggttggattagaattgctccctagagattatgacatggagtcccctaagccctttggaaagtatgatattatcagccttgttcccgtttgcaagcatgtgggatgctcctcaatagacggacgcaatttgttggaatcatcgaaaattgctcttgataaaggaaagcttgaggatgctgttagttatggaacaaaggcattagcaaagatgatgactgtttgtggtccatatcatcgaaatactgcaagtgcgtatagtcttcttgctgtggttctctatcacacaggagattttaaccaggccaccatttatcagcaaaaagcgttggatataaatgagagagagcttggacttgaccatcctgacacaatgaaaagctatggggatctttctgttttctattaccgtctgcaacatattgagctggctctgaagtacgttaatcgcgctctcttcctcttacatttcacatgcggtctgtctcatccaaatacagcggctacatatataaatgttgctatgatggaagaaggcatgggaaatgttcatgtggcacttcggtacttgcatgaagctcttaaatgcaacaaaagattgttgggagcagatcatatacagactgctgcaagctatcacgccatagccatagcactttcattgatggaagcatattctctgagtgtgcaacatgagcaaactacacttaagatacttcaggcgaagcttggcgcagaagatcttcgaactcaggacgcggctgcatggctagaatattttgaatcaaaagctatagagcagcaagaagcagctaaaaatggaactccaaagacagatacatccattgcaagtaaaggtcaccttagtgtgtcagatctcctggattttattagtcctgacaacgattcaaagggaaatgatgctcaaaggaaacaaaggcgtccaaagatacttccaataagtgataacaattctcaagaacacgatgacactccaattgttgatgatgtcgttattgttgacaatgcaaaagatgccgcaatagcagtagaaggcaaaatagaagaaacaaaaggcaaacatggaactgaagaacccaaaaaaattgttgatctcagcatgcacaagccagtggtgacagttgaagctgtttatgagacatcatctgatgaaggttggcaagaagccaattcaaaagggcgttcaggtaacgctgctaatcgcaagtctggacgcagacaacggcctcttctatcaaagctcactgttaacggttctgataatcacatgtacaaggaagccagttacaggaatgacactaccctgcaccaaaaagcagctccaaaagtagcttcagctatgttatctccatctagaaaatcaaaaaccccaaaagctttgtcatctaaaatttcatcaactccagcatcattgagttctttggcctcaaagtctatatcttacaaagaagtcgctgcggcaccaccaggtacagttttaaagccactgttggaaaaaaccgagacagaaaaggtaaatgatgaaaatgagatgccgaaaaatgaaggttctgtcgaaacttccaatgctgatacagttccacaaaaagttgaaaaagaaccttctgatgctgatacagatccacaacaagatgaatctgaacaagataactcttcgtcagaacttgagaaggtttccccttcatctgatcaagcaaaatcttctgaaacaaatggaagcaagctttctgctgcagccaaacctttcagtccaggaacgttgtccgcatctcgccatttaaatccagttcctctcgcgagcatatacgatgcaaatgtgagtcaaggcattcttgtagagcctgttcttcctcctgctgctgccagggtcccttgcggccctagatcaccgttgtattacagaaccaattatactttccgcatgaaacacagttcgaccaagataagggaaataagcggatcaggtggtccaaaaattatgaatccacatgctcccgagtttgttccaagaagtgcttctcaaatagaaattagtgaaaagaacagtacttccaaaaacagtctttctgaatccgagaagtcagagatagcgaggcagatattgctgagttttctagtgaagtctgttcatcaaaatgctgatgccgtggatgagcctaaagttagtgaaggaaaagttgagagctttgaaaactcttctgatgaagtagctaaagacagtgctgtcataaaaataatgtatggtactgatgaaaagaataaggcagtggttaattccagtgatgacagtgaagagcaggacaatttagatggtgaaggatttgtagttgtcacaaacaggagaaaaagcaggcaaaaaaccacgaatggagttgctgaattgtacaaccagccgtcaatttgtgcttcggttcgttgattagagtcatgaaatgaatcaccaatgatccaaatttgtttgc

SEQ ID NO: 463 - DNA, 803 bp, Medicago truncatula
actaaatggcaaccaattctcttcactcaattcaacatcattctctcagcaaacgccactactacccttctgaaactgctcctccatccacactttcatcctcacttttcctcaaaccaaccaccatcaaccccaccaacataaccctctcccactcttcctcttccaactcctctatcacattttctatctcccaaacaacatcctccacaccatcatcaacctctcaaaccagctcctttgaactcctccagcagcatctctcagccaaaaacttccgagaagccgacgaagagacaagacgtcttctcatcgttttagcaggcgaagcagctcagaagcgcggctatgttttcttctcagaggttcagttcatctcagaagaagacctcaaaacaattgaccagctgtggagagatcatagtgacaacaaatttggatacagtgtccaaaagaaactatttggtaaggctaaaaaagacttcaccaagttcttcatcaaggttggttggatgaagaagcttgacactgaaatggagcaatataactataggtcttttcctacagagtttatatgggagctcaatgatgacactccagagggtcatttacctctgacaaatgcactcagaggaacacagttgctaagctatatttttaaccatccagcttttgattcagtcccagacgaagttgaagtttcatttggcagcactgagggaaatggagcactcaaagggttaaaagattcatctaaaccattggctaccaagatcttcaaaacagactatagtttctgatga

SEQ ID NO: 464 - DNA, 1211 bp, Medicago truncatula
cagaaatggcagcaacattgcaaactccgctctatgcagctatctcctcttctcctgcatcatcatcatcatcatcatcttccattcgaacaacaacatcattctccttcttccgttctacaccgccaccaactctcctcttcaactccaaaaactccttctctttaattcgcgcttcctccactgacactgttatcactgaattggatgctgtttccgctttcagtgagatcgttccagataccgttattttcgatgatttccaaaagtttcctccaactgctgctactgttagttcatcactgattttggggatatgtggtcttccggatactatttttaggaaggctgtggaaatggctttggctgattctgaatgttatggacttcaagatcctaatgcaagattatcttgtttcgccaccaaggctttagtgaatgttggtagtgacatgacaaagcttgtccctggccgtgtttcaactgaagtggatgcgcgtcttgcttatgacacacatggcattatcaggaaggtgcacgacctgttgaagttgtacaatgatagtaatgtccctcatgaacgtctgctatttaaaattccttcaacatggcaaggaatagaggctgcaagattgctggaatcagagggcatacaaacacatttgactttcgtttacagctttgcccaagctgctgctgccgctcaagctggtgcttctgttattcaaatttttgttggccgcgtcagggactgggcgcgtaatcattctggtgataaagagatagaatctgccaagctaaatggagaggatcccgggctggcattggtcacaaaggcttacaattatattcaccaatatggacataagtcaaagttgatggcagcagcagttcgtaacaagcaggacctatttagtcttctgggggttgactacatcatagctccattgaaggtgttgcagtctctcaaagaatccgttgcttctggtgatgagaagtactctttcgctaggaggttatcaccgcagtctgctgaccgctacatgtttagtgatgaagagcttgttaaatgggaccaaatgagccttacaaatgccatggggccagcagcagtgcagcttctgacttctgggctggatggttatgctgatcaagcaaagcgggtggaagatttattcgggaaaatttggccaccaccaaatgtataataa

SEQ ID NO: 465 - DNA, 1796 bp, Oryza sativa
atttccactttcgccaaacctcgcggccgtcgagctccgccgccggagaaaaagatggccgacgacagcgcctccccgtcgccgtcctcggcctcgccgctccagcaccaccgcgaagccctcaagtcgtcagtgcgcaacacggcagctagccggaggcgggaacaagctattgcgattgggaaggaaagacgggaagccttgatccgtgcaaagcgtgtgtgtcgagctccaatttctggcagtgatgaagctgaaatggaagagggtgatatggtggtcgatgaggagaaagcatgtcttgaggcaaagactgctcatgctgttgaagaattgaaatctgctttgtcaatccaggggaaaggcgttcagaagaagaagatagaggcgcttcgtgatttgagacgcttgttgtcacagcctgaagtacctctagttgatactgcaattaaagctggagcagtccctcttttagtgcaatatctatcctttggatcatcagatgagcagttgctagaggcagcttggtgccttacaaacatagcagctggggaaccagaagaaacaaaatccttgctgcctgctctaccattgcttattgctcaccttggtgaaaagagctccacacttgttgccgagcaatgtgcatgggccattggtaatgttgctggtgaaggagcagagctgagaagcacattacttgcacaaggtgctttgcggcctcttacccgtttaatgttctccaataaaggttctacagcaagaactgctgcttgggctatgtcaaatctcatcaaggggcctgatccaaaggctgcaaatgagcttattaccattgatggcgtgctaaatgcaattatagcgagcttggaaaaggaggacgaagagttagcaactgaggtggcatgggttgtggtctatctttcagcactttcagacagaggtattagcttaatagtaagaagttctgtgcctcagctgctgataggacgactgttctcatctgagaacttgcagttgctgatcccagtgcttcgtggtttgggaaatcttattgccgctgatgactacatggttgattcagtcctaactgttggaaacaatatcattgatcaagcattgtcaggtcttataaaatgtttgaagagtgataacagggttctcagaaaggagtcatcatgggcattgtcaaatatagcagcaggcagttttgagcacaagaaactgatttttgccagtgaggccacgcctgtgctgatacgccttgtcaccagcgcgcaatttgatattcgcagggaagcagcatacaccctaggaaatctgtgtgttgtccctactggaaattgcgaactcccaaagataatcgtggaacatctagtcgctatcgtagatggtggagcccttccaggatttatacacttggtcaggtctgctgatgtagataccgcagggcttggtcttcagttcctagaactggtgatgagggggtatcccaataagcaaggcccaaagcttgtggaaatggaggacggcattgaggccatggagaggtttcaattccacgagaacgagcagatgaggaacatggccaatggtttggtcgacgaatacttcggtgaggattatggcctcgacgagtgactcaactaattaccattcgtacatcaggttaaattgtaatggcagcagctgttcatgtgttcgtactgtaaaaatgcattctcagtttctaacagcactggaactttagaatgagaaaatcatttgcttgttactgttcgtcttactgccacttg

SEQ ID NO: 466 - DNA, 608 bp, Oryza sativa
tccacatggagaacgaattccaggatggtaagacggaggtgatagaagcatggtacatggatgatagcgaagaggaccagaggcttcctcatcaccgcgaacccaaagaattcattcatgttgataagcttacagaactaggagtaatcagctggcgcctaaatcctgataactgggagaattgcgagaacctgaagagaatccgcgaagccagaggttactcttatgtggacatttgtgatgtgtgcccagagaagctgccaaattatgaaactaagatcaagagtttctttgaagaacacctgcataccgatgaagaaatacgctattgtcttgaagggagtggatactttgatgtgagagaccaaaatgatcagtggattcgtatagcactgaagaaaggaggcatgattgttctgcctgcagggatgtaccaccgctttacgttggacaccgacaactatatcaaggcaatgcgactgtttgttggcgatcctgtttggacaccctacaaccgtccccatgaccatcttcctgcaagaaaggagtttttggctaaacttctcaagtcagaaggtgaaaatcaagcagttgaaggcttctgatga

SEQ ID NO: 467 - DNA, 1747 bp, Oryza sativa
ttggttgcagcactggttcggtgtgagcgagcgagcgagatagccatatcttcgctgtgcgtcgtcgtcgtcgctgcgtggtgaattcttggggaggaggaggacgagatggcgggaggcggcgtggcggcgctgggggtgaagaaggagcgggcggcggagtacaagggccgcatgacgctcgccgtcggcatggcctgcctcgtcgccgccgtcggcggcgccatcttcggctacgacatcggcatctccgggggagtgacgtccatggatccgttcctcaagaagttcttcccggtggtgttccggaagaagaacgacgacggccagaacaactactgcaagtacgacaaccagggcctctcggcgttcacctcctccctctacctcgccggcctcgtctcctcccttgccgcctcgccggtgacgaggaactacggccgccgcgccagcatcgtctgcggcggcctcagcttcctcgccggcgccacgctcaacgccgccgccgttaacctcgtcatgctcatcctcggccgcatcctgctcggcgtcggcatcggcttcggcaaccaggccgtgccgctgtacctgtcggaaatggcgccggcgcacctccgcggcgcgctgaacatgatgttccagctggcgacgacgctgggcatcttcacggcgaacatgatcaactacgggacgcagcacatcaggccgtgggggtggcggctctcgctggggctcgcggcggcgccggcgctgctgatgaccgtcggcgggctgctcctgccggagacgcccaacagcctgatcgagcgcgggcgcgtcgaggagggccgccgcgtgctggagcgcatccggggcaccgccgacgtggacgccgagttcacggacatggcggaggcgagcgagctcgccaactccatcgagcacccgttccgcaacatcctggagccgcgcaaccggccgcagctggtgatggcggtgtgcatgccggcgttccagatcctgacgggcatcaactccatcctcttctacgcgcccgtgctgttccagagcatgggcttcggcggcagcgcgtcgctctactcctcagtcctcaccggcgccgtcctcttctcctccaccatcatctccatctccaccgtcgaccgcctcggccgccgcaagctcctcatcagcggcggcatccaaatgatcatctgccaggtgatagtggcggtgatcttgggggtgaagttcgggacggacaaggagctgacgaggagctactcgatcgcggtggtggtggtgatctgcctgttcgtgctggcgttcgggtggtcgtgggggccgctggggtggacggtgccgagcgagatcttcccgctggagacgaggtcggcggggcagagcatcacggtggcggtgaacctcttcttcaccttcgtcatcgcgcaggcgttcctgtccctgctctgcgcgctcaagttcggcatcttcctcttcttcgccgggtggatcaccgtcatgaccgtcttcgtccacgtcttcctgccggagaccaagggcgtgcccatcgaggagatggtgctcctatggaggaagcactggttctggaagaaggtcatgcccgacctgccgctcgaggacggcgacagtcatcacaagtgaaagaaatgtactctgagatagtatatgggggttacagtagatgagacatgacatgtaggatgaggagattaagattgatcatgtgcggtaatgcattctgtgt

SEQ ID NO: 468 - DNA, 1979 bp, Sorghum bicolor
gcccaatgcggaggtcgtcggggcccggcacgccgtgccgccgccgcgcgatccaggtgctcgtggcggtctccctcgcctacgcgctcgccgtgctgctcctcgagtcgccgctcgtgtccacgtccctgcccggggcgggggcgtccgccgcggcgtcgcggaagctccacctcgacggcgcgtgggagggcgtggggcgaaccgcgccggcgcgccccgggaagcacccgcacagggagaccctctcggcggacgcgtggtggggacgggcacgccggttggcggggatcgtctctggcctcgagctccgccacctcaactccacccgctccggctcgctccgcaaggtcgccgccgaggccgccgagtcaggggcccgcgtgttctccggcctggaggctctagcgacgaccctggcgtcctcgcgtgattcctcaggggaggaagagaagagcaagtgcccgcactcgatcgtcctcagcggtgacgagttccgggagagggggcggacggtggagctgccgtgcgggctcacgctgggttcgtatatcacggtcgccgcgacgccgcaccaggcgcaccctgagcgggatcctaagatcacgatgctcagggagggggaagagccgatcatggtgtcgcagttcatgatggagctgcaggggctcaagacggtggacggcgaggatccgcccaggattctccatttcaacccccgcctccgcggcgactggagcggcaagccggtgatcgagcagaacacctgctaccgcatgcagtggggcactccgcttcgctgcgagggctggaggtcccgtgccgacgaagagactgtggatgggttggtcaagtgtgagaagtggattcgggatgatgaaggacggtcggaggagtcaaaaacgtcatggtggctgaaccggctcattggccgcacaaagaccgtctccgttgattggccatacccattcgtggaggaccgcctgtttgttctaactctcactgctggattggagggttaccatgtgaatgttgatggacggcatgtgacatcatttccataccgcactggatttgttcttgaggatgctactggcttatcattgaatggggacctagatgttcaatcagtgtttgcggggactctgcccaccacacatcctagcttttctccacagaaacacctagagatgttgcccagttggcaggcccctccccttccagacgaaccagttgagattttcatcggtatcctgtcagcaggcaaccattttgctgaacgtatggctgcgagaaagacatggatgtctgctgcccagaagtcatcgaatgttgtggcccggttttttgttgccctgcatggcagaaatgaagttaatgtggagctgaaaaaggaggctgagtttttcggcgacattgttattgtgccattcatggatagctatgatttggttgttcttaagacaattgccatatgcgagtatggggtccatgttgtatctgctagatacataatgaagtgcgatgatgatacttttgttagacttgattcagtaatggctgaagtgaagaaaatccagaacggtataagtctctatatagggaacatgaattatcaccacaagccattgcgcgatgggaaatgggctgttacttatgaggaatggccagaagaggattatcccatctatgcaaatggtcctggatatgttatatcctctgacatcgcagattctattctatcagactttctaaaccataaattaaggcttttcaaaatggaggatgtgagcatgggcatgtgggttgagcggttcaacaacaccagatttgttaaatacgtccacagcgtcaaattttgtcaattcggatgcatagatgattattacactgcacattaccaatcaccgaggcagatgttgtgtttgtgggacaagctacaggctggaaaagcccaatgttgcaatatgagatagtag

SEQ ID NO: 469 - DNA, 883 bp, Sorghum bicolor
gaccgacgacactagctagcattaggaaccagcaatggctccgcgtgatctccttctcctcctgctcgccgccgtgctgctcccatcgtcgtccacggcggcggacccggacgcggtgcaggactactgcgtgccagaaacgggcgcgggggcgcggggtcgtgccgtgccggtggatctgtccctcctcccgtcctacccgtgccggagccccgcgaacctgacggcggccgacttcgcctccgcggccgtgcgcgccgcgggcaacttctccgccgacaccgggttcgcgggggtgtcggtcacccccgcgacgttcccggcgctgcacacgctggggatgtccttcgcgcgcgccgacctgtcggcggcgggcggcgtgaacccgccgcactaccacccgcgcgccaccgagacggcgctcgtcctgagcggccgcgtctacgcgggcttcgtcgacacgggcgggcgcgtcttcgccaaggtgctcgagaagggggaggtcatggtgttcccgcgcgccatggtgcatttccagatgaacgtcggcgacgagccggccacggtgtacgggagcttcaacagcgagaaccccggcatcgtgcgcatcccggccaccgtgttcgggtccgggatcaaggagggtgtgctcgagagggcgttcgggctctcgccggaggagcttcgccggctcgagaagaggttcgggcctcccaagaccaagacggcggagatggatgattaatctgtagatcaggcatgatttaattaattatactaagagcagaagactttgtgatctggaatgtatgtcttttcatttgttaatgtctgtatgtatggatggattatttggcggtggacggtggttattatggatcga

SEQ ID NO: 470 - DNA, 1435 bp, Glycine max
ttgttggtcgtgttcatgattctatgtatttcatgcccctcatttcaaatggtactctttgcctctaacacacactctttcccaaacccaattcaacaacacccaccacctcctcaaatctacctcaaccctttccgccaaacggttccgccgccaactctccctcccactctccccgggcagcgactacactctctccttcaacctgggcccacgggcccaagcccagcccataacactctacatggacaccggcagcgacttagtctggttcccctgcgccccttttaaatgcattctctgcgagggaaagcccaatgcctctccccccgtcaacaccacccgaagcgtcgccgtttcatgcaagtccccggcatgctccgcagcgcacaacttagcctctccctccgatctctgcgccgccgctcgttgtcctctcgaatcaatcgaaacctccgattgcgcaaatttcaagtgtccaccgttttactacgcatacggtgatggaagcttaatcgcgcgtctctatcgtgacacgctttctctctcttctttgtttctcagaaatttcacgttcggttgcgcttacactaccctcgccgaaccaaccggagtcgccggattcggtcgcggtttgctctctctcccggcgcagctggccacgctatctcctcaactcggaaaccggttttcgtattgtttggtttctcactcgttcgactcggagcgagtgagaaaaccgagtccactcattctcggacgttacgaggaggaggaggaggaggagaaggttggtggtggagtggcggagtttgtgtacacgcctatgcttgaaaaccctaagcatccttatttttataccgttggcttaatcggaatctccgtcgggaaaaggattgttccggcgccggagatgctgcggcgggtgaacaatcgaggcgacggcggcgtggttgtggattccggcacgacgttcacgatgttgccggcggggttttataactcggtggttgacgagtttgaccgcggagtcgggcgagtcaacgagcgcgcgcgtaagattgaagaaaaaacgggactcgcgccgtgttattatttgaactccgtggcggaggtgccggttctaacgctgcgttttgctggggggaattcgagtgtggtgctgcctaggaagaactatttctacgagtttttggacggtagggatgcagcgaagggaaagaggagggtggggtgtttgatgctgatgaacggtggagatgaggcggagctgagcggtgggcccggggccacactcgggaattaccagcagcaggggtttgaggttgagtatgacctggaagagaagcgcgtggggttcgctagaaggcagtgcgcgtcgctttgggagagactcaatcgcgacaaaaactagcgtatgatatggtgcacttaa

SEQ ID NO: 471 - DNA, 1751 bp, Glycine max
atttcaaccgttgttccatagcttggaaggcagaagaagatggagaagcttaacttggcactcgtttcttccccaaagcctttgatgttgggacatgttcctgcaagagacgttttcagaagaaaacacttctcttttgggagggtcttaattgctcctcaccgctgcagattccgtgtttctgcactctcttcctcccatcataaccccaaatctgtgcaggagaagctgatagtaaagcattttgctagtatttcttcttcaaatactcaagaaacaacatcaattggagttaagccacaattatcaccatctccatcttcaactatagggtcacctctcttctggattggtgttggtgttgggctttctgcactgttttcagtggtagcttcaagactgaagaaatatgcaatgcaacaagctttcaagaccatgatgggtcagatgaattctcaaaataaccaatttggcaatgctgccttttctccgggatcaccttttccctttccaatgcctacagcagcagggcccactgcacctgctagttctgcaactactcaatctcgagcaccttcagcatctagtgcatctcaatccactatcacagtagatttacctgcagcaaaagtagaagctgctccaactactaatgttaaagatgaagtcgaactaaagaatgaacccaaaaaaattgcttttgtagatgtttctccagaagaaactgtgcgggagagtccttttgaaagttttaaagatgatgaatcaagttccgtcaaggaagcttgggttccagatgaagtttctcaaaatggagctccctctaacctaggttttggtgattttcctggttctcaatctacaaaaaaatcagccttgtcagtggatgctttggagaaaatgatggaggacccaacagtgcagaagatggtttatccctatttacctgaggagatgaggaaccctactaccttcaaatggatgctgcagaatccacagtaccgtcaacaacttgaagaaatgctaaacaacatgggtggaagcactgaatgggacaatcgaatgatggataccttgaagaattttgaccttaatagtcctgaagtgaagcagcaatttgatcaaattgggctttctcccgaagaagtcatttcaaagattatggccaatcctgaagttgcaatggcatttcaaaatcctagagttcaagcagctatcatggattgttcgcagaatccaatgaatattactaaataccaaaacgataaggaggtaatggatgtcttcaacaaaatatcagaactcttccctggagtaggttcaccttgatgcatttgtgtgttgttgctgttttctgggtcaagttatgcatccttttcctgatgacctaagacattattagctccggcctaaccacacggaacaatgcaaaactcttgtgtgctcatatactgcaggctcgcagttacagctccggatagtaactgtcttccctgggctaaaataatgccaaagttggattttttgtttcactaaaaatagttgagattgtgtatattgatgttttatgttttcattaaatattttgtttgaggcattgtatttgcagtttggtttttgagtattcaggtgccataaaaatgtgaatgcttcacataattgtaatactgcatgagattaaactaaacatgtaagcgaccaaataggtggcaacggtcaaatagtcatagtgaaccgtgtaatcaaaggga

SEQ ID NO: 472 - DNA, 1121 bp, Glycine max
gactcctcaacccacttgattcaccccaactcaataattttagccaccagtgtgtagataacttaagccaaaacaaccaaccaattcttttggataccaccttccatatattgatactgcaaaatatagttaaatttcattccgaaacaatgatcaacaaagtagcagttctattagttgttttgcttttcatcattgctgctttggcttctgatcctgatccagtaatggacttttgcatagccaaatcaccagacaatagcttcagttgcaagaactcatctacagcaacagtggaagatttcacctattctggcataaagtctcctgggaacttcaagcaaactggattctcttctatggcagtgaattcaaatgtctttccgggtttgaacactcttggcgtgtcatttgtgcgagcagattttggtgttggcggcgtcaatgtgccacacttccatccaagagcaacagaggttgcttttgtgctggaaggaaaaatttattcaggatttgtggacaccaacaacaaggtttttgccaaagtgttggagaaaggagaggtcatggtgttcccaagaggcctagtgcactttcagatgaatgttggagataggcctgctaccattttgggcagttttgacagccaaaatcctggcctgatgaggattcctaatgcagtttttggttctgacataaaggaggagcttttggagaaggcttttggactgagttctaaggagctttccaagttgaagaagaggttttctcctagttaaaatgcattttctgtttatggagacagtggaaaatttaacatgatacctattattgcagaatattgctgatgattagttgaaaatacacccatcaatagaaagctattggattgatttgtagttaataattttttttaataattcagcctttcttacttaaagggctgattttagagctagagttatttagtatagaagttattccattttaaaatttcacttcccttcagttaaggaaggagcttaagaggagtttgaactgattagaactttatttccaacttcttgcttttgtcttctgaacatattctaaagtcaatgcagtcattgacatttggttca

SEQ ID NO: 473 - DNA, 2789 bp, Solanum lycopersicum
gacagatgccagggaacaagtataccggcaaccaagcggttgctagcactcgattggagaggctattgagagaaagagagcttaggaaaagtagcaaagtttctcactttccaaatgaatctactgataacaataggggaaacgagctctctgaccatgattttcgccaaggagaagctgataatggaggagtttcatatgtcgaacagtacctcgaaggagctgcactagcatataatgaaggatgggagcggcctgatggaaagcccaccagacaacgactcttggttgtggcaaacaggttacctgtctctgcagtaaggagaggcgaggaatcctggtctctagagataagtggtggaggtcttgttagtgctcttcttggtgtgaaggagtttgaggctagatggattggttgggcaggtgtgaatgtgccagatgaggctgggcagagggcacttactaaggcactggcagaaaagaggtgtatccctgtattcctggatgaagaaattgttcatcagtattacaacggttactgcaacaatatattgtggcctcttttccattatcttggacttccgcaagaagaccgccttgcgactaccagaagtttccagtctcagtttgctgcttataagaaagcaaatcaaatgtttgctgatgttgtgaatgaacattacgaagaaggtgatgtggtatggtgtcatgactaccatctcatgttcctgccaaaatgtctcaaggattacaacagccaaatgaaagtcggttggtttctacacacaccctttccatcctcggaaatacacaggacactgccgtctagatcagagctgctccgagcagttcttgctgctgacttggttggttttcatacctatgactatgcaaggcattttgttagtgcatgtactcgtatcctgggacttgaaggaacacctgaaggagtagaagatcaaggtagactgacccgcgttgctgcgtttcctattggtatagattcagaacgatttattcgagcacttgaagttactcaagttcaggaacacataaaagaactaaaagagagatttgctgggagaaaggttatgctaggagttgatcgccttgatatgattaaaggaattccccaaaagatcctggcatttgagaagttccttgaagaaaatccgtactggcgtgataaagtggttttgcttcaaattgctgtgccaacaagaacagatgttcctgaataccaaaaacttaccagtcaagttcatgagattgttggacgcatcaatggtcggtttggaactttgactgcagtgcctattcatcatctggaccgttctcttgactttcatgcattatgtgcactgtatgctgtaactgatgtagcgttggttacctctttaagagatggcatgaacctcgtcagctatgaatttgtagcctgccaagagttgaaaaaaggggtccttattctcagcgaatttgctggtgctgcacaatcgttaggtgctggagcaattctggtgaatccatggaatataacagaggttgctgcttcgattgggcaagctttaaatatgtcagctgaagaaagagaaaaacgccacaggcataactttctgcatgtgactacgcatactgctcaagaatgggctgagacttttgtgagtgaactaaatgatactgttattgaagctcaacagaggataagaaaagttccgccccggcttaacatcagtgatgcaattgagcgctattcgttttccaataatcgactactaatattgggtttcaattctacactgacagaatcggtggatacccctggaagaagaggtggagatcaaatcaaagaaatggaactgaaattgcatcctgagttgaaagaatcattgctcgcgatttgtaacgacccaaagacaacagtcgttgtcctcagtggaagtgatagaaacgtcttagatgataacttcagcgagtacaacatgtggttagcagcagaaaatggaatgtttttacgatctacaaacggtgtatggatgacaactatgccagaacacctaaacatggactgggttgatagtgttaagcacgttttcgagtacttcactgaaaggacaccgagatctcactttgaacaacgtgaaacttcacttgtttggaattacaagtatgcagatgttgaatttggaagattgcaagctagagacatgcttcagcatctctggacaggtccaatatcaaatgcatctgttgatgttgtacaaggactccgctccgttgaggttcgagcagttggtgttacaaagggagcagcaatagatcgtatactgggggagatcgtacacagtaaagccatcgcaacaccaattgattacgttttatgcatagggcattttctggggaaggatgaggatgtatatacattttttgagccagagcttccttctgactgcatcggtatgccaagaagtaaggtcagtgatgcaccaaaggtgcccggggaaaggcgatcagttccaaaactcccttctagtcgaactagctcaaagtcatctcagaataggaacagaccagtttcaaactcggataagaagacttccaatgggcgacggccctcacctgaaaatgtgtcatggaatgtgctggatctgaagaaggagaattacttctcttgtgcagttggaaggactcgtacaaacgctcggtatctgctcagtacgccagacgacgttgttgcttttctaagggaactagctgaagcacctatttcaaatgggacatcatgatga

SEQ ID NO: 474 - DNA, 2170 bp, Triticum aestivum
gcgtctctttaggctcctccggcgatgtcggcggcggtgggcggcgccgagttccacggcttcggcggggcggcacagctcccgcggtcccggatgctcggcaggcccgtaagggtggcgccgccaggggcgacgccggccggcggcggcgggccttcggcggccagcattcgcgccgtgtccacgcctctgaagaaggatgcaaaggaagttaagcgaagcaaggtggagataatcaaggagaagagcaatttccttcggtacccgctcaacgaggagctggtctcagaggctccgaatgtcaacgagactgctgtccagctgatcaagttccacgggagctaccagcagagcgaccgagaagttcgtgggcagaagaactactccttcatgctccggacaaagaatccttccggaaaagttccaaaccagacttacttggccatggatacactggctgatgagttcgggatcggaacgctccgtctgacaaccaggcagacatttcagctgcacggcgttcttaagaagaacttgaagcatgtcatcagcactgtgatcaagaatatgggatcaaccttaggtgcctgtggagacctcaacaggaatgtgcttgcgcctgcagcgccgtatgtgagaaaggatatcctttttgctcaagaaactgcagagaatattgcagcacttcttgcgccacagtcgggggcttattatgacctgtgggtggatggagagaagataatgtcagcggaagagcctcctgaggtcaccaaagcccggaatgacaactcacatggaacaaacttccctgattcccctgaaccaatctacgggacccagtatctacccaggaagttcaagattgcggtcacagttgctggtgataactctgttgatatcctgaccaatgacatcggtgttgttgtcgtttcagatagtgcaggggagcctgttggctttaacctctatgttggaggtggcatgggaaggacacacagaatagaaaccacattccctcgtctggctgatccacttggttacgttcctaaggaggatatattatatgctataaaggcaatcgttgtcactcagagggagaatggaagaagagatgaccgcaggtatagcagaatgaagtatctgattgacagctggggtattgacaagttccgggctgaggttgaaaaatactatggaaagaagtttgaagattttcatccattgccagaatggcaattcaacagctaccttggctggcaggaacagggtgatggtaaattattctatggagtacatgtcgataatggtcgtcttggggggcaagcaaagaaaactctgcgagagataattgagaagtatagcttggatgttagtattactccaaaccaaaaccttatcttatgtggggttgatcaggcatggagagaacccataactgcagctcttgctcaagctggcctgttggaaccaaaggatgttgatctcctgaacataacctccatggcatgccctgccttacctctgtgccctctagcacaaacagaagctgagcgagggatcctaccgatacttaaacgaattagagcagttttcaacaaggttggcatcaaggatgaggagtctgtagtggtgaggataactggctgccccaatggatgcgccagaccatatatggcagaggttggctttgttggtgatggcccaaacagttaccagatttggcttggaggaacaccaaaccagaccaccttggcagaaacgtttatgaacaaagtgaagcttcaagatatcgagaaggttttggaaccactgttttcctactggaatagcacgcgccaggaaggcgaatcttttgggagcttcacaaaccgaatgggatttgagcaactgaaagaggtggtgaacaagtgggaggggtcagcgtcagccgcatgagggctatctttgctggacaagtcccagcaccatttttgctggggtgagaatctggtggcgaccaagtactctacggattatttttatataaaaactaggagaggagggggaaacctgtcaattccgttgacaggcggaggacgaaggaagagccgggtctgaaagaagttgctcctcttgtgtttgttgtgaggtttttttttcgtgtgtacttgtatggataactccgttggcc

SEQ ID NO: 475 - DNA, 5901 bp, Glycine max
cccaacaatgcattaagggtcttttttttcttcttttctctcttatccaatcatccaagtcctataaaaagcatctatatatatattgatattgctttggagtggaaaatggcaccaagaaacagtcgcggaaagcccaagggagagaagaaaaagaaggaagaaaaggttcttccggttgtcatagatatcactgtgaagctcctcgatgaaactcatgttctgaagggaatatcaacggacagaattatagatgttcgtcgtcttctatcggtgaatacggagacgtgttatatcacaaatttttccctgtcgcatgaggtaagagggccacgtctgaaggacacggtggacgtgtccgcactgaagccctgcctcctcactttagttgaagaggattacgatgaagaccgagcagtggcgcacgtgcgaagactcctcgacatcgtcgcctgcaccacgagcttcggtccgtcgtctctgccgccgccgaagaatgattctggcaccgtcccgaagtccggcaagcctgaggcgccgccggcgaagcaatctgcgaaagatgcggaggcggcggcggctacggtggacattgaaggcgagataagccactcgtgccctaagctggagaacttctacgagtttttctctctctcacacctcactgcaccaatccaatatgtgaagagaggttcgaggaggcgcgtggaggagattttggaggaggattatctgttctcgctggatgtgaaggtgtgtaacgggaaagtggtgcacgttgaggcatgcagaaagggattttacagcgttgggaagcagcggatactgtgccataatctggttgatctcttgagacagcttagcagagcttttgataatgctttcgatgatctcttgaaggcattttcagaacgtaacaagtttgggaatctcccatatggcttcagagccaacacgtggcttgttcctcctgttgctgcacaatcaccctcatattttcctcctcttcccgtggaggatgaaatgtggggagggaatgggggtggtcttggaagagacggaaagtatgatttggttccttgggctaatgagttttcatttattgcatccatgccttgcaagacagcggaagaaagacaagttcgtgatagaaaagcatttcttctgcacagcctgtttgtcgatgttgccattttcagagcaataaaggccattaaacatgttatggaagagccgaattttagctgttcagttgtagaaaataatattatttacactgagagagtgggtgacttgaatatcaacgtcttgaaagatggttctgttgcaagctgtaagattgatactaaaattgacggagttgaagctactggagtgaatcaaaaggatctactagaacgaaatctaatgaaaggaatcactgctgatgaaaatactgctgcccatgatattaccactttaggtgtaattaatgtaagatattgtggttatgtggtcgttgtgaaagttgagggaggagttaatgaaaatgttgactctccatctcaacaaaatattgaattgtttgatcagccagagggtggtgccaacgcactcaatattaacagtctgagattacttcttcacaacacaacttcaccagaaaacaataaaccagtgtctcagatacaaacgtttgagagtgaagagcttggtgcttctcatgcttttgtggagaagctgattaaagaaagtcttgctaagcttgaggaagaagaaccaggtattgactattttgtaagatgggaacttggagcttgctgggtacaacatttgcaagaccaaaataatacagaaaaagataagaaaccatcatcggagaaggctaagaatgaaatgaaggttgagggtcttgggaaaccccttaaagccctaaagaattataaaaagaaatctgattcaagcaataataattctgcaactgaatattcaaagtttaatcgtgaggctgaaagctctccattgccctctattgaatcccaacatgaaactacagaagctgagaatgagcttgttctgaaagggatgctatctgatgaagcttttacccgattaaaagaatcgggaactggacttcactgcaagtctatgcatgatttgattgagttatctcgaaaatattacacagacgttgctctcccaaaattggtagccgattttggctcattggaactctcaccagttgatggacgcactctaactgattttatgcatactcggggtctacgaatgcattctcttggacatgttgtcaagctttcagaaaagctttcacatgtccaatcactttgtattcatgagatgatagttcgagcttttaagcacatcctgcgggcagtaatttctgctgttgacaaggagaaaatggcttcatcaattgctggtgcattgaatttgctgcttggtgttcctgaaaatagagaatcagataaatcacgtgaagttcacccattggtgtggaaatggctagagttgtttttgaagaagcgatttgattgggatcttaacaagttgaattacaaggacgtgaaaaaatttgcaattttacgtggcttgtgtcacaaggtgggaattgagcttgttccaagggattttgatatggattccccaattccctttcaaaaatctgatattgtcagcttggtccctgttcacaagcaagcagcatgctcatctgcagatggaaggcagctcctagagtcatccaaaactgctttagacaagggaaagcttgaggatgcagttacctatggcacaaaggctcttgctaatctggtagcagtttgtggtccctatcatcggatgacagcgggagcctacagcctccttgctgtagttttatatcatactggagacttcaatcaggctaccatttatcaacaaaaagctttggatatcaacgagagggagttaggtctggatcatcctgataccatgaagagctatggggatcttgctgttttctattacagacttcaacacacagagctggctctgaagtatgtgaagcgtgctttatatcttctgcatctaacatgtggcccatctcatccaaacactgctgctacttacattaatgtggctatgatggaagaaggtctgggaaatgtacatgttgctctccgatatcttcacaaagctttaaagtgcaaccaaagattacttggtgcagatcatattcagacagctgcaagttatcatgcaatagcaatagcactctcattgatggaagcatatccattgagtgtccagcatgagcaaacaactttgcaaattctgcgggcaaaacttggctccgatgacttgcgcacacaggatgctgcggcttggcttgagtattttgaatccaaggcttttgaacagcaagaagctgctcgaaatggtactcgaaaacctgatgcatcaatagccagcaaaggccatcttagtgtgtcagatttgcttgactacattaatcctaatactaaagggagagatgcagcagcaaagagaagaagccagataacaaaggtgagagcaacatcttaccagaatactggcatgtcaagttctgatgaatcttcaaaagaaattccaaaagaggcttcagatgaagaggtacaaatatccgaaccagtaggtagtgcagattctgagaaggagagcaactctggacctgatttggaacaagctattttaaagcaaatatcggatgaaaagctacaaatttatgatgaaatcttctctgaagcacatgctgaaggagaggatggatggcaatcagttcaaagaccaagatcagctggctcatatggccggagactgaagcagagacgggcagcacttggcaaagtttatagttatcacaagaatgtggaagttggcacagaatctccttttgtaaggagtcctaatccgaatagtaggtattatttcttgaagaaacgaacaatttcccatgggagttatacagatgatcatactacaaacatcacccaaggcaataaatttggaaggaaagtagtcaaagctgttacatacagggtcaagtccatgccctcaacttcaaagccttgtgcaaatgagacattagaaaatggggataagctgctcagttctcttccagaacctgatccaattgatgctaatccagttaagaattctaaagttagtctcggaaagtctccttcatacaaggaagtggccttagctcctcctgggacaatctccaagtttcaggtctataatcctcaaagtgatatttctgttagcagtgaacatgatagtggaaaacacgaagaggaagttgaagctaatagaaatgttgatgttgatccaaccctgatagaggtaaatgatacagttaaagagaagaataatgattctttatcagattctgtagatgattcactggatgatactggagtggctattgaggggaaagaagaaactgagttgattgttgctgtgcaagataattgtatgagtgctgaggggcaatcgggagatgttgaggctcaaggagcagttgatagcagcatattgattcatgcagtagatgatcatgtggattcttacaagcaagaacttgatacaagtaattcatctggcagtttagaacctagtgccaatacaaatcccatttctcagggtggtgaggatttaagggtcaatgtatcaccatcaagtcagagtcgtaccgggggcatcccatataagaaattgtctgcatctgcagctccattcaacccatcacctgccattgcacgtgctgcaccaattgccatgaatatgactcttccttctggtcctagagcagttcctgcaattggcccctggccagtaaacatgaatgttcatcctggacctactactgtgctacccgcagttgccccaatgtgctcctctccacaccatgcatatccatcacctccaacaacaccaaacatgatgcaaccactgccatttatgtatcctccttttactcaacctcaatcagtatcgcctagcaactttccagtcactaacagtgcctttcatgccaatcacttcacatatttgaaccccacaatatctaagtttggtcccagtgctgtttggcctggttgtcatcctgtagaatttcctcttccagtacctattgttgaaccaatccctgatcccatttcagagtcacaagctctgtgtcatggtttggaaagtccaagttcggcttcagttcttcctgaggacattgataatattggggattccaatcaagtggtaaaaactttatcatcagagataagtgaagatgaagcagtgagatctggttcagaaagtataaaagaaaatggtaatatgaattttcacgggtctgaaaatgctgggaacaagcaacatcaaaatattgcttcaaatggcaactctagcagtagtggaactaacatggatggtgagaaaacctttagcattttgtttcggggaagaagaaatcgaaagcagactctgagaatgccaataagtttgcttactcgacctaatggctcacagtcatttaaggttatttataaccgtgtggttagaggaagtcatgctcccaagtctatgaatttgtcttcaagtaaggattgtacagctacttcataatccacagttctttgttgttactaatgaaaagtagcagaattattgtgggtaaagaagatctcataattttgaacaagagagatgtggtatttcgatcatttctggaattgaattacaaaatgccctgttgtatcagctcaagttttatagctgcactatcttttgggaggtttctgatatatgtctctatttaagatggaggattggaggtttttattcatcaatataagtctgcaggttcatcgcagtcagttt

SEQ ID NO: 476 - DNA, 60 bp, Zea mays
aaaggatccagcttcgtctggttgaattctcttctttggaagtgctggtgggcggcgtgg

SEQ ID NO: 477 - DNA, 524 bp, Arabidopsis thaliana
aaccaatgtcgacggtgagaaaaatcactcttaagagttcggatggcgaaaacttcgaaattgacgaagcggtggcgctagagtcacaaaccatcaaacatatgattgaagatgactgtaccgataatggtatccctctccctaatgtcacaagcaagatcctttcgaaggtgattgagtactgtaagagacatgtcgaagctgctgagaaatccgaaaccacggccgatgctgctgctgctactactaccaccaccgtcgcgtcgggttctagtgatgaagatctcaagacttgggattctgagtttatcaaagttgatcagggcactctcttcgatcttatcctggctgctaactacttgaatatcaagggactgttggacttgacttgccagacagtggctgatatgattaaaggaaaaaccccagaagaaatccgtaagacgttcaatatcaagaacgacttcacgccagaggaagaagaagaggttcgccgtgagaatcagtgggcgtttgaatgatga

SEQ ID NO: 478 - DNA, 60 bp, Lotus japonicus
tgaacatggcttcttcttcttttgtcacccttcttctgatctctagctttctttcatttt

SEQ ID NO: 479 - DNA, 60 bp, Medicago truncatula
aacacatgattatatcacacccttttacaccttttccttcttgcattaccattacatgct

SEQ ID NO: 480 - DNA, 60 bp, Medicago truncatula
agaaaatggttccaaaaatgttgaagttctctcgcatgcttcattcatcttccaggaatc

SEQ ID NO: 481 - DNA, 60 bp, Oryza sativa
taatcttcttctcctcacacattcacacacacacaccccgcagaccccggcaccttaccg

SEQ ID NO: 482 - DNA, 60 bp, Glycine max
tttctctctccccgcgatggagaaagccgagagctccgcctccacatcggagccagactc

SEQ ID NO: 483 - DNA, 60 bp, Glycine max
ggaaaatggcactctcagtctcctcaccctcatgcgtacgcgttccttcatgtttttgga

SEQ ID NO: 484 - DNA, 60 bp, Glycine max
aaaagggtggttgaagttgaagcagagataagtgtctcaacaagtgatatgcaaagcatg

SEQ ID NO: 485 - DNA, 60 bp, Glycine max
aggaagtttctgaagcaatagggagtagtggacacagtttaggatcattgttattatagg

SEQ ID NO: 486 - DNA, 60 bp, Glycine max
tgaatagtgatgttcctctcgagatcaattctctttgtgtttgtgttctcagcttgcttg

SEQ ID NO: 487 - DNA, 60 bp, Solanum lycopersicum
cggtgatgtcgggggaagaacggccgtcgagtttagtggtggatccgttgttgaaggatc

SEQ ID NO: 488 - DNA, 60 bp, Solanum lycopersicum
cactttttcttcattcaccatggaaggcgcagcaacagctcaagctttatctcgtattgg

SEQ ID NO: 489 - DNA, 401 bp, Brassica juncea
agaaaatggcgagcactgtgatgactacactgcctcagttcaatggtcttcgagccagcaagatctctgcagctccagttcaaggcctggcaactgttgtgcccatgagacgcaagggaaatggagctttgggtgcaaaatgtgacttcattggttcatcaacaaatctgataatggtaacgtcgacgactctgatgctgttcgctgggagattcggactagcaccatcagccaataggaaggcaacagctggacttaagctagaggcacgtgactcgggtctacaaacgggtgacccagccgggttcactctcgccgacactttggcttgtggtaccgttggtcacatcatcggagttggagttgtccttggtctcaaaaacattggtgctatttaataa

SEQ ID NO: 490 - DNA, 2161 bp, Brassica juncea
aacaagcccaccaatctcttctctgctccatatcttcttcttctctcactaagaaccaaacaatgctcaaaccgttgcttcttctccaatcgttcttgttctgtctcttcaatgttgctttcgtcggaggacggctaatcggcggcggttactcggcgcaggagaatccattcactcccaaagcatctcttgtccgttactggaacaaagagatccgcagcgacaaatcatccatcagatcggagtttctcatctccaaggcttcaccgcttaacgccgtcgagtccgccactttcgccaaactcgccgcccagaactcgctcccgactcgtctcccggacttctgctccgccgcgaacctcttctgcttcccggatttatccccgagcctcgagcagcacaacgccgacgtcaagttctccgtctacgaccagaagaacttcaccaactacggcaatgccgccgccggcggcaccgactcgttcaaaacctactccaaagacggcaacgtcgtcaccgattcgttccggagatacagccgcaacgccgccggtcacgacgataagttcaccgtctacggcgacagcagcaacgtcgtggaggaaaacttcaactcctacggaaccttcggaaccggcggcaccggagaattcaccaactaccaaaacggcgtcaacaacccgacgagccgattcacggcgtactccgacggcggcaacggaaaggctcagtcgttcaaaacctacactcacgaggccaacgccgggaacggccagtcgttcacgagctacggcaagaacgggaacggagtgccgaacgagttcgcatcctacggcgtctccgccaacgtaatcggctccggcttctcgaactacggcgagaaaggaaacgccgccaacgactccttcaccagctacggcagcgacgggaacgtcccgcagaacaacttcaagaactatggcgcctccggtaacgccgcctccgacacgttcgcgaactacagagacaaatccaacgtcggagacgattccttctcctcctacgctaaagactcgaactccggtacggctaaattcactaattacggtcagtcattcaatcccggttcggagacattcaccggttatgggaaaggagccgaaggacacaagatcagcttcaaaacctacacgcccaactctaccttcaaagactacgctaaaaacggcgtcggtttcgcgaagtataacgtttcctccacgtcagcaaccctcggcgatggcaaaaccgtgaataagtggatcgagccgggcaaattcttcagagaagcgtctctcaaagaaggcacagtgattcccatgcctgacattaaggataaaatgcctaaaaggtcgtttttgccccggagcatcatctcgaagctccctttctccacttccaagctcgccgagatcaacaagatcttccacgccggagagaactccacgatggagaagatcatctccgacgcggtgacggaatgcgagaggtcgccgagtgttggagagacgaagcggtgcgttggttccgcggaggatatgattgatttcgctacttcggtgcttggccggagcgtggtgctgcgaacgacggagaatgtggcggggtcgaagcagaaggtggtgatcgggaaagtcaacgggatcaacggcgggaaagtgacgaaagctgtgtcgtgtcaccagagtttgtacccgtatctaatgtattactgccactccgttcctaaggttcgggtctacgaagcggatcttctagacttgaagagtaagaccaagatcaaccacgggatcgccatctgtcacatggacacgtcatcgtggggtccgaagcatggagctttcttagctctcgggtcgaaaccgggtctgatcgaggtttgtcactggatatttgagaacgacatgaactgggctatcgcggattaaaaccgggtcgggtctggatctatcatgctttttttttcaagtattaaatatgaatattatcttatcgccgagatttgaatagaggaatgttaattttctactattgttatatgttttcctaagctctttcagtaacagtaaagacttgttactgatttgtttgtggcggcacgaataatatttaagatattcagtgaatgtttgttgacgcaatt

SEQ ID NO: 491 - DNA, 1304 bp, Brassica juncea
aaaggatccgcacgtgagtaggtttcttcgtcttcttcgttgctccgatcagagaatcgaatcgccgacgacggagaaaaaaaatggcctcctccgtgatttctctctctctgacaacgccattgaaagcgaactcctttagcaagtacaatctcactccgctgccttctctacgtcgcatctcttgctgctcaactcgcgagattactctcaaaccgcgtttggctcttcctgatacgtgtaagcagcggcgaagcgttgagcttttgactcgctgcggcgtttcgtcgaacgacttccccgctgagaaagagaaaaagaggagctttggggagtgggtcgagtttctgggagaggcggtgtcgacggcgtttccggtgtgggtatctcttgggtgcttgctggggctggtgaagccgagtgctttcaattgggtcactcctgatttgaccattataggtcttaccatcacgatgcttgggatggggatgactttgactctcgatgatcttcgcggcgcgttgaagatgcccaaagagctcttcgccggctttgtgttgcagtactcggtcatgccattatcagcatttctagtgagcaaactcttgaacttgccatcacattatgcagccggtctcatattggttggttgctgtccaggcggtacggcaagtaacattgtcacttacattgcacgtgggaatgttgcactatcggtgttgatgacagcagctagtactgtttcagctgtgatcatgacgccgcttcttacggccaagctagccaaacaatacgtcgcagtcgatgctcttggactagtaaagtcaacactacaggtggttcttctcccagtgttggctggtgcatttatgaaccagtacttccaaagagtggtgaagtttgttactcctcttatggctccaatcgcggttggaacggtcgcgattctctgcgggactgcgattggtcagaacgcatctgccatactcgcttcagggaaacaagtggtcatggcttgtgtccttcttcacctctctggatttctctttggctatctgttctcgaggttactcagaatcgatgtggcctcgtcaagaactgtctctatcgaagttggcatgcagaactcggtgcttggacttgttctagcggcagagcattttgggaacccgctcactgcagtaccgtgtgctgtttctagcgtctgtcactccatcatcggtagcgtcttggctggtgtctggagacgcagtgctccaaaacagcttgaagactgagtcgggaccgtttagttaggtaccttt

SEQ ID NO: 492 - DNA, 257 bp, Brassica rapa
tcaagatgcagaacgaagagggtcagatcacagaactatacgttcctaggaaatgctctgctactaaccggatgatcacatcaaaggatcatgcctctgttcagctcaacattgggcatttagatgctgatggcatctacaccggacagttcactacctttgctctctgcggttttgttcgcgcccagggagatgcagacagtggcgtggacaggctgtggcagaagaagaaggtcgaagccaaacaaatctaataa

SEQ ID NO: 493 - DNA, 422 bp, Brassica rapa
caaagatgggctgcattgatcttatcaatttaacaagtaccaatatttatcggctggtgcttacaagaacatcaaacaaaccctacatcacaagaggatcatcgatggctgctattcgagctgagtcagtggctactgagaaattaggaatctttatcgagaagaatcctcccgagtccaaactcacccaactcggtgttcgtagttggcccaagtggggttgtcctccaagcaagtttccgtggacttatgatgcaaaggagacttgttttctgctagaggggaaagtgaaagtgtaccctgatgggtccgatgaaggcgtggagattgaagcaggcgactttgttgttttccctaaagggatgagttgcacttgggatgtatccgttgctgttgataaacactaccaattcgagtgataa

SEQ ID NO: 494 - DNA, 590 bp, Brassica rapa
tcgacatggtttccacaccattccactccatcatctttctcttcctcgccttttccggcggagtcaaaatctccgtcgctgatgagccgaagaccgagcctgttcctgcgccatggccggagcagttccacgcgttgatgttcatgaataaatctggttccattgagattgttgacctatggtacgactggatcaatggccgtaactttaacatcattcagaagcagcttggcaaactaacctacgaccttgaatggaacaatgggacatctttttactatacactcgacgcttccaaaacttgccgcaccgttcatttcgaggttggaatcttgaggccaaactggctggatggagcaaactatttgggtcaacgaaatgtgagtgggtttctctgcaacgtatgggagaaggttgacttcttatggtattatgaagatgttgtcaccaagagacctgttcaatggaccttctatacaggtagagaagctcatgtgatgacatttgaggtcggagctgtcctagaggacgaaaaatggcaggctccagtctattgtttccacaatgaaaacaaaagcagtgagtaataa

SEQ ID NO: 495 - DNA, 673 bp, Phaseolus vulgaris
aaaggatcccattggagtgttgtgactttgctgttgctaaagctaacttcgcgctccacatcgtttgctgccatctcgtctcgccggagcgtcgctgtcggggctaagtttcaagtgttgctgctgatattctgacttgttagtaaagatgagactactaacacataacatgctgtcatcaaacataaagggtgtggtgaatggattcccattgcgcattgaagcagagaaagtggcggaaaagactgtggaaatgaatggggaatttctgaaaaagatgtttgagaaggttgattggaaggctttcgttgatgcatcaaaggccatgggatacactgaactacctgaggaggcggactcttccatgctggactctgatgaatttctgaaccggtttcaccatgctctcttggaactccaccttgaggaaggggctcttgtatgccctgagactgggcgacgctttcctgtcagtaagggcattccaaatatgcttcttcacgaagatgaggtctgagttttgttattattcatcacccttacctgtttagtggcactagttatgaatgctggtaatggaacttcagactttaaaagttgtggatgtcaagtttaccttctttttgttgacccgtgatgtatcctttggctgggctgttctttggatagttgg

SEQ ID NO: 496 - DNA, 2247 bp, Phaseolus vulgaris
aaaggatccgtcagtctggttggttctttgctcctagttttggtgtagcagctatttttcgattcatcctctttttccaaggatttcataattggacattaaacccatttcatatgatgggagttgctggtgtattgggcgctgcactactatgcgctattcatggtgcaaccgtagaaaatactttatttgaagatggtgatggtgcaaatacattccgtgcttttaacccaacccaagctgaagaaacttattcaatggttactgctaatcgcttttggtcccaaatctttggggttgctttttccaataaacgttggttacatttctttatgttatttgtaccagtaactggtttatggatgagtgctcttggggtagtcggtttggccctgaacttacgtgcttatgatttcgtttctcaagaaatccgcgcagcggaagatcctgaatttgagactttctacaccaaaaatattctcttaaacgaaggtattcgcgcgtggatggcagctcaagatcagcctcatgaaaaccttatattccctgaggaggttctaccacgtggaaacgctctttaatggaactttagctttaactggtcgtgaccaggaaactaccggtttcgcttggtgggccgggaatgcccgacttatcaatttatccggtaaactattaggggcccatgtagcccatgctggattaatagtattctgggccggagcaatgaacctttttgaagtggctcatttcgtacccgagaagcccatgtatgaacaaggtttaattttgcttccccatctagctactctaggttggggagtaggtcctggaggggaagttatagacacctttccatactttgtgtctggagtacttcacttaatttcctctgcagtattgggctttggcggtatttatcatgcacttctgggacctgagactcttgaagaatcttttcccttcttcggttatgtatggaaagatagaaataaaatgactacaattttgggtattcacttaatcttgttaggtataggtgcttttcttctagtattcaaggctctttattttggaggtatatatgatacatgggctccgggggggggagatgtaagaaaaataaccaatttgacccttagtccaagtattctatttggatatttattaaaatcaccttttgggggcgaaggatggattgttagtgtggacgatttggaagatataattggagggcatgtatggttgggttccatttgtatacttggtggaatctggcatatcttaaccaaaccctttgcatgggctcggcgtgcacttgtatggtctggagaagcttacttatcttatagtttaggtgctttatctgtttttggttttattgcttgttgctttgtctggtttaataataccgcttatcctagtgagttttatgggcccactggtccagaagcttctcaagctcaagcatttacttttctagttagagaccaacgtcttggggctaatgtaggatctgctcaaggacctacaggtttaggtaaatatctaatgcgttccccgactggcgaagttatttttggcggagaaactatgcgtttttgggatttgcgtgctccttggttagaacctctaaggggtcctaatggtttagacttgagtagactgaaaaaagatatacagccttggcaagaacgtcgttctgcggaatatatgactcatgctcctttaggttccttaaattccgtgggtggcgtagctacagagattaatgcagtaaattatgtttctcctagaagttggttagctacttctcattttgttctaggattctttctatttgtaggccatttatggcacgcgggaagagctcgcgcagctgccgcaggatttgaaaaaggaattgatcgcgattttgaacctgttctttccatgactcctcttaattgagacatgagatccaatgaagtagaaatcacttttcttttactataattatttggttgagtggagcgaggcgtaaagacgaatttcttttccttttttctgagtttctatcgaatcttttttttcgggatgatatagcccagtccgaaaaaaaagattcgatagaaactcagaaaatcaaaaactttatttaccgataaaaaggagagagagggattcgaaccctcgatagttctttctttcaaactataccggttttcaagaccggggctatcaaccactcagccatctggtaccttt

SEQ ID NO: 497 - DNA, 614 bp, Phaseolus vulgaris
tcctaatggctgtgtgccgattcgcttattgttcctctgcatcatcttcttccaccattgttcgtttcccgaaatacccttcacaacacgttaaatcctctttgctgccattctcattcgcaaccatggaagctcctccagaaggttatcgcaggaacgttggtatctgtctcatgaactctcacaaaaagattttcgcggcttcgaggctcgacattcccaatgcttggcaaatgcctcagggtggtattgatgaaggtgaggatccaagaaatgcagctatcagggaattaagagaagagacaggagttaattcggcagaagtgatcacagaggtaccatattggttaacttatgacttcccaccaaaagtgagggagaaattaaatattcagtggggatctgattggaagggtcaggcacagaaatggtttcttttaaagttcactgggcaagatcaagaaatcaatcttttgggtgatggtactgagaaagctgaatttggggaatggtcatgggtatcgcctgaacaaatagttgatctttcagtggatttcaaaaagcctgtctacaagaaagtccttgcagagtttgctccatatttccaataatga

SEQ ID NO: 498 - DNA, 1403 bp, Phaseolus vulgaris
gaagaacagaagagaaaggttctggaagttccatggcggagttgttagcaaccttaggggatctggagagggactcattcgtgcctcttctctccaagctgattggggaatcgaagtacgtgcagaacaatccgccggagctcattcccgaagaggacagagtggtgaagcacgtgttggacgttctattacccttcagcactaccaccggcggcggtcccttgctcgtcaaccacgtcacctactcgcccggccgggggaacctcatcgtcgagtaccccggcaccgttcccggcaaaatcctctccttcgtcggttgccacatggatgtcgtcaccgccaatcccaacgattgggattttgatccgttttcactgagcattgatggagataaactcgggggtcgtggaactactgattgtttgggccacgtggcacttgtcgcggaactcatgaaaaagctcgggcaaaccaagccgaatttgaaatcaactgttgttgctgtttttatagccaatgaagaggattcttcaattactggtattggtgtggatgggcttgtcaaagatggtctcctcaataagctgaaggatggtcctctgtactggattgacacggcagataaacaaccatgcgtagggactggtggtatgataccttggaaacttcaggtcacggggaaggtctttcatagtggattagctcataaagctataaatgcattggagctaggcatggatgctctaaaggaaatccagttccgattttaccgagacttcccacctcatcctcaggaagaggtttatgggtttgcaactccttcaaccatgaaaccaacccaatggagttatccaggaggggggatcaaccaaattccaggggaatgtactatttcaggagatgtcaggttgactccattctacaatgtaaaggatgtaatgaagaagctggaagaatacgtggacgatattaatgagaatattcagaagctagaaagtagaggtccagtttcaaaatatgtcctacccaatgaaaacataaaaggaagccttactttaacttttaacgaggcgctgtctggagttgcttgtgatcttaattctagaggtttccatgttttatgcaaagcaactgaagaagtagttggccacgtaaagccttactcgattactgggagtttgcctctcattcgggaactacaggatgaaggttttgatgttcaaacttctggctacggcctaatggctacataccatgctcagaacgagtactgccttttctcggatatgtcccaaggatatcgggtcttttcgagaatcatctctcaactggaagattgagaacagcagaggaactaataaaactggtgccccatggagggctgtgaaggtgtttctgacttc

SEQ ID NO: 499 - DNA, 861 bp, Phaseolus vulgaris
aaaggatccccatttggtttctcttcccagtagttgaagaagcttgaaaaataaaagcggggaaagaaaaaggagagaggtagggttgtttgaggtttcagaaatggcagcagaatcatcagagggcgaagaagaaacaaagttgagcggaggaaaccaattgctgatggttgacgatgacttaacggagatggggaaaaaagccgcttggagcgtcagttcttgcaaacccggtaacggtgtttcctctctccgtgacgataacctcgaaacctattggcaatccgacggagcgcaaccccatttggttaatattcagtttcagaagaaagttagacttcaactaattgtgctgtacgtggatttcaagctggacgagagttacacgcctagcaaagtttccatccgtgccggtgatgggtttcacaacttgaaggagattaagaccgtggaacttgtgaagccaactgggtggatctatctatcgttgtctggagttgatcctagggatacctttgtgaacactttcatgttgcaaattgctgtgttgtcaaaccatctcaatggaagggatactcatgtgcggcaaatcaaagtttatgggcctcgaccgaatcctattccacaccagccatttcaatttacttcaagggagttcatcacctactcttctataagatgatagtttatggtaaaagtaaatgaagccaacctggttttaaatcaaaggatgccgccattaagtgattgtatcatctggaatatctgaaaccaaatcactactgaccgaaatgtcaaatatatttcacttcaatattcttaaaaattgtcatcagtaaatgtggccatcagggtaccttt

SEQ ID NO: 500 - DNA, 5107 bp, Phaseolus vulgaris
aaacccgggataaacccttgacgacgtttggacctgttttgacggcgccgccatggttctcttcaccgagggcgtgacgaattccgttaaggcggtggggttcagtttcttaacgagtgacgagttactaaggagcagtcgcgtgaagataacgaatccgattttgctcaatccgctgcttaaccctgtttctggtggactatacgaccctgctttgggtccgctggatgacaagtctctttgcaagtcatgtggtcaaggttctaaacattgccccggtcattttggtcatattgaacttgtttctcctgtctacaaccctttgatgttcaatattcttagcagtattttacagagaacttgtttctcttgccatcattttcatgctagcaggaaagaggtggaaatgcgtacttctcaatttgagctcataatgaaaggggatattatcagggccaaaagtttggattctattatttcagatgaatccaaccactcaggtgatggtgatgagagccagggtgttgagcaactgggagaaaattggtcctcccttcaatttagtgaggcaatgtctgttctaaggaaatttctactccgaaaatataagaagtgtcaaaattgtggagtcgtgaatcctagaatcagtaaaccaacctttggatggtttcatatgaatgtcctatctgatgatgaggctagagcaaataccatgagagctctggaaagtgaaacaatcaatgatgatatgtctttaggtggtggggagactacagaagaagaagatataacatctactgggactgcaaaaagagataaaagaaaaaaagggaaattgtcttccaagctagctgcacaaaataaactttctgggtcgttgctaccatcacaggttaaaggtattttagagcttctgtgggaaaacgaggcccgactctgctcttatattagtgatattcaagatcaggggtttggaaagaaagccggtcactcaatgttctttctagagaatatttttgtgcccccaatcaaattccgtcccccaactaaaggaggtgatgatgtgatggaacatcctcaaactgttttgttgactaaggttttacaaggcaacatatccttaggagatgcccatataaataagttagatccttctaaagtactgagccggtggatggatcttcagcaatctgttaatttgttattcgacaataaaacttctggccagggagaagtagctgctggcatttgtcaattgctagagaagaaagaaggcatctttcgccagaaaatgatgggaaagagagttaattttgcgtgccgttctgtcatatcacctgatccttatttggcagtcaatgaaattgggatacccccatattttgctttaaggttatcctatcctgagagagtgactccttggaatgtcacgatgttaagaaatgctatccttaatggccctcaatcccatcctggtgctacacactatactgatcaacaagcaacagtcaagcttccaccaaatgggaagttgctttcttttatatcaagaaaattaccatcgtcaagaggagttattttggatcatgggaagatttctgatcaggaatttgaagggaaaattgtgtatcgccacttgaaggatggtgatgttgtgcttgtcaatcgacagccaacactccataaacctagtataatggctcacgtagttcgtgttctgaagggagagaaaactgtacggatgcactatgcaaactgcagtacatataatgccgattttgatggtgatgaaattaatgtacattttccacaagatgaaatttctcgggctgaagcttacaatattgtaaatgctaacaatcaatatgtgaaacctacaagcggggatccaatcagagctttgattcaggatcatattgtaagtgctgctcttcttaccaaaaaggatactttcataacttatgaagtgttcattcaactactctacagttctggtgtatctatgactgggctaggctcattctctggcaaacacgggcagaaagttttcatgacaaattctgagtttgaaatgtttttgtttcctccagcaatatggaagcctgaacccctatggacaggaaaacaggttatcagtgcattgctatactatatcaccagagattcaccaccatttacagttgagaagaatgcaaaaataccatcaaattttttcaaaactcaggtcagggatggaaaaagacatacacgtgataagtcaaggaacaaggttgagcctgatgatgaggataaattattgatttataaaaatgatttggtgcggggtgtggttgataaggctcaatttggtgactatggtataatacatacagtgcaagaactttatggatccaaggttgctggtaacctactctcagcattaagtcggttgtttactacctttttacagatgcatgggttcacatgtggagtagatgatcttatgataactgaagaaaaggatgttgaaagaatggatcaactcagaagttgtgaggaaattggtgacattgtgcatcgggaattcattggagtaatgaatagtgataatatagatccaataacattgcagttgaatattgagaaaaaaatacgcagtaatggagaagcggccttaacatacttggataggaaaatgacaagcaatcttaactcaagaacaagctcaggaatattaaaggatctactatctgatggaatattgaaaccttcaggaaaaaattgtatttcccttatgactacatctggagctaagggtagtatggtgaatttccagcagatatcttctcatctaggccagcaagagttggaaggaaaacgagtcccacgcatggtttctggaaagaccttgccctgctttgctccctgggattgttcccctagggctggagggttcattattgatcggtttcttacaggccttcatccacaggaatattactttcattgcatggctggtcgtgaagggttagttgatactgcagtcaaaacatctcggagtgggtacctgcaaagatgcctgatgaaaaaccttgagtgtcttaaagtttgttatgatcatactgtccgagatgctgatggttcaattattcagtttcactatggtgaagatggtgttgatgtccatcatactagctttatcaacaaatttgaagcattgtcaactaataaagaattggtttatggcaactgttgccgtcagctagacagatcaagtccatatattaacaaattgcccgatgctctcaaagaaaaagcagagaatttctttcgtgactccttaaaacagagaaatcttggttctctgaaacgagcagaattcttaaagttgatggagcataagtatgtctcttgtcttgctcaaccaggtgaatcagttggtgtattagcttctcaatctgttggcgaaccagctacccaaatgactttgaatactttccaccttgctggtcgaggtgaaatgaatgtgacacttggaattccacgattgcaagaaattgtcatggctgctgcacgtgatatcaaaactccgtttatgacatgccccttgagatcgaataaatctatggaagaagctatttgtcttgctgacaaattgaagaaaatcactgtagctgacataattaagagtatgaaggtttctgttgtaccagtatccgttcttggtggtcaggtttgcagtatatataaacttgtgatgaagctatataaacctaaacagtatccaaaatacagtgatattacccttgaagattgggaggacactttaagaatttcctttgtgagagagttggaggatgccattgaaaatcacatggcactgctttctaaaattagtggcataaaaaaattcaagacagatccacaatcacattcaaacagctcagaagatgctcacggcaatggatcagaatcagagacaaaaggtaaaagtaatgatgatgacgacgatgatgatgttgttgaagacactgaagggtatgaagatctgggatcagatgcacaaaagagaaaacggcaaggtactgatgaggttgattatgaggatggtcctgaagaggaaacacatgatggtgtgctgtcagaggaaattgaaaatgatgaggataatgtggatgataacatgacacttgatgctagtgattctgaaggacttgacgaattatccgagtccaagtctatttttgaaaaagatagtttgaaacgggaaaagaaaaaatctagaccaacaacaagaaaatatgacagggcagtttttgtgaaagctaaagggatgcatttccagatccactttaaatttaccggtgaacctgatattttgttagctgagattgctttgagatcagccaagaaggtttgcattcaaaattctggaagggttggtgaatgtaaagctgttacatgtaaagaaagtggagtaatgtactatggtgaagatagcagaaaaagggatgatattccagcctctgtgaaagaaaaaataccagcactgcagacatcaggggtacattttaaaacattctgggagttgcaagatgatcttgatgttaggtatatttattcaaacaacgtgcatgctatgctaaatgcttatggggtggaagcagccagggagaccatcatcagggaagtgcaaaatgttttcaaatcttatgggatatcggtaaatatccggcacttgacactcattgctgactttatgacgcactctggtggctatcgtcctatgaacagaaacgggagcatagcagactgcacatcccctttcatcaaaatgtgctttgagacagcttccaaatttattgttgaggcagcttatcatgggcaggtggacaacttggagacaccatcttccagaatttgtcttggtttgcctgtgaagatgggaactgggtgccatgacttgatacagaaattggagatatgatgtagccggcatgttcttcagcaccacagctttggcccccgcatgcctggaggtcatgcgaaattttgataccataactgctactaggacaatttccgagtccatttttgtctgtggttcgaaattaaattgctcgagttt

SEQ ID NO: 501 - DNA, 1532 bp, Phaseolus vulgaris
cattgctttggtttgcttcacaaagcgcttaatatttcgctttttcattttcatttcttattatttttgtttttctctggatggcccgaagaaattccactccagggtttcggttccggcccactgacgttgagttgattgagttttttctgaagaggaaggttcggggtaaggtaattcccagcggagtaattgctgagcttgacttgtacaagtatgctccgtgggatcttccagataaatctgccctccagagtggggatttggagtggtacttcttttgtccgaaggggaagaaatattcgactggagggaggtttaatcggtcgacggaggttgggtactggaagactactgggaaggatagagcggttgaacacaagaatcgagttgtggggatggttaaaactctggtttttcacaccggtaaagcccctaagggagatcggactgattgggttatgcatgaattcagagttgatgacaaggagatggttgacgaaggcagttcgcaggactcctatgtaatttgtaggatattccgaaaggaaggtcctggtcccaggaatggtgcacaatacggtaaaccatatgatgagaaagaatgggatacagatgaggaaattgactctgtgcaatctgaacgtgttgcttctatgtcgacacctgttcctatacaacccagtgaaagtcatatttctattgcaaatgacatcaatccctctacaagtggatgtgctggattgacctctgtatcatgtgcatcaaagttgatgccttcctgctcagcatattgtgtgccttctaacaatcaaattgactctgtgtcatgtgtatcagaattgatgccctcttgctcagcactacctttttctccaaactgtgcatttgattctgtatcaggtctatcaaaagtgacaccctcttgttcaacagttcctttaactccaaactatgatgttgactctgtatcatgtgtatcaaaattgatgccctcttgctcagcattttcttctgctccaaacagtgaagttgactctgtatctgtatcaaaaatgccttcttgcttgccacttgcttcagctccaaacaatctagttgacactttatcatctgtatcagaattgatgccctcttgcacggcaccatctccaaaccatcaagatgatgaaaacattttatctttgctagattatttcaaagaagatgacgacacaatggctgtgaatgaaaacaatggaattaagaaggttgaccctgatcaggcgaacaatgctgaatgcgcaccatgtttggatccaaatgtgatttttgagaacctaggagaccttgacagcttggttggattgggtgaaggcagtttttcctctggccagaaaaacggactttctacaagcgatatgttttatacaggtggtgattatatgcttgggtcttgggaaccccaagactttttggagttgacggacctagcggggccacagccctggcagaataagcatggaagttctggcgaatataagtaaaggtaa

SEQ ID NO: 502 - DNA, 931 bp, Phaseolus vulgaris
tccttcgcatattagtctcattccttcactctgccgctgcaaaaacaccactctctgcgccggattccacaccatttcctcacaaatggccgccgaaaagaaactgtcgaatcccatgcgcgaaatcaaagtgcagaaactcgtcctcaacatctccgtcggcgagagcggtgatcgtctcactcgcgctgccaaggtgctcgagcaactcagtggccaaacccctgttttctccaaagctaggtacactgtacgttcctttggaattagaagaaacgagaagatcgcgtgctatgtgactgtgagaggtgacaaggcgatgcagcttttggaaagtggcttgaaggtgaaggagtacgagctgctaaggagaaacttcagcgacactggctgcttcggcttcggcattcaggagcacattgatttgggaatcaagtatgatccatctactggtatttatggaatggatttctttgttgttctggagcgccctgggtatcgtgtgggacgccgtcgtcgttgcaagtctcgtgttggaatccagcaccgtgtgacaaaggaggattccatgaagtggttccaagttaaatacgaaggtgtcatcctaaacaagtcccaggcaattgtttagttttatatcagacccttctgttgttcattaccgtttcttgtttcttttcttccattattagtaccggatgttatttttacaggtctctctagctgtttgacattttttttttaatattattaaattttgacatccttatttatcataacatgtatttctgccatttatctacttaacatcagggtcaaattgaattgtatgtgtaatattttaatgttttagcttcatttcatcatatgccattttagtttgaaactccctgtcactatttggcagtggaatcttcacacttagctgctg

SEQ ID NO: 503 - DNA, 383 bp, Phaseolus vulgaris
gagtcatgaatgctagacgagacaaccgtaacaatagagtttccctttttgatggtatcgaggagggtggcatcagagcacaatctgtttactcatcttctcatgaaattgatgaacatgataacgagcaggcattggatggactgcaagatagagtcaatctgctgaaaagattatcaggtgatatcaacgaggaagtggatagccataaccgcatgctggatcgaatggggaatgatatggattcatcaagaggagtcctttcgggcactatggacaaatttaaaatggtatttgagactaaatccagccggagaatgttttcgcttgtagcatcctttgttgtgatttttcttataatatactatctcactaagtaataa

SEQ ID NO: 504 - DNA, 982 bp, Phaseolus vulgaris
aaagtcgacgaaacatttcgcttccacactccgcgaggtacacgacggtgccggttggtgagcggcgccatacctctcattccatccatcgccgtcgtcaccttcctaaaacgacgtcgcacccatcacccctttcctctccctctcgctcgcagtcataatttcccaaaaaggagggaaaatggtatcttcttcaaactcatggatgaaggaatataatgaagcactgaaacttgctgatgatatcagtggtatgatttctgagcagagttcatttcctgcatctggaccagaaatccagcgtcattcaactgctataaggaggaagattactatattgggtacccggcttgatagcttgcaatctctattgtccaaatttcctggaaagcagcccatatctgagaaggagacaaatcgtcgcaaggacatgctcgcaagtttgagatcaagagtcaatcaaatggcttccacattgaacatgtcaaacttttcaaatagagatagtttgcttggaccagaaggaaaaccagatgcaatggccagaactgttggcatggacaacaatggacttgttggatttcaacggcaactaatgaaagaacaagacgagggccttgagcaattggaagagactatagcaagcacaaaacatattgctttggcagtcaatgaagagctgggtctacacaccagactcattgatggcttggaccagcatgtagacgtcacagattctcgccttaggagagtgcagaagaacttagcagttttaaataagcgaaccaagggtggttgttcctgcctctgcatgcttttatcagtggttggtatagtgcttttagttattgtgatttggctattggtcaaatatttgtgatgccatagtaaataacccaacttctcaagattcttttgtgtttgtttctgacgtgcacaagtatcataacggagtttcctgatttcccttgctggatccttt

SEQ ID NO: 505 - DNA, 1096 bp, Phaseolus vulgaris
agctctgaacaacgaacacaacacagtcgaagaccaaagatggtgcagtggcagaggcacattttgcccttccttcgtcacattcacaagcgagtagtggatcaccaccatgccaatccttcagctcctagccttgtaatttctcgcttagcctcttctctttcacaaggtcaggtaggggggagagcgtggacaagaacgacaccaactttgccctgtttctcaagacccatttttctctgtttccaacatcagggaatttcaagcaccactccattgctggcaaattcatctgaggaaacacctgttttgtcacctttagtcccagtttcatctttgggtagttcaaaaggtgaagaccagaagcagaaagctgttactaagccagaaaaagttcaagcaatattaaagggaataaagcagagtccaaagaaggtcaacttagttgctgctctggttcgtggtatgcttgttaaagatgcattgatgcagttggaattgacgataaaacgagcagcaaaaactgtttatcaggttattcattcagcccgagcaaatgcctctcacaatcacgggttagatccagaacgtctcctagtagcggaagcatttgtaggaaagggatatttcaaaaagagacttgcctaccatgccaaaggaagatcaggactcataatgagaccagaatgcaggctaacaattgtagtgagagagataactgcggaagaagaggctgatatagctaggctgagagttcacaacttcaagaaactaactaagcgggagagacgacttgtgcctcatcaacttattgagaccactcctgtttggggccgcaaaagcaaatctagtggtcaaaacttgagtgctgcacctgcatgagcctcactttgtttccaagttttcatgcttcatggcattttgtgtaatagattattcttcttggtcatcacataatatggaacagttgaaattttttttgcccttgttgcaaatgatagaagtttgtgttggatcattttcagtgttattctcatttaatagcttatttttcttccatctaggtacaaaaatggatatgccctgttcaatcagc

SEQ ID NO: 506 - DNA, 440 bp, Phaseolus vulgaris
aaaggatcccctgtttgtttgcaatggaagtgatctctccttcatccacctcctccagattgaatcccaacgctccaatgttcgtgccgctcgcctatcggacggtggaggatttctccgacgaatggtggaatttggttcgttcctccgcgtggttccgcgactactggctccgcgagtgcttccaagatccccagtaccagaacgagctttttgatttcgacttcgacttagatctggaagaagaagaagaagagaacgaaggggaagaaggaaaagaggtggtgtctttgggggtgctcaaatggcgaagctctggaggaggttgggccgaagcgcctaggtatgttgaaaaggccccaaagttcgtcaagcccaaagttagtcctcgggctattcaccagcccaggtagatcagctaggcccatcacggtaccttt

SEQ ID NO: 507 - DNA, 968 bp, Phaseolus vulgaris
gcctcatgttggtgttcttcatttgtgtactccttttcttcgtctttttatacaaattcatcgccgcttatggcgatttcactctgatgtctaagaagcaacctaaacgcgaagaaattgaagataaggttgtttggattactggcgctagccgtggaattggggagattttggctaaacagcttgcaagtttaggggccaggcttataatctctgcgaggaatgaagttgagctaaaccgagtaagggcacaactgaaaggtaagcatgcacctgatgaagtcaagattttaccattggatttatcgtctggagaggattctcttaggatagctgttgagaaagcagaatactttttttcggattctggtgttgattacatgatccataatgcagcttttgagcgacctaaaacatcaattttagatgtaactgaggaaggtcttaaggctacatttgatgtcaatgtttttgggacaataactcttacaaagctcttgacacctttcatgttaaagagggggcatggtcattttgtggtgatgagtagtgcagcaggaaagacacctgccccaggtcaggctgtatactctgcttctaaatatgcgctcaatggttacttccataccttgcgttcagagctctgtcagaaaggaatccgagtaactgtggtctgtcctggtccaatagaaacatcaaataatgctggatcaaaggttccatctgagaagcgtgtatcatctgaaaggtgtgcggagctgactatcattgctgcaacccatggcttaaaggaagcttggatatcatatcagcctgtgctcgctgttatgtatcttgttcagtacatgccatctgttggttattggctcatggacaaggttggcaaaaatcgagtagaagctgctgaaaagaagggaaacacatattctttgagcttactgtttggaaaaaagaagggcccttgataa

SEQ ID NO: 508 - DNA, 600 bp, Phaseolus vulgaris
aaaggatcccatggcatgcaatctgaatcaaaatcagaggcagtagtgaagtgacttaacgagacgaaccatctatttgcactgtcatcgtagatcgcatagatggagacacagaacaacaatccaaaccctaaccctcatcatcggaattcgctaccgtcatcgttgccggtgtggccaacgatcgatgggtcgttggggttgtcggaggaagaatcggtgagctacgcccggaggttttacaagtttggcttcgctcttctccctcttctttgggccgtcaactgcttctacttctggcccgttcttcgccactctcactccttccctcgcattcgcccatatgttgttggatcagcagttgggtttgcagtgtttgcaaccgttctctgttcttgggctctaacatttgccattggaggggaacgcctcctcggacctgtttgggatcaattggttatgtacaatcttgctgataggttaggcctaacaagctggagctagttgtgtggtacctcttatacatgtattttgatcttttattaccacatttaccttcttccatgcctcgtgaatgcacttccattttagggtaccttt

SEQ ID NO: 509 - DNA, 3362 bp, Phaseolus vulgaris
tcagagaactgcagtgaattgggttttgatttcaactgactgatggagtgcaacaaggatgaagctgtgagggctaagcagattgctgaaaataagatgcaagctggtgactatgaaggggggctgaaatttgctacaaaagcccaaaggctgtttcctgatattcagaacattgttcagatccttgcagtttgtgatgttcactgtgctgctcggaagaaactctccgagtttgacatggactggtatggaattcttcagactcaacagtctgctgatgaagcaaccattaagaaacagtatagaaagcttgcactgctacttcatcctgataaaaataaatccgcgggtgcagaggctgctttcaagttgattggtgaagctaacagaatgttaagtgatcaatgcaagcgggctctgtatgactcaaagattggaatttcagtgggaaatacagcagctaaggtcgcacctagtcacccaaatggaaatgcagggaattatcagaacatttttaattcacagccccatgcttggaatccatatcatcagtttgaaaatcagacattctggacatgttgctctcattgtaatactagatatcaatactacaaaactattttaaatcagaccttacgctgtcaacaatgttctaaatcctttacagctcatgatatggggaaccacaatgtgccaccaacatattggtcaccttttaataaccacaaagagtctgcaaaacatgcatcatctaaagaagcatcaaaaagcaatggtggaaagtctcatggtgtagaagaggagggtgtgtccatgtcaaaatgcactgctggagttggtgcctattctaaagttgcaaatagcagaaatggccacgtggctgcaggagtgacaaaggctggtgttaaagtgttcaaagccaaggaatcacaagcctcaactaaggttggttgtaaaagagcaaggcagtcagcatcaaatgataataacaaagctggaaatggtaaaggcatgaaagataccaaggatcaagaaaatacggttgatcctcataggaaaacttcaagaaaaaaacagcatgttctgtacccagaaaccgataaagctggtgattttgggagttcacccagaaggccacgacaccatgaatcatttaccacccctaaagtagaggaaaaagaagtgccagtaactggtgggttgttcagtaaccttaatccagcctatcgtgctacaggtgtgggtggtcagaatggggagacaataaataaagcaagtgaaccacatgaagaaacaattttaaggaataaagccaaagttgagcagacaaatgtgcaaggaagggaggtattaaactcagatctgaatgatagaaagtctaaagccaactattgttctccatcgaagtcaaatttgcctcccaatgcagagatttcctgtcctgatccagatttcagtgattttgagagagataaggcagaggattgttttgctgttaatcaattatgggctatttttgataatgatgatggtatgccaagattctatgctctcgtgaagaaagtgtactcccctttcaggttgcggattacgtggctagaagctgactcagatggcctaggtgagattaggtggcatgaagcaggtttgcccattgcttgtggtaagttcagactcggtgattctcagagaacttcagatcgttttatgttctctcatcagatgcattgcataaaaggaagtgacactagtacatatctgatatatccaaagaagggagaaacttgggcaattttcagacattgggatcttggatggagttcaaatccagaaaaacatttggagtatcaatttgaatatgtggaagttctatcagattttgatgaaaatgttggcattgaagttgcttatcttggcaaactggaagggtttgttagtctctttctgcacactgtgttgaatagtattagcttattttgtatttcacctcatgaaatgtacaggttctctcatcggattccttcatacaagatgacaggtgctgaaaggaaaggtgttccaagtggatcttttgaacttgatcctgctggtctgcctacttgtctttttgaagtcggtgatactggtgttgcgaaaatggatggagtcaattgttctcatcgggaatactcaaactcaaaagttgaacaggcaaagtctagtgatagtattcacaaatcgaagttgcaagagagtattgactctgaaagagcagcacaaatcctcagaaggtctccaaggtcgagccaaaaaagtatggtcaatggccaagcaagcactagacaattcacggtcagaaaggatgacataaacattgagcacaggggctacagtccaccagagggaaacgctgcttcatctcagactaatgcgaggaaggtcaagacacctcagaaacaagagaaaaatagttatgatggagagacattgaaaactcgaaagttgcctagagatctaagcaagaaagatgctctaggagatgcatctgaaaggacaagatgtaagttgactgctaatcaatcaaaaaacagcaaaaatgtgaagagcaccaacattcctcagttggttggagaatcagtttctgactttaaaaaggataaaactgaaaagatgtttcagtgtggtcagatatgggcaatatatggtgatagagatcacatgcccaatacttacgcccaaattaagaagattgaattcactcctagttttagagtgcaggtttccatgcttgaaccctgcccagtaccaagtgttaaaagagcaatatcttgtggaaccttcgaagttaaaaaatccaaattacagattctctctccctctgcattttctcatcagttaaaagttgaacccttggtaaataatcgatatgaaatttaccctagaaaaggtgaggtttggtttctgtacgaggatcagaactatgaactgacttcttcaaagcacggcagaggtaaatgtaatatagtagaagtattagcagatagtgagaagagtatacaggttgttgttctgtcgccacataacaactctcagacaattttcaaagctcccagaattcagagatctaaaactggtgtaattgaagtattaagagaagaggttggcaggttttcacatcagattcctgcttttcagcacagggacaatgtgcatctcatggggtgttgggagcttgatccttcttcagttcctggttcttttgtaccaataaactgaagtatttttataccctcttgtcccctttgttcgttgtagtgaatctatattttgttatatattaattgaccagctattctgtgaagcagccatgtattgaaatgtgt

SEQ ID NO: 510 - DNA, 813 bp, Phaseolus vulgaris
aaaggatccaaaccctaagcatggattgaagggagatgaagaaaatggagagtgtaagaagaaatgcagaggctctggtggagaagacgatgaaagggaacgatgcttcccatgacgcagctcatgtttggagagttcgcgatcttgctctctctcttgctcaagaggaaggcctctcttccgatcctaactccatgcaaatcgttgagcttgctgcactgctccatgacatagctgactacaaatacctaagggacccatctgaggaaaaaatcgttgagaattttcttgaccaagagggagttgaggaggacaagaaatttaaaattttgaagatcatcagaggaatgggtttcaaggaagaggtgactggaaatggaagtagtgattggtttccagaatttggagttgtgcaagatgctgatcgacttgatgccattggtgctataggaattgcacgttgtttcacctttggcgggagtaagaagaggttgctgcatgatcccgctattctgcctcgttctgatttgtccaaggagcaatacatgaacaaagaggaacagactactattaatcattttcatgaaaagcttctcaagctcaaagatatgatgaaaaccaaggctgggaaaaggagggctgaaagaaggcacaagttcatggaggagtttgtgaaagagttctatgatgaatggaatggcttaaactgataaacatttttcatagcttcttctcttcaagtataggttcagagtttcttctttcaaatggagctcaagcgagatgctgggaaatgttcaaatcggtaccttt

SEQ ID NO: 511 - DNA, 1002 bp, Phaseolus vulgaris
aaagtcgacaaatttgattccgcagtcgtcaagcttccattgtctactgttgcgttgctcctgattttgctttccatcggaatggatagtgcaaagacgcatggtgctgttctggcttgcacagatggagcagttctttccgtcaatcaagcgcttgaggcaattagagaacttggcattgaaggggttcagcaatcggatcctctagttattacatctgcctctctcttaaacaagttgccagtggagtcttcctcttttgattctgctattttattttggctgtcaagtgattgtcctggggaccaactgattcaagaaattcttagagtgttaaaagtaggtggaataattctcattcgcaagtcatctcagtctattgtgggctcatttgataagataatatctgatcttcagagcaagttattgttggcagggttttcagaagcacaaattttacaatcaattgggatcaaagctaaaaagccttcatggaaagttggttcagcatttgccttaaagaaggtgataaagagttcacctaaaattcaaattgatgttgattcagatctgatagatgaagatagtcttttgactgaagaagatttaaagaaaccccagctaccacctggtgattgtgaaattgggagcactagaaaagcctgcaaaaattgcacctgtgggagggctgaagaagaggacaaagtattgaagttaggattgacaacagaacagattaataatcctcaatcagcttgtggcagttgtgggctcggagatgcattcagatgcagtacctgcccttacaagggactgcctgccttcaaattgggcgagaaggtagcactgtctggtaacttccttgctgctgacatataaatggacaagattgaagaacgatttgtcatggaaatcctattattatagatttattatgtagtatttgtcagacactagttatgttaatactagcagaaccattcatcccagtaagaattcttt

SEQ ID NO: 512 - DNA, 934 bp, Phaseolus vulgaris
aaactcgagcactgcaatggccatggcttccaaccatctccgaaacttgactcgcatctccgtccaccgcattctccatcaccgttttcaacctctcctcaacgctgctaggtttttctccgattctgcttcttcactgcctcaaccgcaacctaatcagcaatcttcgcctccctcgtctttgaaggattatgaactcgccaagttcgctgcaattgctgattcctggtgggattctgaaggtccctttaagccattgcatgtgatgaatcctacaagacttgctttcatccgttctgcactatgtcgacattttaagaaggacccttatagtgctaaacctcttgaaggacttaaaattgctgatgttggttgtggaggtggaattctttccgagccactagctcgattgggagctactgtgacgggtgttgatgctgttgagaagaatatcaagattgctcaacttcatgctggtttggatccagtaacttcaactattgaattttgttgcaccacggccgagaaactagttgaagaaggaagaacattcgatgccgttatggccttggaggtgattgagcacgtggcaaatcctgcagatttttgcagatctctttcagcactaacagttcccgatggcgccaccgtgatatccaccattaatcgttctatgagagcctacgcaactgccattgttgctgcagaatacattctccgctggcttccgagaggcactcatcaatggtccagttttctgacgccagaggaacttgtcctcatcctgcaacgcgccggtatcaatgtggaggagatggccggatttgtgtacaacccggtgacaggacggtggtctttatcagacgatatcagcgtaaatttcatcgccttcgccaccaaatcaaacagcaccgaatagcattaaaggcctttt

SEQ ID NO: 513 - DNA, 1305 bp, Phaseolus vulgaris
aaagtcgaccttcaaaatgatgcagtgaggaacacaccatatccacactcatctccatggcgtccttatccagttttgctcctcttgtgtttcttctgcttgttattgggtgcactgcaaggcctttttatcctcttcccagcaaaggtgatgggggaagtaggaagcccctacagactcttcgcccatacaacattgcacatcgcggttcaaatggagagattcctgaagcaactcatcctgcatatacgagagctattgaagaaggggcagacttcattgaaactgatatcttatcatccaaagatggtgttcttatatgttttcatgatgctacccttgatgatactactgacattgcaaattacgcagagtttgctaatcgtaaaagaacgtatgaagtccaagggaaaaacatcactgggttctttactgttgatttcacattaaaggagttaaagtcattgagggtgagacagaggtatacatacagggatcaacagtttaatggaaagtttcaaatcatcacttttgaagagttcattaccatagcactgcaggcacccagagttgttggaatatatccagagataaaatatccagtatatatcaatcaacatgttaaatggtcagatggaaaaatatttgaggacaagtttgtggacacacttcagaagtatgggttcaagggttcctacctgtcaaaaaattggctgagacaacctatattcattcagtcatttgctccaacttcacttgtgtatatagcaaataaaacggacttgcccaaaattctgttaatcgacgatattgatattccaacgcaagacaccaatcagtcatactgggagattacatctgatgaatacctaaactacataaagcaatatgttgtaggaattggaccttggaaagacacgttggtacctgtagcaaaaaattatatgcgaactcctactgatcttgtttccagggcacatgctcataatctgcaggtgcatccatatacttaccgaaatgagaattcttttttgcacttcaactttagtcaagatccgtatatggagtatgattactggatcaacaagataggcattgatggtctgtttacggacttcactggtagtcttcatcattttcaggaatggacctctaaacatcaagatgatgatagtgacaacgatgataacactgcatccaaactgttgcataaaattgcaatgttgctcgcctcttataaatgatctcaagaattcaaatattgtattatgtgtttggattaatttattgtgttcaggatccttt

SEQ ID NO: 514 - DNA, 1025 bp, Phaseolus vulgaris
aaaggatccatgtaatgcatatgcattgtgtgcaagccaattccattggtggattcgtctcttccattcccaaatcatcactttcactctcaccaaccacaaccatggccatgccttctcctaactccctccgagttgcggcggcccagatgacatccgtcagcgacctcgccgccaatttcgccacctgctctgggctcgtcaaagaagcagcttcagctggagccaaattgctttgttttcctgaggctttctcttatgtgggtaccaaggatggggacagtgttagtgttgctcaaccattggatggaccaattatgaaccagtactgctctctggccagagaatccagcatttggttgtcacttggaggcttccaagagaaaggatctgatcctcaacacttgtgtaatactcacgttatagtggatgagactgggaaaattagaagctcttatagaaagatacacctgtttgacgtagatgttcctggtggaagggtatataaagaaagtagttttacagaaccaggcaaggatattgttgcagtagacagtcctattgggcgtcttggtctcagtgtgtgctatgatttgagatttcctgagatgtaccaattgttacgtttccaacatgaagcacaggtactattggtaccttcagcattcactaaagtgacaggtgcagcacactgggagattctccttcgtgctcgtgcaattgagactcaatgttatgtcattgctgctgctcaaactggcaaacatggtgataaaagagaaagctatggtgacacattaattattgatccatgggggacaattgttggccgattaccagatcgtttgtctacaggcattgtagtagctgatattgatttatcacttgttgattcagttagagagaaaatgccaattgccaagcaaaggatgccaattgacttctggaaagctgcatctctatagttcttatttggaccagtcaacaaggggtacatggttaaaaatctgggataagaattcttt

SEQ ID NO: 515 - DNA, 1095 bp, Phaseolus vulgaris
aaaggatccgagagagagagagagggtgtgtctaaaaagcttgaagatgaaggccgtagtgataactactccggggggtcctgaaatgctgcagcttcaagaagttgaagatccccaactccaagacaacgaggttctcatcggagtccacgctactgcccttaatagagccgatgcccttcagaggaagggcttccaccctccccctaaaggtgccagtccttacctgggtctcgaatgttccggaactgtcctatccgtcggtaaaaacgtttccaactggaaaatcggcgaccgggtctgtgctcttctcgccggaggaggttatgccgagaaagttgctgttcccgccgggcaagtgcttccgattccacaaggtgtttcactcactgatgcagctagttttcctgaggtcgcatgcactgtgtggtccactgttttcatgacgagtcgtttatctcaaggggaaaccctgttgattcatggaggttctagtggaattggtacatttgcaattcagatagccaagtatcgaggggcaagagtatttgttactgcagggaatgaggagaagctaggtttttgcaagagtattggggctgatgtggccatcaattacaaaacagaagactttgttgccagggtaaaggaggaaactggtggacaaggtgttgatgttattcttgattgtgtgggagcatcctactatcaaaagaatatcgatagcttgaatttggatggaaggctttttattattggctttcaaggtggggttactacacaaatagatctccgccctttactcgctaagcgtctcacagtacaaggggctggcttgcgtaatagaagtgttgaaaataaagccctaattattagcgaagtggagaagaacgtttggcctgccattgctgaaggaaaggttaagcctgtggtctacaaatctttccctcttgccgaagctgcggaagctcaccagcttatggaaagcagcgagcattttgggaagatattgcttgtgccatgatcattgtcatactgaagttcatgtgtttgaatcttgtgtttggacttcgttgtgatgatctcggtaccttt

SEQ ID NO: 516 - DNA, 1187 bp, Phaseolus vulgaris
aggctatggaagataacaaccaggcttcatctcctgcttcaccaaccgaaggaaaaccaatactatgcagagcggcgattgctagaaaagctggtgagccattgattattgaagagataactgtggcgccaccaatgcctcgtgaggtgcggattcgtgttatctgttcctctctctgccacagtgacatcactttcaggaacctccaggactttcctgccatttttccaaggattctgggtcatgaggcaactggggttgtggaaagtgtagggaaggatgtaactgaagttacaaaaggcgatgtggttattccagttatcctaccagaatgtggggagtgcatagattgcaaatcaaccaagagcaaccgttgtactattttccctttcaaggtgtctccctggatgcctcgagatggtacctctagattcactgacaagaatggagagatcatctaccattttttgtttatttcaagcttcagtgagtacacagtggtggacattgccaatattataaagattgatccagaaattcctcctgacagggcttgccttcttggatgtggtgtttcaacaggggtaggtgctgcttggagaactgctggtgtggaaccagggtctacagtagctatttttgggctgggatctattggattggcagttgcagagggagcaagactttgtggagcaactaggattataggtgtggacatctacccagaaaaatttgaaattggaaaaaagtttggagtcactgactttgtgcatgcaggagaatgtgggggcaaacctgtgagccagtttatcatagagatgactggtgggggagcagattattgctttgaatgtgttggtacggcatcagtggttcttgaagcatatgcttcttgtagaaagggttggggaaaaacaattgttataggagtggacaagccaggagccaggataaatctcagttcccatgaggtccttcatgacgggaagagcctcatgggatccttgtttggaggtctaaaacccaagtctcatgtacctattctccttaaacgttacgtggacaaggaattgcagttggatgaatttgtcactcatgaggtggagtttaaggacatcaacaaagcttttgatttattgagtacaggaaagtgtcttcgatgtgtgatttggatggataaatgataa

SEQ ID NO: 517 - DNA, 982 bp, Phaseolus vulgaris
agtaacgtaaccgtcgttcgtgtgtttcgcttttcagatggcgttgcaggagaggttggacaagttcaagaagcagcaagaaaagtgccaaacgacactgtcaagcattgcagcaagcaaggccgcagcaagccaaaaatctgccgcgcatggctcggccaatggaagaaacgcgccccctgcggttaagttttcgaacgacacggagaggcttcagcatattaacagcatacgtaaagcccctgtgggtgctcagatgaagcgtgttattgatctccttctggagacgagacaagctttaacaccggagcaaataaaccaggcatgctatgttgacataaaggctaacaaagatgtctttgagaatcttaggaaaaacccaaaagtgaattatgacggcctacgattctcttacaagtcaaagtatggtcttaaggacaaaacagaacttcttcaactgatacgcaagtatcctgagggccttgcggttattgacttaaaagatgcttaccccactgtgatggaagacttgcaggctttgaaagctgcagggcagatttggctgctgtccaactttgattcacaggaagacattgcctaccctaacgaccccaaattgcacattaaggttgatgatgatctaaaacagcttttccggggtattgaattgcctcgtgatatgattgatatagagaaggatcttcaaaagaatggaatgaagcccgccaccaacactgcaaagaggaggagtgcagcacaaattcaaggcatttcttccaagcccaagcctaagaaaaagaagagtgaaatcaacaagagaacgaagctgaccaatgcccatcttccagagctttttcaaaacttgaacaattcctgattagctctcaactagtgttgtattagttcaaatagacaatgtatcagacagcctataaactagattattagactgaaatagtcaggaggttcttgctgctctttc

SEQ ID NO: 518 - DNA, 533 bp, Phaseolus vulgaris
cagcgatgcagagccaacttgtgtgcaatggttgtaggagccttctgctttacccgagaggggctaccaatgtttgttgtgcattgtgcaacacgattacctctgttcctccacctgggatggaaatgtctcaactttactgtggaggctgtaggacgttgctaatgtacactcgtggagctacaagtgtgagatgttcctgctgtcacactgtaaaccttgttccagcatctaatcaggtagctcatgtccattgtgggaactgccggacagccctcatgtatccttacggagctccctcagtcaaatgtgctatttgtcactatattactaatacgaacaatggacggcttccaatccctgtcaatagacccaatgggacaaccaatgctggaacattaccttctacttcaacatcaatgcctcaaactcaaagtcaaacagtagtagtagaaaatccaatgtctgtggattcaagtgggaaattggtgagcaatgttgttgttggcgtcacaacagataagaaatagtaa

SEQ ID NO: 519 - DNA, 1536 bp, Phaseolus vulgaris
tgggcctagtgacatacctagcagaaccatagtggaaatctgaagaaagttaacacgacgccgtttttcacagcgaacaaaatcccaggaaaataaggatgtcagagaaatgggacaaaaacctaaaccctgcaatgcaaagttgagtttacagttaagagagttagtagagaaatcgaagctgaaaggataatagatagttccaacaccattctttacttatcagagatggcttccgttgatagtagaaagaaatcagtggttttggctctttgcaagtacctttcattggatcccagtgttgttccggctgaaagtttagacagtgatattaagagtctttacttgaaaatcaaagcggaaaatggacacggggataatcactctgatgaggtgttgaagtgggtagcatttgcagaagccttccctgtggccaatgatgcatgcttagagaatctcaagagattaaacgatgaattgtctggaaagtctgtacttctgggcaatggactgaaaccctctgaagccgatgttatagtctattcagtggttcattcttccctggtcaacctttcagatacaaacaaagaaaaactgccacatgtgttgagatggattgattatatccagcataagcaagaatttgtaggtttgtttgagaagatatcgttgcagaagcctggatttgagcctccggtgacaaaacctgttggagtcgtggaagctgatttaaaatcaaagacggagcaaagcataaagaatgtcaacaagtcagaaatagaattatgcaaggataaaaacaaaactgagggaaaggccactggaagaaagtcaacaggagacaaagaacccaccaaagcgaaggcaaaacctgctgaaaaagaagtagctgagaaagagaatgaagttagcgtcagtttgcttaatattcaagtaggattaatttgcaaagcatggaagcatccgtctgcagatagtttgctagttgaggagatagatgttggggaggccaaattgcggcaggttgtcagtggtttggcaaagtacttcagtcctgaggagttaacgaatcgtcgtgttgtacttataacaaatgtcaaacctggaaaactacgggatgtggtgtctgaaggtctggtattatgtgcttcgaatgaaggaccaactgttgtggagcccttgctccctccagaaggagcaaaaattggggaacgaatttctttttctgggattgatggaaagccagaggatgtgctaaacccaaaaaagaaacagctggagaagattacaccgcatcttttcacagatgacaagggggtggccacattcaagggaataccatttatgacgtctggtggaccatgcacatcatccattcccagagcaactattaaatagtgggagagatatggtccatatccactgttcatttgttcttcaccactctgatttttggcaccacaaaatattcaaagttttttattacgtcaataaggcgttactatcgtatcttgttggcaagtttatgttgcagtt

SEQ ID NO: 520 - DNA, 356 bp, Phaseolus vulgaris
tgaaggaatcgcatcacattacagtgaactgaggacaatgtctgctgaatcgccaagttctgttcgtaaagtggtcattcatctcagagccaccggtgatgctcctattctcaagcaatctaagttcaagatagcaggaactgataaattcgctaaagtgatagattttcttcgccgtcagctccacagggagacattgtttgtgtatgtcaatagtgctttttcaccaaaccctgatgaattggtcattgatctgtttaataattttggttttgatggcaaactggtggtgaactacgcctgctccatggcgtggggctaaccctgaatggtggttgctggttaccaaagcttca

SEQ ID NO: 521 - DNA, 1531 bp, Phaseolus vulgaris
aaagtcgacgattgttgagagagtgcaattgagagagcagaaaaatggggttggaatctgttggagatttagccattaacatgattcttaagaagttagaaggcgaagatgttgccagagtcgcttgtgccagcaaaaggtttaggttttcagcttcagatgacactctttggaccaatctctgcttccatgaactcgctttgacccaacccatcgatcatcttggaaaccccttcccttccttcaaggaatgctatcaagcatggagaggagcttttgatatgtatccatggcctcttgttaagcgtgtgaaaaagtgctgggatagaataaagacctggttgaccaataattttcctgaagctgaggccactctttgtaaaggggcaactgaagctgacattcagacgttggagaatttgttaaaggtggaattgccacttcctacaaggatcctttatcgctttcataatgggcaagaaatcgtaaaagcaaatccagaaactagtacatttggaagttctttgggtctaattgggggttactccttctataatcatttggtgaatgtttatctattgcctatacgtcagataatccaagaaactgagcaaattaggcgtcacttgagctttttaagaagatccaagtttgttcttgtggctgcttcatccactttccgtagaaagttgtttttcctcaactgctccaatggtcaactatatgttggaaccaataaacttcattctgaaaaagacataatcccttgtgtacctcaagatctgataagtttacatcgggaattaaatattgaagagcaacaagatgccatgctactgtggttagaagaacatggtcgtcgtttagaacatggcttcatcaaactctgtgacaaagaaaatggaagaagcattaatcttttcccagaagaaccccctttttgttcaacggctgttactaatggtgtgaaggtccgtgcatctgcattgattatccctgagtttattgatcctcaagatgagaatgaaaagtacttatttgcttattcaatccgcttgtcccttgaaccgcaaggatgcttgattaatggaatgtccttcaactcttgtcagctccattggaggcactggatcattcgtgctaatgatgatgttgtatcggatttcaatggagaagctgttataggacagtatccacttttgcatcctggtgcagaagaatttgtttatcagagttgcacacctctaccactgccatcaggttccattgaaggttcttttacttttgtacctggcagcttggcatacccaaaaggagacccttttctagctacagtggcacaattccctctccagctgccagactatattttctgattttgattctgaatggaaatgaagtatctctgatggcaattgcagctccccaatggcgtttgtgcacattatgtgactttagtgagagtggcttggttcctgagtttttattcttctaagtgttggacctgcacaatttccctatagaattcttt

SEQ ID NO: 522 - DNA, 461 bp, Phaseolus vulgaris
agcaaatgagtcgccatcctgaagttctgtgggctcaacgttctgataaggtttaccttactgttgctctacctgatgccaaggatgtttctgtgaagtgtgagcctcagggtttgtttagtttctctgcttcgggggttcaagatgaatcctacagctttagcttggaactttatggatccattgaacctgagggttgtaaaactaaatctggcttaagaaacatactatgctcagttcagaaaggagaaaaaggttggtggaagaggctattgaagtctgaagagaaacctgctccgtacctgaaggttgattggaacaaatggtgtgatgaagatgaagagtcaacttctgatttggtatctgatgatgattctcggtttgttgatcaagatgaggggagcagtgatgatgatggaatgttgtatcttcctgacttggaaaaggctaggggatagtaa

SEQ ID NO: 523 - DNA, 809 bp, Phaseolus vulgaris
aaagtcgacggattacttgtgcacacacagacaaaaccctacctctcaaaaccctaatcttgaagcactgtaagtgtgatatggcaagagccatttccttatccggcgcacggttcaccatgcgccttatctccaccaccacatttaacgccacattacacaaaccctcatcactttcacttcgttcccgtcgttttcttttccctctctccaatgccatcgttcatccctccactcgcgttgccgggatccgctgccgcgtcaaccgcgctggcgactccgcctactcgcctctcaactcgggatcttcgtctttcagcgatcgccctcccaccgagatggcgcctcttttccctggctgcgattacaaccactggctcattgtgatggacaagcccggtggtgagggcgccaacaagcagcagatgatcgattgctatatccaaacccttgccaaagttttaggcagtgaagaggaagctaagaagaaaatttacaatgtttcctgcgagaggtactttggttttggctgtgagattgacgaggaaacctcgaataaattggaagggttacctggagttttgtttgtgctacccgattcgtatgttgatcctgaaaacaaggactatggcgctgaattatttgttaatggagagatagtccagaggtcacctgaaaggcagagaagggtggaaccacagccacaaaggcatcaagacagaccaagatacaatgatagaacaaggtatgttcgccgcagagagaacactcagtgaaggaccaaattgtgatcggcagaggaattcttt

SEQ ID NO: 524 - DNA, 1239 bp, Phaseolus vulgaris
ctgactcggttgtttctcactgagcaatgcaagccgtctcaaacgctcgccgagtctctcggttgttcctttcgcctcatctccgagcctctggagctcctcactacaccgcggtctctcctttctcagggctcgcgcaacacgtttaccggcgagtgacaactgatccgatacactgcttcttgtctaaggcattttgctcttcaggagtggataccgttgaagaagctccctcaggggatgtgaaggaattatacgagaaaatgcttgactctgtaaaagttaaacgatcaatgcctccaaatgcttggttgtggtcaatgatttcaaattgcaaacaccaacacgatattagacttctgttcgacattctgcagaacctccgcatatttaggttgtcgaatcttcgaattcatgacaattttaattgcaatctctgtcgtgaagttaccaaggcgtgtgttcatgcaggagctcttgattttggaaagaaggctttgtggaagcataatgtctatggattgaccccgagtattgcatctgctcactatttactgctgtatgctaaggaccacaatgatactaaactgttggtggaagtaatgaaacttctgaagaagaacgatttaccattgcaaccagggacagcagatatagttttcagcatttgttacaatacagatgactgggtgttgattagtaagtatgcagaaaggtttgtgaaggctggtgtaaaactacgacaaacctcatttgagacatggatgcaatttgctgccaaaagaggggacaccaaatcattgtggaaaatagaaaatttgagatctgatacaatgaagcagcacactttggcaactgggttttcttgtgccaagggtcttctgttggaacgtaaacccagtgatgcagttgctgtcattcaagttctaaatcagaccttgtctgatacaaaaaagtcaggcatcaagggtgaacttcagaagcttgtatccgagtggcctttagaagttattaagcaccaaaaagatgaggacagaaaggcattagcagcctctttgaaatctgatatccctatcatggttagtgagttgctgagcatgggtcttgaggcaaatgtaagtttggaagacctaaacaggaaggaaggtattccacaatagcattgagttcagaatttgattacattgtatttcagaatgtgcttatttgcggagtaactccttacgacgatgcttcctt

SEQ ID NO: 525 - DNA, 718 bp, Phaseolus vulgaris
aaaggatcctcactcataatattcaaccatgtcgcagttgaacggagcctactacggccccgctattccgtcgcagaagtcctaccaccgcccagggcgcggcggcggctgtggctgctgctgcggctgcctcttcagcctcatcttcaagctcatcctcacggtgatcatcatcgtgggcatcgccgcgttcctcttctggctcatagtccgtcccaacgtcgtgaaagtccacgtcactgacgccaccctcacggagttcaactacaccaacaacaccctccgctacgatcttgccctcaacatcacagtgcgcaaccctaataagaggctgggcatctactacgactatatcgaggcgcgcgcattgttccacgacgccaggttcaactcccagtaccccgatcgcttctaccaggggcacaagaccacgaacgtgttgaaccccgtgttcaagggggagcatattctggctctcaaagctgaccagagcgccgaatttaagaaggagaacgccactgggttgtatgagatcgatgtgaagatgtacctgagggtgaggttcaagttgggcgtcttcaaaaccaagacgctcaagcccaaagtcagctgcgacttgcgtgtgcctatcaagggaacagccaccgcctttgaaaccaccaagtgcgactgggatcgttgatgggttcggatcattccatctacctagggtaccttt

SEQ ID NO: 526 - DNA, 1073 bp, Phaseolus vulgaris
tccacccacttccagtagtttcagtaacactcatgggggaggaggaaaagaaaccagaggaacccaaggccaaggagaaaaaaccagaggaacccgaaaagaaacaagaggagaagaaggaagaaactgcggcaaaaccagcgggagagaaaaaaccagaagaggagaagaaagaagtgactcctccaccgccaccgcctccgcaggagattgtgctcaaagtgttcatgcattgcgagggttgcgctcgcaaggttcgtcgctccctcaaaggattcccaggtgtcgaagatgtactcaccgattgcaaatctcacaaggtggttgtcaagggagagaaagcggatcctctgaaggttttggagagaatacagaggaagaatcacagactggtcgagcttctctctccgatcccgaaacctccagaggagcagaaggtcccggaagaagaaaagcccaagctcgaagagaaagttgaagagactccgattgtgacggttctgaaagttcacatgcattgcgaagcttgttcactggaaatcaagagacgcatacagagaatgaagggagtggaatcagctgaacccgatctgaagaactcagtagtgagtgtgaagggcgtgtatgatccagagaagttggttgagtacgtgaaaaagagaactgggaagcacgcagcgatcgtgaagcaagagccagaaaaggaagagaaggtggaggaaacaaaggaggcgaagaaggaggaggttgagaaagagaagaagagtggtgaaggagaagaaaacaaggaaaagaaagaggaagaagcaaagggtgagaccaaagcagaggaaacagcagcatctagtgaagacagcaacaaggttgttccagaggtgaagattaatgaatccttctataactcaccaaggtatggcatggaggtgtatgcatatcctgcacaccctgtacaccctgtacaccctgcataccctgggtattaccatgcctaccctccccagatgttcagcgatgagaacccaaatgcttgcattgtcatgtaaaaatggaaggtgtcaagggtgatatggtag

SEQ ID NO: 527 - DNA, 735 bp, Phaseolus vulgaris
cgggtgaagaagcatttcctctcctctaccatggacagcgtttgtgcttcgtctccgccgtttcagaccggaccgtccggccacccgcgccacttttacctcgctgttgacaggctccacttcaaaatgcaaacggtaatcgaactcgtggatctggtggctcgacgtccatccttgcccatcgtcgtctgttgcagcacgcgcgacgacctcgactctctctgctcctctctctccgctctccccttcgtttcctcctctgctctgtacagtgatctcgctgaagatgaacgcgctttcctcttggaaaagtttcgacaggtaacagctcagtggaatcagacgaatcacggtggcgcgccgaacgaggacgagattgggaaagacgagaggtctcatatgatcattgtaaccgacgcctgtctccctctcctttcttctggagaacttcccttgaatgctcatcttctcattaactacgagttaccagcaaagaaggagacatacactaggcgattgacaacttgtttaacagccgatggaattgttattaatatggtggttggtggggaagtggtgactctaaaaagtattgaagagagcagcaatattgtcatgcaagagatgcctatgcgaattcttgacattttatgaagatctttagtcttgctctttcctgaagaaagcaaaatttgatcgcttgcactcatgaatggttcaagacatgaagctcgc

SEQ ID NO: 528 - DNA, 709 bp, Phaseolus vulgaris
tcccgtgtttcttgtttctgagtgttgattttgaaggagaaatgagtagttacttgggtgcaggtgttagtactgggactgtcccagttaaccacgacacaaatgggaaaatgtttgataggaggataaggataactgagttggtgttgaggtgtgtgatcctaggtttgggagttcttgcagctgttctcgtgggaactgattcccaagtcaaagagtttttctcaattcagaagacagctaaatttacagacatgaaggctttggtattcctggtagttgcaaatgggttggctgctggcttctctctactccaagggctgcactgtatcatttgtgtggtcagaggaagaacactcttaagcaagcccctagcatgggtcattttttctggtgatcaggtaatggcatatgtaacagtggcggcagtggcggctgcagggcaatcgggaatgttagcaaaggtgggccagccagaactgcaatggatggagttgtgcaacatgtatggaaaattctgcaaccaagtgggagaagggattgctagtgcttttggggttagccttagtatggtggtcctgtcttgtatttctgctttcagtctcttcaggttgtatggtggtaacagaatgaaaaatgtatattgttaggttggaaaataccattgattcaagttaatatagcctacctaccactgaatcaattggcc

SEQ ID NO: 529 - DNA, 1187 bp, Phaseolus vulgaris
aaactcgagatttctaactgctcacaccaacgccaccactccattccccaatgcttcgttttcttttgctgctgttcttactgggcctgggagcccgggtggagtcacacgaagaatccggcccctggagctgcgactccgactccgagatccgagccgaggccaatttcaaacccggcgttattacactggatggccgcgccgacgattggaaggacattgatgggtcctacttccccctcctccccgccctcgaccctgacgctgagaatgaattcaaagggggaaagatgagcgttaagagtgtgcatgatggccgcgatatcttctttctgttgcaagtcgacggtgattatgcgtactccaaaggtgaaagcaacaaatgtccatctgttgctctcatgtttcagattggagatggtgcctcttatcataatatgggtggctgtgaggaacattcaacctcatgcactaacaagacctgcaaaggtcatgaagtggacattatgcacttttccataggaagtgctattccgggacggctttatggtggcaatcccctggacaatagggatggaaatggtggcgacaggtttggtcacttggttgatctgtattcctggaatccacattgtagatacttggatggaactggtcctccaggttctgctaatgattctagtgcgcagaatgactggaagggtgcctggtggcatagtagtttcacggttcactcaggtttcgtagaggatcagagtccatatgcagataatggaaaaaagggcacatacttttttgaattttccaggcctttgaggactatggatcatcttcaacaggacgtgcaatttaacatcggtggatccagtaagatgtctgttgcattctggtatccactagatggtcagccatggcatggttcgggacactactctgttaactgtgattgggttcccattgacatatctattggcggttctttgacgggcaactcagtagatgcagcatcaagtagttcgtggaatgtggctagtgccttttccgttatactatcagtagcagcactttgtgtatctgtgtttgtgagctaccgtgtgttcaatcccaagagtgtttcctttacaccgttagagaacaacctttaaatattgaaccaacagcttgagtttgggatttaggagctcttt

SEQ ID NO: 530 - DNA, 776 bp, Phaseolus vulgaris
tgacgatgaagtgtgtagtgttgctgtcagtggttgcgtgcgccttcgcggtggcggtttgggcggcgaacggcgatgacagcctggttccgccgcgacgggaagtgtacggcaatggccgaatattcgacatcagtcaccggtaccaccccgagatgccggagtttgaatcgaaggacggcatagggcagttcctgtggcttccgaagagcatgaagaacggttccatcgctaacaactccgaaatgaagctcccaacccacaccggcacgcacgtcgacgctcccggccacttcttcgaccactacttggacgccggcttcgacgtcgacacgctcgacttggatatactcaacggacctgctctgttagtcgatgttccaagagatagtaatataactgctcaagttatgaagtcgttaaatattccaagaggtacaatacgtgttctcttccgaacgttaaatacagacaggcggcttatgtttcagaaggaatgtgacacaagctatgtaggattctcagtggatggagcaaagtggcttgtggagaacactgatattaaacttataggagttgattacctatctgttgcttcttatgattacttgatttcatctcaccttgttcttttaaaagatagggaaatcattcctgttgagggcttgaagcttgatgatgttcctgcaggattttattcggtccattgcttacctcttaggttgtctggtgctgagggatcaccaattcggtgcattctgattaagaattaataa

SEQ ID NO: 531 - DNA, 620 bp, Phaseolus vulgaris
acaacatgtgcgcgcccatatccgaactcgaacaggaagagctgctcgaaaagctagaggtcttcaagatcaaaggccgcgacaagcatggccgcaagatccttcgcattattgcaaaattcttcccagcgcggttgatcagtattgaggtgctgaagaagtacctggaggagagggttttcccgaagctggggaagaggaaattcgcagtgctctacgtgcacaccggcgtgcagagaagcgagaatttacccggaatatccggtctccgatcgatctacgacgcgattccggccaacgtgaaggagaatctggaagccttttattttattcatccgggcttacaggcccgccttttcctagctaccgttggccgcttcctcttcaacgctgggttgtatggaaagttgaagtacattagcagggttgattatctgtgggagaacatgagaaggaacgaggtggagattccggagtttgtgtttgatcatgacgaggatttggaataccgtccgatgatggattacgggttagagagtgatcacgccagagtgtacggtggtgctcccactatggattcacctgtgaccacgtattccatgaggtgcatctcatagtag

SEQ ID NO: 532 - DNA, 239 bp, Phaseolus vulgaris
aaacgatgggagctgaaaatgaatcacaggaaaaacgcacacaagagaggccaaagtctactatcacacaggaacagttcctttcatggaagcgccaaaaggatgccgctgtatcagccaacaaagctgaagtatccaggaaacgtgcggaagatattgcagcaggaacaattcaaatgaatggccgtgagttgtttgcacatgagccatgggtgtttgataactcacaatattgataa

SEQ ID NO: 533 - DNA, 1507 bp, Phaseolus vulgaris
aatccaatcggaacagtgagagagagaaatggcgttgaaatttttgaacaagaagggatggcacacggggagtttgaggaacatagagaacgtgtggaaggctgaacagaagcatgaagcggagcagaagaagttggaggagcttcgcaagcagatccaggaggagagagaccgcaccgagtttcgtcttcttcaggagaaagctggcctcgttccgcaccaggagaggttggaatttctgtacgattcgggattgtccgtcgggaaatcttccaattccgaaggattcaaggtccttgaacagttgccgaaatctgatgcggcggatgctccaggctcctctgcttctaaggagggtgcaagcgtgcctggggcattgtttgaggagaagcctcagtctgccaatgatacttggcggaagctccattctgaccccttgctcatgatccgccaacgtgagcaggaggagctggcaaagataaaaaacaaccctgttaagatggctatgataaagaaatcgattgaaggaactgaagacaaggagaaagcacataaaaaggaaaagaggaagaagcaccgttctagtaaatcaaagcataaaaaacagtctgattcagaagatgatcctactgaagggaggaaaaggagtgataatggaaatatttacaagaatcataataaggctcaatctgattcagggtatcaatcagatgaaagagaaaatacgaggaaggatcactatgaagacaaaaaatacagggaaagatcacccggccaccaacagagacagagaaagggaaaagactacaatgaaggtgctgatgacagaaattatagcaggtcgaagtcagagaggagtgtccgtaacagtcaatcaaatccagggtatgaatcaactgaagttgaaaagagaaggatgaatcactatgaagatagaaaatacagagagagatcacccagtcaccaacagagacaaagaaatgacaaagactacaaagaagatgctggtgacaggaattataataggtctaagtcagaaagatatggttcagaagatcagtccaatatagatgccccaaaaagtggaggtgggcgattttctgaaacaagctccaacagatattcttcttcacatgaacatggatataagcgcagaaacgtggctcctaagctttcagaagaagagcgggctgctaaacttaggcagatgcaattggctgccgaagtgcatgaagaacagagatggaaacgtataaagaaggctgaggagtctgatgcacgtgaagcagtccagaataataacgctagtggcaataatttcttggatagtactcagaaaagtgtttatggtgcagacaaagggggaagtgcatcaatagctgagagtgttcgtcgtcggacatattattctcaaggcaggtctggtggtgaaggaaatgcatttcggcgatgaattctgtgtctttacttcaccaatgtagtagacatccctcctgcttctgtctag

SEQ ID NO: 534 - DNA, 362 bp, Phaseolus vulgaris
gaaaaatggcaatggcatggttgcagttgcagagaatcatcaccaaaggaggtgctaatttgatctcaacactcccacactctacgccttattcttcttctagattcttctccaaatcatccctctatgttgtgaaggttggaatacctgagttcctaaacggaattgggaaaggggttgagtctcacgttcccaagctcgaatccgaaatcggagatttccagaagcttcttgtcactcgcaccctcaagctcaagaagctcggtattccttgcaaacataggaagttaatattgaaatacacacacaagtacaggctgggattatggaggcctcgtgttgagtccatcaaagcttgataa

SEQ ID NO: 535 - DNA, 704 bp, Phaseolus vulgaris
agaaagggagaagcgcaaatacattttctttctttctttctttgtttttgtatctccaagaaaatcatgggttcaatcaatctagtgctctcgtcaaccttgttgctccttttggtcggttttgcaacctccgatattaaccaagacaaatcagaatgtatggacaaaatcattggtctggctggttgtctcacctacgtcagtggtgaggccgcagtccccaccatggattgctgctctggtctcaaagaagttatcgacaaaagcaagaggtgcctctgcatcctcatcaaggatcgtaatgacccaagtcttggcctcaaggtcaacgtcaccctcgctcttaaacttccagaagtttgcaaaacacccactaacataactgagtgtgttgatcttttgcatttgccaccgaattccgccgacgctaaggtgtttgaagggtttgaaaaatccttgacaaaccaaactagccccccttctacccctgctgctactcctgcaaagggagaaaacataaatgatgataacaagaagaatggagggtgggcaaagaaggggttggtgacagaagtggtatgtggaattttaccgttactgttggtatcccatttggtgctgttcctggtttgaagcttaaagatggaaggtaaagtgtgttaggtggttgtgtctattattgtatgggtttcatgtgttatgca

SEQ ID NO: 536 - DNA, 517 bp, Phaseolus vulgaris
ggttaggttacgctggatgcagcacagtgataatgaaatggaagcctccaaactcagtaacagtattcaaaatattcgatgccatcactgcgcaggacccctttcaaaccgcatggaaactagtcactggaatgtttctcctctcatcagggatagcttttctatgattggttctgccgttggcggcaccacaagtgcattttatggattcaatcttgttatgcccattgtccagagaagaataaaaggacccatgtggttgcattttctcattggtgcaccccctgtgatagtattctcttcagcatgcgcgggactagcaggtggtgctgttcctgctgcggcacaacttgtttcctcctcttatcatgcagcataccctcccccatcaaaggatgaatatattcaaaagtcaataaaatgagataattgctttatttatgtgaccatgcattttaaaacgagtgtggtgatgagagttttgttttttccttgtgtaaatactgctggaggttag

SEQ ID NO: 537 - DNA, 1816 bp, Phaseolus vulgaris
aaagtcgacgtttggcatcttcttctcatggtgtttcagtctcattctggatcactcagctcattctcttaatgtcaagataaaaaaaaaaggtagaggatgcagggaagctcgagaattgcaagtaaaagtggaaaagcctcaagcagagaaagaaaattggctttgaaacaagatgtggataggttgaagaagaagcttaggcatgaagagaacattcatagagcattggagagggctttcaacaggccattgggagctttgcctcgtcttcctccatatctccctccatatatactagctcttctggctgaagtggcggttctggaagaggaaattgttaggcttgaagagaaggttgtgcatttcagacaggatttgtaccaggaagctgtctacatgtcatcttctatgaggaaacttgaacattcagtttcagctcctccaaacaagtcaaattcaaccatggatagtcccaagttggaaaaattgaagcttcaatcccaaacagttggtaattcagctgcagaatctgcaacaaggcctaccacaactctcacagaggataaggagaatcaatcctgtagtaattcttccaagagcaggaaccaatcatccaaccatatgaacaaatatgcaatcaaaagacttcacaataaatcaccccagaaaaggttggatcatccaaaaataaagcaagaaccaaggttgaacagccagcaaattgcagatttgagaaaccatagtccacataaaagttcatcagaagctgagagaccaaatataatttcggaaaatattgtgaagtgcttatcaagcattctcatgagaatgagtgctgtgaagaatccaggttctgcatgtgacattccacacttgtgggatctaaaacccaaaatgtgtgatgaagaaacagtgtttggggatccatatggcatctgtttggaatttgggaagagggatattggtccatacaagcaattatgtgcaattgatgctaaatctttcaatccaaaacgaactgcaaatactttgtttttactacaccgtttgaaacttctttttaggaaactagcctctgtcaacctagaaaacctcaaccatcaggagaagcttgcattctggataaacatctacaactcctgtatgatgaatgcattcatagaaaatggcataccagaaagtcctgaaatggctgttgcactgatgcggaaggcaacaataaatgtgggtggacacgtgctaagtgcaacaaccatagagcatttcattcttagacttccttatcattggagatttaccttttccaagggaacaaaaaatcatgaaatgacagcaagaagcatgtatggactggaactgtcagaacctctagtgacatttgctctctcttgtggaacatggtcctctcctgctgtgagagtttacactgcatcccaggttgagaatgaactggaagtggccaaaagagagttcttacaggcagcaattggattttcaacttcaaagttttctgtccctaagttactggattggtatttgctgaactttgcaaaagacttggaatcattgctggactggatctgcctccaattaccaagtgaactggggaaacaagccataaaactcctagaggaaagaaaaactgagcccctctcacaatttgtacaaataatgccatatgatttcagctttagatacttgatatgcacataatttcactttagtaattccatgtacattgcttcactgcaactctttatacaactgtagatcatacatacagacaaccttgggtagaaatgttgaattcttt

SEQ ID NO: 538 - DNA, 867 bp, Phaseolus vulgaris
atcccacaggtttgagcctacgcaaaggttgttggtgaccggtgagtgttgaagagaacgatggcaacgtcaaccatggatgttcttcatttccaccacacccctttttactgtgaggagaatgtatacttgctttgcaagaagttgtgcagtgatggaatagcaaaagctgagggatctgatctttttgttgtcttcatttccaacgaaaagaaacagatcccactatggaatcaaaaggctagcaaaagagctgatggggtgattctatgggattatcatgtaatttgcattcagataaaacaaggagatgttcctccactagtatgggacttagattcaacccttccttttccttcacctctaccctcatacgtgtctgaaacaatacgaccatcttttcaacttttttctgattataacagattattcagagtagtgcatgctccaatatttcttcgtagttttgcatctgatagaaggcatatgaaagattctggtggaaagtgggttgaagaacctcctccacacgagcctatagttgcagaagatggaacagtgcacaacctgaatgaatacattaacatgtctgttgctgatgctattacggatgttacaatcagttcagtcaaagatgtaatttttacccagaaaaatggtgtggtgataaaggataatcagcttgaggaattcatttgtcagttatcttctttagaatagccccattcatattgctttctggtttgtatatgttcagctgccatccaagatactgtcaaatattgtctcccgtttaatgggtgttgtaaaaaatgcttcttttgaaggtgtctttctgagagtggtgtgcaaggaatggaagtttaa

SEQ ID NO: 539 - DNA, 1007 bp, Phaseolus vulgaris
acgccattgaagctcattctaccatttttttcaacgtttcacataaggggagagtagaaaaaaatgattagacgaaggttatctgttctctcaacgtcaatcatcagaagctcaaatcatagcaaacccattctcagatacccttctatccaatttcaaccctttcagctccctcattctcccaatgctcatcgaacaattagtcgtaatgaatttccagaatttcaaggttttcgggcgtacagtcttctgagcttgaatgatttgagagataatgttcccaggaaacagcccacgaggaaggggcgtgggattgggtctggaaagggtaagactgctgggaagggtcacaagggtcagagagccagaaaaggtataaaattgggttttgaaggaggccagactcctcttcgcagaagactacccaaacgtgggttcaagaacccatttagcctcatttttcagccaataggtttgggtagaattgcaaagtttattaatgctgggaagatagattcttccgaactgattacaatgaaaacactcaaggatgctggggtacttgggaagcaagcgaaagatggagtgagattgatggggcgtggttccgagcagatcaagtggccaattcatctagaggtatcaagggttactgttagggctaaggaagcagttgaaggagctggtgggtctgtgagaagggtgtattacaataagttgggcttgagggcactgctgaagcctgagtggtttgaaaagaaaggaagattgttgcctaaagctgctagacctcctccaaagcaaaaggataaagttgatagcattggtcggttgccagcaccaacaaagccaattccatttttagttgaaacaaccaaggatcttccagttcagccacttagttaaataactaatatgtgggcactgttttttaaaattttgtaattctctatggtgtacctcttgctctcaagttgttcatgcagttcatgcattgtgaggttgtt

SEQ ID NO: 540 - DNA, 550 bp, Phaseolus vulgaris
ttctccgatcgtctttctgccaccaacatggcttccatcactccacttcacactatgcttcccaacgctgcgcccaaactccccgcatctgtcgctgtttccaacaccaaggtgtcgtttgggccctcacctgggctaccctgcaccgccattcagaggaacaagagtagatcttccagggttgttgtttcggctgttggagacgtttctgctgatagcaccgtttaccttgttgctggcgcggttgcagtggcactcgttggaaccggattccccatcttgttctctcgcaaagacacatgtcctgaatgtgatggagcagggtttgtccgaaaggcgaatgtgacgttgagagcaaatgcagcacgaaaggatcaaactcaaatcgtttgtgctcgttgcaatggattgggtaaacttaatcaaatagacaaatagacttaacaaaatcacttcttttctcctttctttgttttcttaatatgtaactgtttaagcataattatcccctccttcatcctttttcttcgtgtgggacgaacaactttat

SEQ ID NO: 541 - DNA, 1045 bp, Phaseolus vulgaris
aaaggatccggataaagaggcagtgggagagatcgagggcaaaacacagtgttgtgtttgaaattgtatattatgggaatgaaagctttcatatgtctgatgtggttgttgatgtgggtctctcaatccaaaggccgattactgttcatcccatcaaaacccgacccaaatgatgctgctgcctctgctcgttggctcgtctctctcaatttctggggagtcttgaacactatatcagctgatttgggtggagctccctttgggaatgtggtgtcatacagtgatggactgactggtgccggcactggaatcccttacttctacttgacaagtctagatccaacagcaagaaatgcactggaaaatgataaagcttcacttacagtcagtgaataccctcttgggacttgtggcacgaaagacccgatgaaccctacttgctcaaaaatttccctaactggaaagctgaaattggttgatcaacagtccaaggaagccgaatttgctagaaaagccttgttctccaagcatccagagatgaaagactggccgaagaatcacaactttcaattcttcaaattagaaattgaaaatatatttctaatcgactggtttggtggtccaaaaccactcacagtggaacagtaccttcatcctaaaatgaacaatgttggctttttggttcttaatctacagagtgctctttgaattgctattcctattgtgggctgtaaatgtgccatggaattgtaaatagatataccgtcttttgaattgtgtattccctccaaaatactcttgggccatggttctttatccttgtatatttgaactctgtacatgtttatgatcttgggttcttgcccattgtgttgtggctattatatctgaaaatactgtaatcattaagtggaacaaaaggcatcaaagagcaataattgattactatcagttgctaatgcttatctcttttatctgggaatggtttcagtcaaagcatttgaagctcccattgcggcacagcataaaaagattcggtaccttt

SEQ ID NO: 542 - DNA, 563 bp, Phaseolus vulgaris
acccttctgatccagaattcactttcctccttttcgtttaaaagggtaaaggaattcacaatcttttccattttcattttattttatttctcttgaattatatagcattgagaagataatggaggagatgaaggtttctcggcgggtgaagtggtggcagaacatgatgtaccccgttcgacgggtttggtttagcgtcgccactcgtctcagaattcgaaaaaatgggttactgaaactaaggcatgatgtgagggcatgtgagtatgaggacattcaagtgatgtgggagatgctgaacagaaatgaatctgagtttggtaattcttccaagaaatccaacaaaaacaacaccaacaagaagaacaagggacaatgttggaagttgctgaagtgggcaaggtgtgctccatattactacatgtgccgtgcctgatcatgattgctgtgtcagtgtttttctcttgacagaaaaatccaacctgcgtgttggtgtgcctttgccttcaatcatgaataaagggggttgtgcagaacacacggtggttctccacttctctgaa

SEQ ID NO: 543 - DNA, 3656 bp, Phaseolus vulgaris
ctctcgtaatcaatcaaaaaccctaaccgcgcgtgctcgtcgccgctcatcatcttcattcttttctcctcgccgccatggatcccgaggtgcaacaatcgcaggtggccgccatccttggtgccgatccagcggctttccagacgctgatctcgcacttgatgtcctcctccaacgagcagcgctcccacgcggaggcgctcttcaacctctgcaaacaaaccgatcccaataacctctccttgaagctcgcgcacctcctccactcatcgccgcaccacgaggggcgtgccatgtccgccatcctcctccggaagcagctcactcgcgacgactcctacctctggcctcgcctctctccacagacgcagtcctccctcaaatcgctcctcctctcctcgattcaaaccgagaactccaaatccatctccaagaaactctgcgataccatctccgaactcgcctctggaattctaccggataacgattggccggaacttctcccttttatgttccagtgcgtgtcttccgattcccctaagctccaggaatctgcgttcttaatcttcgcgcagttgtcgcagtacatcggcgattccctcactcctcacatcaagcacctccacgacatcttcctacagtgcctcaccaatccctccgttaaccctgacgtacgaattgctgcgcttaacgccgttatcaatttcatccagtgcctctccggttccgccgatcgtgaccggttccaagacctgctacccgcgatgatgcggactttgaccgaggcacttaattccggccaggaggccaccgctcaagaggcgctcgagcttctcatcgagctcgccggcactgagccgaggtttttgcggcggcagcttgtggatgtcgttggcgccatgttgcagatagcagaggctgagtccttagaggagggaactcggcatttggcgattgagtttgtgattactcttgccgaggcaagggagcgtgcccctgggatgatgaggaagttgccgcagtttattagtaggttgtttgcaatactcatgaagatgcttcttgatatcgaggatgttcctgcatggcacagtgctgagacagaggatgaggatgctggtgaaaccagtaattacagtgtgggacaagagtgcttggatagactctctatatctttgggtggaaacaccattgttccggttgcatctgaacagttgcctgcttacttggctgccccggaatggcaaaaacgccatgctgcacttatagcacttgctcagatagctgaaggctgctcgaaggtcatgataaaaaatttggagcaagtggttgccatggtattaaactcctttcctgaccaacacccccgtgtaaggtgggcagccattaacgcaattgggcaactatctactgatttgggtccggatttgcaagttaaatatcatcaaggggtgttgccagcattagctggtgcaatggatgattttcagaatcctcgtgtacaggcacatgctgcttctgcagttctcaacttcagcgagaactgcacacctgatatcttaacgccatacttagatggaattgttagcaaactgcttgtgcttcttcagaatggtaagcagatggtgcaagaaggtgccttgactgctttggcatcagttgctgattcttctcaggaacacttccaaaaatattacgatgctgtaatgccatatctgaaggctatattggttaatgcaaccgacaaatctaaccggatgcttcgggctaagtctatggagtgcataagtttagttggaatggctgttgggaaggagaagtttagggcagatgctaagcaggttatggaagttctaatgtcccttcaagtatctcaactggagaccgatgatccaacaacaagttacatgctacaggcatgggctagactatgcaaatgtctaggacaagattttcttccttacatggagtttgttatgcctccattgcttcaatccgcttcacttaagcctgatgtaaccattacatcagctgattcggacaatgacattgaggactccgacgatgaaagtatggaaactattactcttggggacaagcgaattggaatcaagactagtgttttagaggaaaaagctacagcgtgtaacatgctttgttgctatgctgatgagctgaaggaaggattctttccttggattgatcaggtcgctggaattttagttccactccttaaattttatttccatgaggaggttagaaaggcagctgtttcagcaatgccggagctattgcgatctgcaaagttagccatagagaaggggcaatctcaaggacgggatttatcctatttgaaatttctgactgatagtataattccttctctggtggaagcattgcacaaggaacctgacacagagatttgtgcaagcatgttggattcattaaatgaatgcttacagatctctggggtgcttttggacgaaagccaggtcagatctgttgttgacgagattaagcaggtgatcacggctagttcaagtagaaaacgggagagagctgagaggacccaagctgaagattttgatgctgaagagggggaactaattaaagaggaaaatgaacaagaggaagaagtttttgaccaagtgggtgaaatattgggaactttgatcaaaaccttcaaagcctccttcttacctttctttgatgaactgtcatcatatttgacacctatgtggggaagggacaagactcctgaagagagaaggattgcaatttgtatttttgatgatgttgcagagcagtgtcgtgaagctgctatcaagtattatgatacatatctcccattcctgttggaagcttgtaatgatgagactcctgatgtcagacaggctgctgtgtatggccttggtgtttgtgcagagtttggtggatctgtgttcaaaccactggttggagaggctctttcgaggttaaatgctgtgatccagcatcctaacgctcttcattcagataatgtaatggcatatgacaatgctgtttctgctctgggaaaaatttgccaatttcatcgggacagtattgattcagcccaggtagtccccgcatggcttaactgtttgccaataaaaggtgatttgattgaggccaaagttgttcacgatcaactttgtttaatggctgagaggtcggacagtgagctgctgggcccaaacaatcaataccttccaaaaatagtttcagtgtttgcagaggttttatgtgctggtaaagacctagcgacagaacaaacagctgggcgtatgattaatttactcagacagctccagcaaactttaccaccctctacttttgcttctacgtggtcatctttgcagccacagcagcaaattgcactgcaatccatcctttcttcatagttttcactgctttgctgctttacaatccatcatttcttcatagcatcctggcttggcatttggtgtattgctcttcttgggaacaagctttttcctgtttggtggtctctatttgttacccattctttttgccataagatggtttccatcattcattcttgcatggtgttttatagcaacatggcttcagttttgagaatgcagagtcaattgtgattggaaagggaacttcct

SEQ ID NO: 544 - DNA, 584 bp, Phaseolus vulgaris
aaaggatccggtccttgtttgtttagagtgtttgtgagagtgagagagtgaaatggcgtatctcagattcttacacgcaccactaccacagcctcagctcacactagggtttccttcgccacctcaatttctctccattgctccacctctcaatttctctctctcctcttcttccttcaggtgcaaagtttttaggagattgaaagtgaatcaaaggctgttgactgttttcgcaacaaaccccaactctgtagatgggaaatcacccaaagaaggatcagaggtaaataaaactagcaatgctgctcagggacctcctctccttactattttggctggactttttgtccttttcgtagtttgttggagcatttggtccatcatagcgtggctgataagtttgatagttactgctcctgctccgaaataaatttgattataatgtttgtgtttgtattttaagccactgctttagtccttatgaatttgtctttgtttctttctactattttccacttaatagaatttgagtgctaaacatgctaaagtgagccaagagctggtaaagggaagaaggtaccttt

SEQ ID NO: 545 - DNA, 869 bp, Phaseolus vulgaris
ttgtcttctggcttctcctatttctctccgatctcatgaagaagatcaaacccgttgtctccatggaccctccttacgaggcgtatcagggtcagaggactcggttcaggcaccagagtctcttgcaggattatgaagacctgcacaaggaaacagaagccgtgagaaggaaattgcaggctacggagcagaaaaggttgatactggaagatgaagttagatttttgaggcatcggttcaaatacttgctaaaacatccgattccaaagcctcaaccaaagaaagaagttgtaaagtcacagaagctcaaaattcaaactcccatcatctcgaagggaaagagttacagtagaaaggatcatacttcgcgatcccactctgcatctcatttgaaccctaatggaaagatatccaatgtggctgaagtgccattgcaaaaaactagccatctgtttgatctaaaccagaatgctaggaattttagttctagtagaaaagacagtactattcactgttctgcttcaccagcacgtgacttgaatcacaaagaaaggcttcacagcagcaaagaagccacaaagaagagtgtagctccattttttgacttgaaccagatatcgagagaagaagaagagttgcaaggcaacagtgagaccatgaggattgaagaaccaaagagaagtacacatagagttggaagtgatgagcagcacaacgatatcaaactctcagcttgtagaagtgttggtgatggatcaaatagggcagggaagaggaagatttcatggcaagaccaggtggcattgagggtttgatctttaaaagtacagtaggctgaattcttacccctttggaatgtctagtctgcc

SEQ ID NO: 546 - DNA, 1647 bp, Phaseolus vulgaris
caccacctgcacctctcttaaccctaatactggaagacataacattatagtgtttctgagagtaaattttcgtttcagatccccaactctcaacaacccaaacccacgataaaaacacagcacaagagtaaagaagaagaagaagaagaaaggctaatagcatagcagcactgaagttcgtgtcagcgagcagccatggatgctatacggaagcagctcgatgtgttgatgggagccaaccgtaacggcgatgttcgtgaagtcaatcgcaaatactacgatcgcgacgtctgtcgtctctaccttgtcggtctctgtcctcacgaactcttccagttaacgaaaatggatatgggaccttgccctaaggtccactcccttcagctccggaaagaatacgaggaggcaaaggggaaagggactgataattatgacagggaattggaggatgttatagataagcttattggtgagtgtgataggaagattggcagagctctcaagcggctcgaggacgaggatgcaaaggctgccattgcgatttctgtctctgaagttactcagacgcttgaggtgcttgagctgtctaagcaaattaaagagaagttgaaagaagctgatcaatacgatcttgaaggaaagacagatctcaagattcgagctctagaggttgtagaggagcttagaaccaagagagcagacaagcagtctatgcttcttttagatgcctttaacaaagatagggcatctttaccaacacctctgccaaatccaccacctttggcacccattcctgtagttgcccctgatcctcgaacacaagagatgataaatgaaaagctgaagaaggccgaggatcttggtgagcaaggaatggttgatgaagctcaaaaagcaatggaagaggctgaagcacttaagaagcttcctgccaggcaagagccagtgttggattcatctaagtatactgctgcagatgtgcggattactgatcagaagcttcgtgtgtgcgacatttgtggagcatttttgagtgtttatgacagtgatcgccgattagctgatcattttggagggaaacttcatttagggtatatgcagattcgtgagaagttagcagaacttcaagaagaaaggaacaaaagccgaaagactgatcggcatgaagacaggagatcaaaagaaagaagcaaggatcaagacagggagtcaagtagggaccgtgaacgtggtgaaagtcgtgaacaagggcgagaccatgatcgtaggagtagggaccgtgacaggcattatgatagagatcgtggccatgagcgagaccgagacagagtctccgaccgcacccgcggctatgaatcaagaagtcgtaggaggtcacgctctagatcccgagagcgaactagagattatgatcgacataggcgtcatgatcgatattagcaattgctatgaatcttatggatatgacaatctctagtttaggtgggtgttgaacctcatgttggacaaataattttgcaatttcttgtgttgaactgttttcctgatgatggatgtagcttgagcttaggtgtagctaaattatggtcttgtgttgctttgcagatattaatccaatttgtaatctgccttactttggagcagttc

SEQ ID NO: 547 - DNA, 1227 bp, Phaseolus vulgaris
tgaacttcttctccttaggcagcaacaatggccgcagaatcatctcgcagaagcggcaaacgcccttttgtggaagaagacgacgaatcaagcaaagaaccaccagcaaaaagggttaggtttccaaagggtaagaaagtgaagccaggagatgaagttgtggacaaaggaaatgttgaggagggtgaagttgacataatgaatccccgggtagcagccaaagctgccaaagagcgggcaaatcaaagaaatcaatttactgctgaacttctcagtgagggcactggaggtattggaatagacttttcagttgctgaagtcacatatgaggatagcgagaattttgttgatgatgggattcaaattgaacctttcaacctagacaaagaaagggaagaaggttattttgatgcagcaggaaattttgttgaatatgtaagagagaatgagatcaaggatgcgtggcttgataatattgaagttgatccaaagtattctgcattaaaatctgtaccaaccaatgatgaagatgaggaaccacccgacctttcttctgaagatattggaatcatgaagagacgcattgcaaatgttcttgaatctggggaaacggtattgcaagccttgagaaggttaaaaggtaacagtgacagaaaggcaaaaatgtctgctgaggctaagattatatttgaccagctaactgaggatgctatgaagctgatggaggatggtgaatacaatgtttatcatgaaaaacgagaggtttttgttcgtgaagcggaaggatatgagaggttatcccaggcaaaagaaggcacatcaaatcaacatttggctagtggagaagcctctggcgatggtgatgatgattttgatatgtttgccaatgatgatgaacaggatactagtaagccatctacaaatgaaaataatgcagttagtcaatcttcatcggatgccataaattctgctggagcattgcaaaatgattatgtgtatgatgaatcttctgggtactattacagcagcagtttgggctattattatgatccaaatacagggctttatttctctgcagcatcaggacaatggtactcatttaatgaggagactaacacctacgaagaagttgacgaggttccatcgaatgtgaactgagggacttgtctcaagggacagtaggctagttatagcatagccacaatcattgtctacgagtggctcatg

SEQ ID NO: 548 - DNA, 493 bp, Phaseolus vulgaris
gcagaccatggatgacttgtttgattcctcgttgaacttggaggacacccattacaaggaaggctatgatgaaggccacagtcacggccttgtcgcgggcaaggaagaagccagacaggttggcctgaaggttggttttgagattggagaggagcttggtttctataagggttgtgttgacatttggacttcggctcttcggcttgatccgacttgtttctcttcacgggccaaaatagttgttggccagatggaggagttgattgagaaataccctctcatggatccagaaaatgtacaagtgcaagagatcatggatagcctcagggtcaagttcaagatggtttgttcttccttgcatgtcaaacttgagtataatggctatccaaagtcttctacagaagccaacgatattcaattttgagctgcttatgatattttcagtcttctagagataccagtgtgtagagatacaatgagttgggcaagttag

SEQ ID NO: 549 - DNA, 2274 bp, Phaseolus vulgaris
attaaggcacaatcaccgctactgagtcaatgaccatgccaagggtttctgccaatccttctccctcgtgcttagtctctatggcttccaccgtcagagcttacgcgctccctattattctctttgctggagccatgttctaccagctcttcattatccccaatgcctttcctccttcccattacgacgttctacaaattgagagctatagttcgattgacaaagtgcaggaggcttacgagaagcttgaatctaaattgaattctgctgaggaagcttttgatattcacaagtttttaaagattcgatatgcttatgagttgctgacagatcctttatggaaaagagactatgacacatttggtattgatgaacaacttcatattgttgagagtggtagcaagcgttatgcagggaaacatatttcagaattggacttccctttactacaggcccgatctggatttgtggatcactcttctaaagtcattacatccagtgacttccagtatatatttccagatgttaagccatggctaattcagttgttttcatcagggagcgaaaattgtgctcaattttccaagtcctggaataaaattgcttctttattggatgttgttgcaaacactggtgtggtggaacttggtgagaaggagcttgccatatatcttgctgataaatcatcaactggaaaaccattttttagaaatggtgttccatctcttattgtcattcctgcaggatgtagatctcctaaatgtatgacgaggtttaatggcgagcttagtgttgataaggttacaaattggttcgcaacaactatagtggatttacctcaaattaactactactcaagggaatctttggtgccaaattttcttggtaaaactagccatcataaggtaaaagtcctctttttctcaacatttggtgagcgtgctgctccatttatacgacaagcagctaaagactattgggcttttgcttcctttgcattcattctctggcgggaagaggaatcttcctattggttgggagcatttggagtgcattcagcaccagctattgtatttcttaaagacccaggtgtcaaacctgtggttcaccatggttctgtcaacaattcaatttttttgcagttgatggaaaataataaacagcaagagcttcgacaactaaggagtgtgacatcaatggagctaggttgtgatccccatggctattctcgtgctggttatgatacaatgatatggtattgtgctatcgtggttggaaggccaagtttggagctgaacaaaatgcgtgaaactatgtgcagggtccaagaaacattttttaagcacagccaagtggatgcatcatctgataatcaatccttaactccagctgtggatgcatttaaaagaaggcggctgacatttgcttggcttgatggtgaaaagcaaaaggattactgccaattttacattggtcaagcgggtagcgatcacacatgtgggcaacgacggagtgtgactgatattcctaggttatttgtcattcgttacctgaggaatggcagtgctgttgatttgagaacagaacaaaaaacggactggaaatcatcactggtccaagatctaatcagtgattctgatcttgcaggccagtttgtagctgggtacaagggagaagatgatgtttcacagataaccgcttggcttgcaaacattatttctgatggtgactccagagaattaccattctttactttacgaactcctaagcttgtcccagatgacacagaacctatttggtccataacagcacaaaatattcctctgaaaaatctgaaacagagtattcttggtagtcttagcggactctctatataccgtgaggatcctagagttggtccgtttttgcttctgggtgcattaatttctttgggtactatctggctgcgtaggagccaacaacaagttcagccatctgaacaaaatcaacctaattccaatcagccatctgaatcaaatcaaccaactcaacccagttccaaggatgaaagaaaacaaatgccaagagaccgggtcagaagtcggtcaaataaaaaaccaaccccttctatgactgattttgaaccatcggatgcttaccaggttccactatcagattctgattctcagtaatctcagtttggtttctccatgaaggaaaggaaaatacacacagttacatggtctgaaggtgaaattcttgaattgtgttcttggtttctccatgaaggaatag

SEQ ID NO: 550 - DNA, 584 bp, Phaseolus vulgaris
tccaacttcccaaatctcaggcatttttgccacactcagaactaaataccaattgaaagagaatgaacaaaggtggaggagcggggttaggaggtggcgccggtgccggaagcggacccactgcggcagcagcctcagccgcagcgcagaagcagaagacgctgttgcaaagagtcgaaggtgatattgccaatatcgttgataactttagccacctcgtcaatgttgcaagggtaaatgatccaccagttagaaactcacaggaagcttttatgatggagatgcattctgctaggatggttcaggcagctgattctctgttgaagttagtatcagagctaaagcagactgcaatattttcaggatttgcgtctcttaatgatcatgtagaacaaagaaggattgaatttaatcagctggccgaaaaaacagatcatgctttatccagagttggggaggaagcggctgctaacctaaaagaacttgaatctcattatacttcttctgcacagaagaccatgcaaaacctgcaaccatagttaagaatctctaaatgcagtatgcggatcatgctttattcatag

SEQ ID NO: 551 - DNA, 2019 bp, Phaseolus vulgaris
aaaggatcctcatgatctattcggaaggagcattttaagctatggccgctgcaaggttaacctcattcgtggcggtgtcatccgctgcggtggtttccatgtccacgttctctgatcgtgcctacgccgactcttcctttcgaatccctttcttctcttcttcaccttccaatgcgccggcgccgccgaaccagtcttccgacagcagttcagagcctccggtgcctgaggaacctaacaagtcgggtttcgacccggaatcgttagaaagaggagccaaagctctccgtgaaatcaacagttcttcctactcaaagcaggtgtttgatttaatgcgaaagcaggagcaaactcgcctcgctgaattagacgctgagaaagttcactacgaacttattcagtctcaaggagatattgaaaggcagcgaaaaatggctgaagaacaacgtaatttaatacaagagcaagcccagagacaggcccaggtgctgcgatatgaggatgaattagcaaggaaaagaatgcagacagatcatgaagcccagaggctacataatgttgaattggtgaagatgcaagaggaatcttctgtaagaaaggagcgggcaagacagtctactgaagaacagattcaatctcagcagcgtcagactgatagagagagagctgaaatagaaagagaaactattagagttaaggcaatggcagaggccgaaggccgagtacatgaagcaaaattgacagaggatcataacaggagaatgcttatagaacgactgcagggtgaaagggataaatggcttgctgcaattaacacaactttcggtcatattgaaggtggtctaagggccttattgactgatagggacaaattgcttatgactgttggaggagctactgcactagctgcaggagtatatacaactagagaaggtgctaaagtcacctggggctatattaatcgaattttagggcagccatcactgatccgggaatcatcgatggcaaaattccctggatcaaagataatttctcaagccaaaaataaacttctaaatagtagtactttggctgggacagaaaagcctattggaagtaaaaatggccttgaaaatgtaatcctccatccatcgttgaagaaaagaatagagaaccttgcacgtgcaacatcaaacaccaaagcccatcaggcaccgtttcgtaacatgcttttttatgggcctccaggcactggtaaaacgatggttgcaagggaaatagcaaaaagatcgggtttggattatgccatgatgacaggtggagatgttgcacctttggccgcccaggctgttaccaaaattcatgatatatttgattgggccaagaaatctaggaaaggcctattgctttttattgatgaagccgatgctttcctttgcgagcgtaacagcacgcacatgagtgaatctcagcgaagtgctttaaacgcattgctattcagaaccggtgatcagtctcgagacatagtacttgtccttgcgacaaatagaccaggtgatcttgacagtgcagttactgatcgcattgatgaagtgattgaatttccgcttccaggagaggaagagcgtctaaagttattgaagctctatgtaaacaaatatttatgtgatgacaacaatggcaccaagggaggcttcttgccgaagaagcagcctcagcagattactatagaagatttatccgaagatgttttcagagaggctgccaagaaaacggagggattttctggccgtgagatcgccaaactcgtggctagcgtccaagctgctgtctatgggcgcccagactgcatgttggattcccaattgtttagggagattgtagattacaaggtggtggaacatcaccaacgactaaaactagcagctgaaggtggccagcccggccaaatataacttgctgtgtgagatttttgttcatggtgttatgtgagtgcgtatttgtgcgcggcagatgaagcagattcgttaaggtaccttt

SEQ ID NO: 552 - DNA, 773 bp, Phaseolus vulgaris
atctcatggccctcgctccttctaaagtttcccccttttctgggttttctctttcagacggtgttggggccgtgagaaacccaacctgttctgtttctttgagctttctgaataagaaagtgggaagcaggaaccttggtgtttctgcctcaactgtgcctcttactggggtgatctttgaaccctttgaggaggttaagaaggaagagcttgctgttcccactgctgggcaggtttcgttggctcgtcagtattacgctgatgagtgcgaatctgcaattaacgagcagataaatgtggaatacaatgcatcctatgtgtaccactccttgtttgcatactttgacagggacaacgtagctctcaagggatttgccaggttcttcaaggaatctagtgaagaagaaagagagcacgctgaaaagcttatgaaatatcagaacactcgtggaggtagagttgttcttcacccgatcaagaatgtaccctcagaatttgagcatgtggagaagggggatgcgttatatgcaatggaattagctttgtctttggagaagttagtgaatgagaaacttcggagtgtgcacagtgtggcagatcgcaacaaagaccctcaattggcagacttcattgaaagcgagtttctttctgaacaggtagaagcaattaagaagatctcagagtatgtggctcaactgagaatggttggaaagggtcacggtgtttggcactttgatcaaagtctgcttcatgatggacatgccgcttgatga

SEQ ID NO: 553 - DNA, 632 bp, Phaseolus vulgaris
aaacaccaccatggcagcatcagtctttaacactccctccttcacactctttgtttttctctctctccaactttatctctctttctcttcctcttcctcttcctctccctccatccatgaccttctccgttccaaaggactaccccctggcctcttgccagaagaggtaaagtcctacactttttcccataatggccacttggaagtgttcctagatgcaccttgcatgaccaagtacgagaacagggtcctctttgaacaagtattcactgctaacctcacctatggtagtctcataggagttgagggtctccaacaagaagagctctttgtgtggctccctgtcaaggacataatcgtaaatgacccttcttcagggttgatactctttgacattggcctcgcccacaaacaattctctctctccctctttgaagatccacctcactgcaagcccgaaggtgggttgaggaatcatgtgaggaaggaaaaaggtttggaggtcctgaggtagaaaaagatgccaccctgtgtttcgggcttcacttgttgtctttttctatgtcatgtttatataattttagccttgcaatgcaactatagttaatgagcttgtagcgtagaggttgagc

SEQ ID NO: 554 - DNA, 1501 bp, Phaseolus vulgaris
cactgccttcttccgcttctgggcctcgctcagaagtcagaatgatgtctgtcacaggcaaagccattgattttgctggaaaaaacttggtgtcctgtggttgctcttccaatgcttcctttgataggtacacggtcaggaactatgccaaggttaattcaaaagggtgtggcagaggtcatggagtttgtaaattgttttgttgtacgaggaggaacactcagtgtcgggtttcttctatgaagactgcagaacctacggtgaatggggggagtcaagcaattgaaagccttaccaagggatcttacttgaagggttattcagaatcccccatttctccagctacgttctttgaagtggttgctgatgatttgctaactctcaataaaaatcttcagtcgattgtaggagcagaaaatccagttttaatgtctgcagctgagcagatttttagtgctggtgggaagaggatgagaccagctctggtgttcttggtagcaagggcaactgcagagttgtttggcttgaaggaacttactgtaaagcatcgacgtttagcggagataattgaaatgattcatactgcaagtttgatacatgatgatgtactagatgagagtgaccttcgacgagggaagaaaactgtacatcaaatttttggaacaagagttgcagtgctggctggagacttcatgtttgcacagtcatcatggtatctagcaaaccttgaaaatattgaagtcattaaactaatcagccaggtgatcaaagattttgcaagtggggaaataaagcaggcctcaagtttgtttgattgtgatgttcaacttgaagagtatctaatcaagagctattataagacagcatccttgattgcggccagcaccaaaggagctgcgatcttcagtggtgctgacagaagcatcactgagaaaatgtatgaatatggaaggaatctgggtctatccttccaagttgtggacgacattttggatttcacgcaatcagcagagcaactgggaaagccttctggcaatgaccttgccaagggcaacctgactgcaccagtaatatttgcactggagaaagaaccgaaattgagggatatcattgagtctgaattcagtgaggttggttcacttgacgaggccatcaatttggttaagagttgtgggagcattgaaagggcccaagagttggccagagagaaagctgatattgcaattcaaagtctccaatgccttcctcagagtgtgtatcgtttagcccttgaggatatggtggcatataaccttcaacggattgcataagcttatgcatgctgaagtataaggacatactgttaaaagaaaaacacaaaaacattcttttggtcctaatatatagggataagaaacttgaacatgttgtcctttcaagaatttcttccaaattctactcctgtgctacttttggggtacttatatacgcattgaaggacaaagcaagtgcacattcacat

SEQ ID NO: 555 - DNA, 359 bp, Phaseolus vulgaris
acacaatggcttcggacgaaacccagaacaaagtgatcgagccctccagcagcgaccttctggccagcgcgaagctggtggcgaacgcggcgcagtctactctgcggaacgaaagtgacaaggtggacaagacgaaggtggcggacgcggcgggggaccttcttgacgcggcgggaaaatatgggaaactggatgatcagaagggcgtagggcagtacgtggacaaagctgccgattatctgcaccagtaccaggacaaggctgctgcaccttctcagcctgcagactccaaacctgaagaaagtggtggtttgggtggtcttgcaaacttggctggaggcttcttcaaaaagtagtaa

SEQ ID NO: 556 - DNA, 1182 bp, Phaseolus vulgaris
aaaggatccgttctcagtgtctctcccttccaaaaacacataatccatcaaattctgatggcggccatggcaaccactgccctaacttcaaaccccaaactctcattcttcgaccacaagcccacctccttccatggaaagcccgtttctcagtcccgcctcacacccacaaaatcctcctccaaacaacccacaatctccatgtccctaactccaccaccttacgacctccaatcctttaagttccaaccaatcaaagaatccatagtctcacgcgaaatgacgcgccgctacatgaccgacatgataacctacgccgacaccgatgtcgtcgtagtgggggcgggctccgccggcctctcctgcgcgtacgagctgagcaagaacccggcggtgagcgtcgccataatcgagcagtcagtgagccccggcggcggcgcgtggctcggtgggcagctcttctccgccatggtggtgcgcaagcccgcgcacctcttcctggacgagctcggcgtggactacgacgagcaggagcactacgtggtgatcaagcacgcggcgctgttcacctccaccatcatgagcaagctcctggcgcggcccaacgtgaagctcttcaacgccgtggcggcggaggacttgatcgtgaaggaagggagagtcgcgggggtggtgacgaactgggcgctggtttcgatgaaccacgatacgcagtcctgcatggaccccaacgtgatggaggctaaggttgtagtgagctcttgcgggcatgatggaccctttggcgccaccggagttaagaggttgaagagtattggcatgattgatagcgtccctggaatgaaggccctggacatgaacactgctgaggacgctatcgtgagactcaccagggagattgtgcctggcatgattgtgactggcatggaagttgcagaaattgatggtgctccaagaatgggtcctacctttggggcgatgatgatatcaggtcaaaaagcagctcacttggcgttgaaggctttggggaggaataatgcaattgatggaacgtgtggagttggaagggaagaaccagaacttgttttagcttcggccaacactgaggacattgttgatgcttaaactttatcatcacataccttttctgtttcacctgcagcctatgattagggtaccttt

SEQ ID NO: 557 - DNA, 947 bp, Phaseolus vulgaris
aaaggatcctgcacacagaaactaaggttggagttaatctctggtgctgttgaagagtgaaaaaaagggctagcatggacagcttggaagagcaagtgtttatgttcattgatgaacaatattatcattaccattccaatttttccaatgaatcagagcttcaagtggaggaggatctatggtggcaagacaacagcgattctgatgattcatcccagaggactttgtattgggaatctcaggtcgcactgcttcaggaaattttggagcattacagtcaaagtggctcaaaattgagacgagaggttggtcgaatcatagaagaggtgaagggttcagatttctgcagctgctataaggctaactttttagattgcagcacctgtttgagaagagaaattgttactaagctcagagatagaggattcactacaaacctttgtgtttcaaaatgggaaaccacaaaaaagtttccaggagggtgtcatgaatatattgaagtgtttgcaaatacatcatcaaagaagaatcagattcgtatcctgatcgaattggagttgagagaacagtttcagattgcaaaagcgagtgaaaattaccaggatctggtgtcgtgtttgcctgaattttatattggaaaaccagagttcttgactgccattattcgagtgatgtgcaatgctgcaaagaaatcaatgaaggagaagaaaatgcacgtgggtccgtggaggaagagtagtttcatgaaaatgaagtgggcagagttcaatcaaacattaaacaataaatcatttggtacacataccactcaatcttaccttggaatttcaggagctcatacacctgtggtggtaacctgaattagaaaaaatattcaattccattactgaattttgatcttagagaattctttagtagtaggagttgatgcccaagtgggtaccttt

SEQ ID NO: 558 - DNA, 525 bp, Phaseolus vulgaris
tcagatgacgtgtgtgtgttaagagtgtatcagaagagaagagaagagaagaggaggaagagaacaaagaagaaagtggtgtggcgtggaaatgtcgaagaaaggaggaagtggcgcttcgtttcagaaggacgtgccatggcgagcgtcttcttctactgtcaaacccatccccaaaattcaccactctccacttcttcgcgtttcccaaacacccgttaccgattacgccgtctccgtcatgaggcatccagaccctatagggagtggattgggtgacgatgccatagtggaagcagctggtcctgactgcctcgtacctggccagaaaatgcccatccaattacttggccttcaggtctggccaatccatgtggacctgaagtttttggaaccagttgggcgagaacttaagatgcttggaaagttcatggatgatgccgttgaactaatgaacaaatcattcatcgagcgttgattatacgtgcgttgattatacgtgcgttgcgaagagatgaaatagtt

SEQ ID NO: 559 - DNA, 775 bp, Phaseolus vulgaris
aaaggatccatattccattgccattaccgacctcacaactcatcgcaacaccttcaaatccccctctcctttctctcgctcctcttcgcaacccatccaccacaatcacaacccttttctcctttctctctccttctctctctctctctctcttctctctctctctctctttctctccctttttctctcatacgcaaaacctaactctcttttcttcttcctccatggctcagaaaaccgaaaacgaagaaaccgagttcaaggttcccgaaactattactctctgcgttaacaactgcggcgtcaccgggaaccccgccaccaacaacatgtgccagaactgcttttccgctttcaccgcctccaccgccacaacctcatccgccgcctcggccggaatctcctcgccctccgctagatccgttgcttccgcgcgtcctcagaagagatccttccccgaagagccttcttcggctgcagatcctccctcctccgaccaaaacgcgccgtccgaggccaaacgcgtcgtcaaccgctgctccggttgccggcggaaggttggactcaccggattccgatgccggtgcggcgacctcttctgcgcggagcatcggtactccgaccgccacgactgcagttacgactacaaagccgccggaagagaagccatcgccagggagaatccggtggtcagagccgccaagattgttaaagtctgaaagaaaggaaaaaaacacaaaaaagcaagagaaacctgaaacggaatggtaccttt

SEQ ID NO: 560 - DNA, 955 bp, Phaseolus vulgaris
aaactcgagcgaattcaaagttctgtgggacaaaaaaaaatccaaaattttcatggcccttctagttcacgcccctgaaatatctgttgctcttcaaattgccccaaaccctaaccctaggctgagcaaagtccacagcttcaaaccccagacaaagggcaaaacgattgggtcggctcgcggagtgagagtttcttgcaaagtgaaagattgtgcagttttggatgagagcgtgaactcgtacggtcaattttcggctcctgtgaagccagggtcgaagcagagcaaagagaaggaagaagagaagcagaattaccatgttaatgtgggatacgctattcgaactttgagggaggatttccctgatctcttctacagggaacttagctttgacatctacagggatgatattgtgttcaaggatccaatgaacacgttcattggtattgagaattacaaatctatcttctgggcactacgattccatggcaaggtatttttcaaagctttgtgggttgacataagtagtgtatggcagcctgttgagaacgtcatcatggttcgctggactgttcatgggatcccacgagttctatgggagagccgtggtaggtttgatggaacctctgagtataaacttgacaagcagggcaagatttttgaacacagggttgacaacattgctacgaattcacctcctcggttcaaagtgttgagtgtggcagaattaattcagtctattggctgcccctcgactgcaagaccaacctattttgaaacatcttcacatcccgagagaacgtaatgttgctcaggttcttcaagaagttttggtgtaaattgtgcatattatggtaaacaacaaaacatggagttagatttttatcttgcttgttacataaacctgtgagaaaaaggtcctttgccattgacttggtcttgtggtaggcctttt

SEQ ID NO: 561 - DNA, 3190 bp, Phaseolus vulgaris
aaaggatcctgctctgtgttcgtttagttgctccgtcgagtcatatcaattctcaagtatgaggattgccaaggaagaatcatcaagcagtgctgcacaggcaataagcttgatatcagcagtgaaggaattgcaagaggttactgctatggatctcaacaaattattgagagactctgaaaatttcactattcagtaccttactgaaaaaggatcaatactgaagattgatatggaaaagcttgtgggatctcttccattgcaccttagtaccctgctgatgtcagctgttagaaatgaagccttgttcagatacctgttacgtggcattcgactcttgcattccttgtgtgatttagcctcccgaaattctaaattcgagcagattatgctagatgatgtgaaaattatggaacagctgactgacttggttttctacatgctaattgttcttggtggatacagaaaggaataccatgcttttagttatatgcaccttttgcattcaactcttgtagcatgcaatttacatctattaacagggtttatatcaacacaatggcaagatattgttcatgtattgcttgcgcaccccaaggttgacatatttatggatgcagcttttggatcagttcgcatggttgttagttttcttgagaatacactggtagcatatcaagaagatgtttctgtggaatcaaatcttactgcaggacaaatagtttattatctctgccagcagtgtgaagcttctctgcagtttcttcagtcactttgccaacaaaaattgtttaaggagcgccttctcaagaataaggaattatgtgaaaagggaagcattctttttctggctcgatccatcttgaagttacacattcagccatcttttccatctagggtcatggcggctatttctaggctaaaggctaaaatactatctattctgctgagtttgtgtgaagcagaaagcatttcttatcttgatgaagtagccagctcagcacgaagtttagatttggctaaatctgttgcattagaggtttttgacttgttgaaaaaagcttttggaagagatcctgggcatctcactgctgacagaagtcatccaatggggtttgtgcagctcaatgcaatgcgtcttgctgacatcttctctgatgattcaaactttcgatcttacatgataatttgttttactaaagttctgacagcaataatttcgctctcccatggagattttttatcctgttggtgttcatctaatctgtcagagatggaggaagatgctagtcttgaatatgatatatttgctgcagttggatggattttagataatacttcaccagatgtaagaaatgctacaaatttggaattcaacctagtccctaacagcatgcctaaggcttcttatgcacatcataggacatcattgtttgtcaagttctttgcaaaccttcattgttttgttcccaacatttgcgaagagcaggagaggaacctttttgttcttaaggtcatggagtgcttgcaaatggatctttctaacttgctgcctggattttcttttgcttctgatgctcctaaagctgccattgctagcaaaaacctccgctcattattaagtcatgcagaatctttgattccaaacttcttaaacgtggaggatgtgcaacttttaagagtgttttttggtgaattacaatcactgtttacatctactggatttggggaaaatcaagtccaagatagcaaatttgaggagtcacaatcttgggataagatttctaaattcaacatcaatgaacattatcaggaggcacagagtgcagtgggatttccgccatctttaactggaaaagaacctgctgatctcaataagaagggtagtaacttcaaggaaggaatgtctgagaattctgcatttccggacatggaccaacataatagccgagctgaagagacaaatcaaggcaagggcttaaataggcaaaatcaggtggatgataaagggatacctggtaaaactgcatcaggaggagcaagagatatggacaaggatgctcagaatgttgaaacaagtggttcagatactagttctgcaaaaggaaagaatgttgttgatcatatggatattggagaactttcaaaatcaaatgagcgtcttaaacgaactgcagttgaggaaaatccagaggatgaaaagattgagctttcacaacgaagaaaacggaagcgaacaataatgaatgataaacaggtgttgttgattgagagggcactcaaagatgagcctgatatgcagcgtaatgcagtttcacttcaatcatgggcagaaaaactaagcgtgcatggttccgaggttacatcttcacagcttaaaaattggttgaacaaccgaaaagctaggcttgctcgcacagctagggatgttcgcacagcaggaggtgatgctgataatcctgtcctagaaaagcaaagagggccagtacctgggtcctatgactcacctgaaagtccaggtgatgtatcacatgttgcgagaatagcttccggtgataataaaccagagccttctctggctcgatttgttgatattggttctccagaatttggtcgttgcaatgcaggtcagtatgttgtgcttgttggtgttcgaggagatgaaattggcagaggaaaagtgtttcaggtgcatggtaagtggtatgggaagagcttggaggaattagccacctgcgttgtggatatttgtgagctcaaagctgataaaggtatgcggctaccctatccatcagaagccactgggaatacatttgcagaggctgaaacaaagttaggtgtcatgagggtgttatggggctcgaacagagtttttccattgcggtctgaaatctgaatgagtttaattatgctttcatttgctgcagcagctgctattcctctgctacctgctgcaaactgttgtcaatcttacttgtggttccctgaatgcacatattttctatttccataaacactgaagggatactagatgacttagttgagaagatcatcattacttgatagaaaagagttcagtaagggacgggtagaaagtagaagtcgataattatggagaaaactagggcgatttcgcaatgaaagatagtttagtttagggtataaacaagaggcatagcggggtaccttt

SEQ ID NO: 562 - DNA, 494 bp, Phaseolus vulgaris
ggtttggtttggtttgaagatgaaatgatatgctaacagtagaaagagaagaaagaagaatagtagcggtggtgccactggtgcagaggacaaagagaacaaagaagaagaagaagaagaataagaagaataagaagaaacagcagttcatggatgtctggcgcaacatcatcttccctgtcaggcgtgtctggcttgctctctctgctcgcctcaaggctcgcaaaaacggagcaggactgctgaagcttcaggatgatgtacagacttgtggatatgaagatgtacaagtgatgtgggaaatgctacaaagaaccgaaagcgatgttgtagaaaaccaccataagcgtaagcaattgccgttctggaggatctttgtatggtccaaccacagtgaagtttcatcagaatctgcaaatcacacttgaaaccagacacgggttttcagtttacaaataaaacctccaccgatgtattgcagtatgcatctgtag

SEQ ID NO: 563 - DNA, 3317 bp, Phaseolus vulgaris
tgttcgttctcttattgcgtttgtttgtttttttgaagttaagcttttctgtgcggtgtaatggtgagtgacagttacagtaagatgatatctgatgtgacaattcgatcgatgatgaagaacggtgaatactgcggtgaagatttgggggttctgagggagaggaaactcgctcggttgcgtagtgggtcggcccctccaacggtggaggggtcgttgacggctgtgggagggttgtttgaggggtcaccggctgctgtggggtatggtggcataaggggttttggaagcgaggaagagcttcgggctgatcccaattacgctaattattattactctaatgtgaatctgaacccacgtctgcctcctccgctggcctcgaaggaggactggcggttcgtgcagcggttgaggggtggttctaaggtggggggtgtcggggacaggaggatggccagtgatgacggtggaattgaaggtggccatagcaactctttgttctctgtgcaccctgctgggtttggtgtgaaggaggaaggtggtttgaagcaccgcaaagggggtgctgaatggagtggcgaggatgggttgatcgggttgccggcattaggcctagggagtaggcagcagaggagcattgcggaactgtttcatgatgaaaggaataatgcatcatctgcatccaagcaccctcataatctacctagcagtaacttatttgatgatattgctgaaaaatctgaaacccgtgttgcttatgtgcatcaagaactgaatgccctgcggtctggtgggaataagcagggtatatctgctgcccaaaattttgttggttctggacctcaaagttatgcttctgccttaggagcctccctatcaaggagcagcacccctgactctcagcttctaccaagagctgctagtccttgccttccacccattggtgatggcaggtccagttctgctgataaaaaaatttctaacggtcaaaatttactcaatgctgtctcatctaatttaaatgactctgcagatctggcgtctgctttggctagtatgaatttatcaacgaaagatataatagatgatgagaaacattcccagtcatctaggcacaatgagttagattatactcacagttttaaacagcagccttacttaaacagtcctgattccttggcttatcaacgtcattctgctacccaatcccatttaaaattgaataagggcagcagttttggattggatctgaataaatcaccaggatatgcagatgaacagctagaaccccataaggctggtggagtttctgttaacacgcatttgaaaggaccttccacaccaacttttactaacagaggtagttcacctgctcactatcagaatgttgaagatatctcatatccaaactatggcatgactggatatagtgttaatccttcatcaccatccatgatggcaagccagcttgggagtgggaatttgcctcctttctttgaaaatgctgctgttgctgcatctgcactaggattgaatgctatggactctagagcactgggaagaggtgtagctttaggacctttattggctgcaactgaattacaaaattctagtaggcttggaagtcatgctgccggtagcactcaacagttgcccttgatggaccctttgtatcttcagtatctgaggtcgggggatgttgcttctgctgcacagattgctgcgcttaaggaatcagtgataaatagggaatgcacagatttacttggcctccaaaaggcttatgttgagtctttgattgccccccaaaattcacatttcaatgttccataccttagtaaatcagctaccttgagccctaattcttttggaaatccatcatatggtctggctacatcatatccaggaagcccactggctggttcccttttccctaactccctctatggaccaggtagtcctatgaaccaaagtgaacgaaatatgcgtttgtctgggatgaggaatgctgctgggggtttcatgggagcttggcattcagacacagttggtggcttagaagagaattttccatcttccttgcttgatgaattcaaaagtaataagaccaaatgttttgaactttcagaaattgccgggcatgttgttgaattcagtgctgatcagtacggaagccgatttatccaacagaaacttgagactgcctcaatggatgagaaaaacatggttttccatgaaatcatgccacaagcactttctctaatgactgatgtcttcggtaattatgtgattcagaagttttttgaacatggaacagcagcacaaataagagaacttgctgatcagcttacgggtcatgtgctgaccctaagtcttcaaatgtacggctgtcgggttatccagaaggctattgaagttgttgacatggatcagcagactaaaatggttacagagttggatggtcatattatgcgttgtgtacgtgatcaaaatggaaatcatgtcatccagaaatgtattgaatgtgtgccagaggatgcaatccattttattgtttcaacgttttatgaccaggttgtgacattgtcaactcatccttatggttgccgtgttatacagagagtcttggagtactgccatgatctcaaaacacaacagattatgatggatgaaattttgctgtctgtgtgtatgttagcacaagaccaatatggaaattatgttgtacagcatgtgctggagcatggcaagccttatgaacggtcagctataatcaaagaattaactgggcaaatagtgcagatgagtcagcagaagtttgcctctaatgttatagaaaagtgcctttcctttggaacacctactgagcgtcaagtccttgtgaatgagatgcttggctccacttatgaaaacgagcccctgcagattatgatgaaggatcagtttgcaaactacgttgtacagaaagtgctggaaacctgtgatgaccagcagcttgagctaatccttaatcgaataaaggttcacctgaatgccttgaagaagtatacctatgggaagcacattgttgcccgtgtagagaaattggtcgctgctggggagaggaggattagtattctgactctaaatcctgcacagatggtatagagaatgtacagctaactgaagataatagaagcacctgctcttttttcttttcatatgtggtattgctaatggccctgtctgtattcaggtagttaagtaataaattagttgtacttgaaattgtacatttgttagtgtgaggataatacagctagaatcaggttagccga

SEQ ID NO: 564 - DNA, 1049 bp, Phaseolus vulgaris
tcatcatggacgctcagagagctttgctcgacgaactcatgggtgcagcccgcaacttgacggaggaagagagaaaggggtataaggaagttacttgggacgataaggaagtgtgtggattctacatggtgcgcttttgccctcacgatctcttcgtcaacacgcgcagtgatcttggtccttgcccgagaattcacgacccaaaattgaaagaaagttttgagaaatctccaagacatgatgcatatgtacccaaatttgaagccgaactttctcaattttgtgagaaattggtgatggacttagatagaagagtaagacgtggacgagaacgccttgctcaagaggttgagccagcaccacccccacctctgacagctgaaaaatccgagcagttatctgttgtggaggagaaaataaagaaccttcttgaacaagttgaatctcttggcgaagctgggaaagttgatgaagctgaagctcttatgaggaaggtggagacacttaatgctgagaagacagctttaacacaacctcaaaatgataaggtgttgatgcttggtcaggagaagaagatggcactatgtgaaatttgtggttcttttcttgtggcaaatgatgctgcagaaaggacacagtcacatgtaacaggaaagcaacatgttggttatggcatggttcgtgacttcataactgagtataagactgctaaggagaaagctgatgatgaggaaaagttagctcgggaaaaagagaccgaagaacggaagaaacaaagggagaaggaatctgagaggaggagacgaagtgattcaagtgatagggataggcatcgtgataaagatcacaatagggagcgggatagatatagggatagagactcggagcgtgaaaggtctcgggaacatgatggtagaggctatcgagatgggggaaggggagtggattataggttgaggaatggacgaaatggaggtagagacaggtaccgtgatcggagcagatcacgttctcctgttaagcatggctacagaaggtcttcttgatga

SEQ ID NO: 565 - DNA, 1010 bp, Phaseolus vulgaris
aaggcatgaatagaggtgttcttcagagctcaccagtgcaacaaatgatcactggaaaccctaactggtggaacatcaatatcaatagcatgcctccacaagctcctcctttcttctccaccactccttcaaactttcccatcccttatgctcccacttctcttccctttccttcttggaatgagaatcaagagcttcctgaatcatggagccagctactcatgagtggggtggtggatgaacaaggtaaggttgggatgggccagtttcagagcaagaagttggagaactgggaggatcaaatgctagctcaggctccaaacgcttctcttgttgatgttaaacaagaaaattcagctaacagctacgtatatggccatggaaacgaagagcttcagtcatcaaaaccatcttggtctccaaaatcatgtgtcacaagtttcagtagcagcatgttagatttctctaacagcaacacagatgcaaggcatccaccaccagatcgatcttctgagtgcaatagcagtgcagctggtggggcactgaagaaagctagggttcaaccctctggcacaacacaggccacattcaaggtcaggaaggagaagttaggtgacagaattactgcccttcatcagctcgtttccccatttgggaagactgacacagcctctgtcttgttagaagctattgggtatatcagattccttcagagtcaaattgaggcccttagcttaccatacttgagtggtggaccagggaatgggaggcagcagaattctgttcaaggagagaagaattgtatattccctgaagaccctggtcagctgctgaatgagaactgcttgaaaaggaaagcagcaggagaaccggatactcaggaagaacaacagaaggggctgaggagtagagggttgtgtctggttcctgtgtcatgcacactgcaagttgggagtgacaatggagcagactattgggcccctgccctaggagggggctttcgttagtaa

SEQ ID NO: 566 - DNA, 742 bp, Phaseolus vulgaris
attgaaggtggcgtttgagaatcaatgggggagagtgacagagggaaagggaatgtgagcttggagggagagaaggtgatattggtcccttacatggaggaccatgtccccaaatatcaccaatggatgaaggacccttctctccttcaagccactgcctcagagcctcttaccctccaagaggagtaccgcatgcagctctcctggttccaggaccctaccaaggagaccttcattgtactggacaaggacttggttgttggacaattctcgcacggacaaccccaccttgaagccatggttggtgatgtgaatctattcatgaatgatttggatgatcctcatgtggcagaggttgaaataatgatagcagaaccaaagagccgtaggaagggacttgggaaggagtctgttctgatgatgatcacctttgctatcgagaagttaggaattaatatctttcggactaaaattggggactcaaatggagcatcccttgatctgttccaaaaattgggatttgtgcaaacttcatatagcagcaccttcaaggaggtcactttggagttgcagataacacagcccaagaaagaggagatacttggtttaatcaaaatggtaatcaaacatacataaacgtagcaatatcacttccagtttatttattggtaatctgtaactatattaaggggagacatgcttatgtttttctttttagaaggaacaatagacacgatgcaca

SEQ ID NO: 567 - DNA, 1961 bp, Phaseolus vulgaris
aaaggatccagtgttgggttgagtgtctccctctccgtcgcagcaacggagtaattaaacgtcgccgttttgaatttcgccattcacgccttcgtgcaacccaggcttcagtgggagcacatggcttccatgcattccaatttcgtccccaatttgtccttcaatcgcttccagacaccaccatcatcgtaccttgttggtgctggtattgtgcaacgtggagttattttgagcaattattgtagaaggagggttccttgcataaagtgtgaaaagaaagatgaggaggagcacattaagcatgtgtcggtggagcgtccaccctatcacagttactttgactccacctctggccagctcgagccggcctccggcgcccgagcgagtattcccagtcaagagtattggcctgagggaactgctagtcgtgtgagggcggcaagggcaccggctccaactgctgaatcaacaacctctccatcttatggagccaagcctggaagtaggaggaagaactacaaggcatctgttcctgctgctgcttcttcttcgtctcagtccactgtggaattttctggtgctggctctggctcttctgagcttttggttgaatcctccgaagaatctcaggatcactcgtctgagtttgttgtttatcagtctgaacccgaggaggaagaattgagtgaatatgagttcaataagagagttggactttctcatccgtttgttgatccaaagactaaaaggccgatagagggggtgcttcccaatgaggagctgtggtggaattggaaagagtcggacaaagaacaatggtccaggtggcaaaggaggaaacctgatgttgaaacggttttcctgaaagctatggcagaaactggacaaataaagcttcacggtgaagagccaacattaacagaaactgccctttatcgagcaaggcgtgaaatttataaagaagaaaggctgcaggctgagcaagagagactggaaagagatggtccaattgcatactattcagaatgggtgaaagcatggaaaagggacacatctcgcgaagcaattcagaagcattttgaagagactggagaagatgaaaatgcacaactagttgaaatgttttgccaccaaactgaccgagagtatcgggtgatgatggggactgattatcgaattcaaagggaccctttagcaatgcgaatgagggaggatcagataaagcaaatatggggtggagatccagtttacccgactgtgaactatattcaagatccaaatgaagtgattgactacagggggccaaattttcatgaaccaacgccaaatatggtggcttatctgaaggagcatggaaaactcacttcaagggatgaatttgacaagactatggccgaggaaaagactgaacttgttgagatgacggacatggatgaagctatggccaaagctgttgacattggggagaatgatgatgaagaggatagtgatgttgaggaggtagaggaagggggagaggaagagaagcttagtgattattggagtgtgttgaaaagtacccctgagcttcgcaagtcaaagccacagccaaagccaaagaaaaatggtgctatgtcactggacgaagctgtagaggattcagaaaacttgactgatttcctcatggactttgaagaagaagaatgacatgcatcctctgttgcatctcaagtggagtattgtattgctttgtagacagaatagaaggtttggttgttaatcttcttatgtcaatttctataccctctaagtaaattctaggtaggcacagccacagtggatgtgtgtccaatgcgataattattagagtgcgattctgattcaagggtgggttctagtttctgttaagcacttgttccctaaacatgtctacattaacaattttgaaatccctcttcatacggaacctagcaggtaccttt

SEQ ID NO: 568 - DNA, 610 bp, Phaseolus vulgaris
aacctttgaatgtgagcaaataggttaataattatagatcattatagagattaagacactggttttcactcacagtttcataacacagtacaatgggttctcttatggcaggatggggctctacccatgtggatcctaagtcagccacacttaagaggaaccgttcactgacaaaagatgaaattgatgcttattggaaatcaaagaagaagattgaggaagaacacctcactgctatttccagttctccacacactcttctgaatgaagatggcagcaggagcactgaaaagaagtttcagaaatcaataagcatgccagtgacacgtgtacgtgaaagcttaaatattaaccttgttgatacaagtttggagcagcttataaagaaaaatggctggtggacgaagagtagctgggcatttctgaatgagcctccagtgaatgaagctgcatcctataagtacacatcacagtttcatgtcaccaacatgccttcatccaaaaataaaattactgcttgatttatataaatatacatcaatactatataatatataatatgtgtagtgctcaaactatatattagtggatttagttggtgctgttcatg

SEQ ID NO: 569 - DNA, 569 bp, Phaseolus vulgaris
tagcaatggcaaagaaagagatggatgttgtgaagggtttggacttgcaaaggtacatgggtcgatggtacgagattgcttcattcccttcgttttttcagccaaggaatggtgagaacaccagagccacatatacccttaacagcagtgagggcactgttcatgtactgaacgagacatggagtgatggaaagagaagcttcatagagggtagtgctttcaaggctgaccctaaaagtgatgaagccaagttgaaggtgaaattttatgttccacccttcttgcccatcatccctgtcactggcaactactgggtcctctttgttgatgatgattatcagtatgctttggttggcgaaccaaccaggaaaaacctttggattctaagcaggaatacccaaatagatgaggagatctacaagcagcttgttgagagagccaaggaagaaggatatgatgtgagcaaactccacaagactccacagagtgatcctcctccactaggggaagaaggacccagagacaccaaaggcatttggtggatcaaatccatttttgggaaatagtag

SEQ ID NO: 570 - DNA, 1268 bp, Phaseolus vulgaris
aaaggatccatgttcctctgcaactctgacctgcagtctatagacacccaacttcaatggagagcagtgcggccatggatgttgaggagcaaccttcacccaaccccactaacgtaaaacgcttcggccttaaaaactctattcaaactaacttcggcgacgactatgttttccaaattgtcccaaaggatgattggagtgcaatggcggtttcactgtcaacgaacgcagtgaaactatattcacctatggcgggtcaatatttcggagagtgcaagggtcacaccgcaaccatcaatcagattttattttcgggtacttcacatcaccaagttttgtgttcgtgttcttctgatggcactgtcagagcttgggacacacgcacatttcagcaggtttcttgcatcaatgctggttcttcgcaggaggttttcagcttctctcttggaggaactagtgggaatttagttgctgccgggtgtaaatcgcagatactgttctgggattggagaaatatgaagcaaattgcatgcctggaagactcccatgtggaagatgtcactcaggttcattttgtccccaacgaacaaggaaagcttatttctgcttcagtagatgggttgatctgcacatttgatactactggagatatcaatgatgatgatcatctagattcagtgattaatatggggacttcaattgcaaaggtggggatttttggagagagttaccagaagctttggtgtttaacacatattgaaaccctgggtatctggaactggaaagatggtagaaatgaaggaaacttctcagatgcacgtactttagcttccgaaagttggaatttggatcatgtagactatttcattgattgtcactactacagagaatctgaaaaactatgggtgattggtggcactaatgctggtactatgggctactttcctgtaaattacaaaggggtggcaacaattggagctgcagaagcaattcttgaaggtgggcacacaagtgttgttaggagtgttttacccatgtcaaaaattcattctaatagtcctacccaaggcatttttggatggactggtggggaagatggtcgactatgttgttggctctctgatcattcctctgaatcaaatcgatcttggatttcaagcacattgattacgaggccagaaaaaactcgcaagaaaaatcgtcatcaaccctactagcagaatccgttaactctaatagttcgataccgaaggagctagggtaccttt

SEQ ID NO: 571 - DNA, 926 bp, Phaseolus vulgaris
cgaaaatggctactatagaatctgccctcaccctgttcgcacctcaacgattttcggactatcgttcgtctgcaaaaccccctcactccattaagctccatgattccacttcccttattttctcttccaatgcctcctctttcaaaactgcaagactctgcttacggctatgctctgctctgcaagagctacccacaacagagaaaacacctggcccaacccaaccaactgacaacctcaccaagctctacgttgctaacttgtcttggtctctgtcgccggctgacatcaagggcatatttgcccaatgtggaaccgtaacagacgtcgagataataaggaacagaaaagggaggcacatgggatatgccttcgttactatggattccggggaagaggctcaggttgctgttgataaatttgactcatctgagttatcaggacggataataagggtagagcttgcaaagacattcaagaaacctcctcctcctcctcctccacctcctccacctcctcaacctagagagacacgtcatgtactttatgtatccaaccttgcatggaaagcaagatctacccatctcaggcaagtcttcaccgaaaatttcaaaacaccagtttctgccagggttgtctttgatagccctgctaaacgatcagctgggtacggatttgtttcttttcttactaaggaggatgcagaggctgccatttctaatgtggatgggaaggagataatgggacgaccgcttcgcctaagctttagtgaaaagaaagataatgaagctggaagtgaaaaagaggaagaccaaattaaagatgctgaaagtgaagatgaagaccaaggttctgttgctcaaccagaagagtcataaattttggatattcatttacttgtctttgttcgtggtatgggattctag

SEQ ID NO: 572 - DNA, 1471 bp, Phaseolus vulgaris
tcccaaccctttaatagatacaccatctcacagacatggctcttcaaggttcaatgtcttttgctgctttcactcttttcttggtcctcacaacagtctctcatggcagaaatatcaaccctcccgtgtatggtatatgttcctcttctgtcattctgcatggatacaagtgccaagaacacgaggttacaaccaatgatggatatattctgagtgtgcaaaggatcccagaaggtcgtgctaatggcagtggtagcagaaccaggaaacaaccagtgatcatacaacacggagttctagtggatggtatgacatggcttctgaaccctccagagcaagacctacctttgattttagctgataatggctttgacgtttggattgctaacagcagaggaaccagatttagccgccgacacatctcattggacccctctagcccggccttttggaattggtcttgggatgaacttgtctcctatgatctaccagccatctttaattatgtattcacccaaacgcagcagaagatcaattacgttggccattccttgggaactttgacagctttagcatccttttccgaagggaaattggttaaccagctgaaatcagcagccttgttgagccctatagcgtatttaagccacatgaacacagcacttggtgttattgcagctaagtccttcgttggtgaggtcactaccctcttcggtctggcagaattcaatccaaaagggttacctgttgatgccttcctcaagtctctctgcgcttaccctgggatagactgctatgacttgatcactgaactaactggtaaaaattgctgcctcaattcttctactgttgatatattcttgaggaatgaacctcagtcaacatcaacaaagaatatggtgcacttggctcagactgtaagacgtggggtgttgacaaaatttaattatgtgagaccagattataatattatgcattacggagacgtattccctcctatctacaacctttccaatatccctcatgaccttcctctcttcattagctatggtggcagagatgcactttcagatgctcgagatgttcagaatttacttgataacctcaagttccatgatgtggacaagctcagtgtccagttcatcaaggaatatgctcacgctgactacgtgatggggttcaatgccaaggactttgtatacaatgctgttatttcatttttcaatcatcaagttaacacttgatgccaagcaaactacgtcatagaaagaaccacgtggcttcatacgctagtgatcactgagatcaatcaaaagttatctagtgaagattaagtaatgaccaattacaaaagtaatgaagtatcactacaccagtgatttgctttggtgtttcaatggctgtgtatctattgtaatgcagaagaaattggctattggcctcaactatgtaacatggaaacacgtggatg

SEQ ID NO: 573 - DNA, 1067 bp, Phaseolus vulgaris
ttgggtgcttacaaggcttcaaaagttgaagcctttaggaatctgagggatgggtttctcagtggcagcttcgttgggtactcatattgcactgagaaacactcacgaagcaagaatcaagtgccactttttgtacaaaagacaagagagcaatataattggtttcaagttctcaaagcccaaggcccttcaaagaaagatttctctaagcaagcaagagttcagtgacttggatgagaggaagagcccagatgaggttagagaagagattaaaaaatgttatgaactcataaacagattagggagaggagctgtgtatctgggttcttcaaggatgggacccagtcattcacattatgtgcagacacaagagctggctaaagagatagcaaatcttttggactgcacttcttggtcaggggctggaccagggctaatggacgctgttactcaaggtgccatgctagcaggaaaaccagtcggtggattcaagataggaaaagaagctggtgaatggacagcatctaactttcatccatacttaccatcagaaaattacctcacctgcaggtttttctctgcaaggaagcatgggctggtggatgctgtagtgaggaacaactcatttgataagactgccgtggttgcccttcctggtgggattggtactttagatgaggtgtttgagatgatggcattgattcagctggaacggattggatcaaagtttcctgttcccttgctcttgatgaactatgattcattttattcaaagctgcttgatttcttaaatgactgtgagggttggggaactgtctctaaaggagaggttgcatcattgtggaaggtttgtaacagcaactcagaagctttggcgtacctagaagaattctatggcatttcttctattgacaaaagtaagagtgtaactaaattttgtagcacgtatgaatcaccctcctcgtgagattttttactttccttttcttcctgaactattgcaatattaccaggtttttgttgacatttgacatgtgcactagcaagttctgattgtacatgaaagg

SEQ ID NO: 574 - DNA, 2357 bp, Phaseolus vulgaris
ctcgcagaaggtgaagaagaagaagcaaacacactagcttatagcttacaacaatggaattgaaggtgctgacacagatgcaagtgaccctgctgctgctgctgattgtgttgacaagaacaggaactgcagcagatgaccaagacctgctcggctgcccgaacaagtgcggagatgtttcgattccatacccctttggcgtaggtgtgtcagatatcacgggaaagaactgttacttggagaaaaacttggaactcaattgcactgactccattctatacgcaggtaacgtcgaagttcagaacataaccctcgtcggtcaaatggagatgaatttcttcgtctccagtatctgcaaaatcaacatttctaacggaaaaaataaatccaacacacccacactccaaactgcatccttcactatttccagcacggacaacaagttcgtgagtataggctgcgacacgtacgggtatctcaacagttacgtcgaccaagctaaatactcaacagggtgcttgacaagatgtgacaagaatgacccgaatgtgaaaaatatgcagagaaatgatgggaaatgttcgggcatagggtgctgccaggtggatatacctcctggaatgaagaacatcagtatacaagcatcctcctttgatgatttcaaatccttttcgggtaacagctgcagcgtttcgtttgtggtgaaaaatggcgggtacagtttcaagatggatcatttgaaacacatcccattcgataaggctcccatggtggttgattggactgttggagatggtgcctgtaacgtttccaagaataacgacaactatgcgtgcaccagtaatcatagcgtttgcgaggacccaccctatgccaatcgaaatggctaccaatgcaaatgtaaacaaggttttgtgggcaacccttaccttcgcactggttgcacagactttttggaatgtacaacgggcaatcacaattgcgcaagagatgagtattgtcatgatattcctggctcttttgaatgtttatgtcctgttggactaaccggaaaagcaacaaacggaggtggaggatgccaaccaaaaaaggaggatgatgcatttaccaagatcgtcattggatcaggtgtaggattaattgctctatttgtgggggtttcttggctgtacttgatgcaccagaaaaggagactgctcaaattgaaggaaaagttctttcagcagaatgggggcatcattctaagacagaaactctctgcaagaggagaaacgtctcaatccgccacaattttcagtgttgaggaactaaagaaagccaccaacaattttgatgagagtttaatcattggtagaggaggttttggaacagttttcaaaggagttctcttaaataacgaagttgtggccatcaaaaagtccaaaataatggactcgagccaagtggagcaattcatcaacgaggtcattatactgtcacaaattaatcacaggaatgtggttaaactctttggttgttgtttagagacagaagttcctttattggtctatgaatttgttgaaaatggcaccctttttgattatttgcataagcaaggccaggtgcctaatgtaagttggaaaacgcgtttaaggattgctacagaagcagctggagctttgtcatatctacactcggaagcttccatacccatcatccacagagatgtgaaaactgctaacatactcttagatgaaagtaacacagccaaagtgtctgactttggagcttcacgattggttccacttgaccaaactgaaatagccacaattgtgcaaggaacctttggctatttagacccagagtacatgcaatcaggccaattgactgaaaaaagtgatgtttatagctttggggtagtgcttgtagaacttctaagtggggaggaacctttctcttctcacaagacagaagagaaacgaagtctcacatttcattttcttagtagcttggaaaaggattccctgattgatgttcttgagaatgatattctggatgaagaaaataagcaggagattatggaggttgctattcttgctgccaggtgcttgaaacttagaggggaggaaaggcctagcatgaaggaagtgacaatggaattggagggaataaggcatatggacaaacacccttggaccaatacaagccaagattttgaggagagtcaatacttgctttctgagccacaaagcactcctgaacatggttacagtagtggccaacaaagtactggatttgatagcttgagagaacttgaattaattaactttggtaatgggagatgacacaccacaccaacaatatcaattcccacttag

SEQ ID NO: 575 - DNA, 3099 bp, Phaseolus vulgaris
tcacttgccgtctctttcttcttacaatggaggtctcagacgacgacgacggtggccacgttttccttgtttgtactaacaccgattcaatccaagcagccgaaaccctaaacaatgagattctcgtgtccacaaccgatatcctcgcttgggatctcccaacgattctcacttttccgacgattaaagttcaggcacatcccaataggctcattgaacaatctttgtatttccgcggcctcctcagcgggaacttcagtgaatcatgcttgggctctatctctatcaattggaatgtgagcgaatttttgcaaattcttaagcatatgtgtgactgcgttttggatattacgttggataatttcttccctctttatgagggtgcgctttattttggagtggagtcacttctcttgaagtgtgaggtgtggctttctgaggtgctctcacccgaaggatttcaatctactcaaataaaaatggaggacttgatccaaatttggaaatttggttcagatcgcgcaagcgactatgtcctgcacttatgtatgggctacctagcaagaaattttatgtgggcaaagcatagcaatttttttgttaaacttccatttgacctgctgttatcttctgtaaagcaccctcatttgactgttgacagtgaactgcatctttctgatgcacttcttctctggcttgaaagtaacttggaaaatttggagaggccaagcaaaactgaagacaattgcaacggaattttgaaacaaattcgtgtgggccttttgcctttgtggtttgctctaggaaaaagaaactctttttattttagacagctggctgaggaaagccttgattcaattttcagactactgaatattgttcctatgggttcactagatactttcaagtatagtgacttgcatcatctcaggattaggttgacagaatattcaaagaaaatggacctttctggttgcccgcaaataacatctaccatacttcgtctgtcactcatccctcaatcatatttaacagttcccatgcaaaagaagattatagaaaatttatttattaattgtgaacatcctgtaagagataaatgggtgttcccccaaaatctgtcagaagaaaccttgagctttgaagcagttcaggaggtggatatgtctaagtgtcaaaaattgtgtgttgaacatgctgttgattgcttccgcaagtcctttccttctttaagaacattgaaagcaggttatcttttgaatattgggacaatcagtttccttcaattattggagaaatgtcccttggtttctgaaattgacttgactgttgatattaccccactgataccagcatcagttacagttttatcctctagtcctgctgagatacaaccaataccagagaagacttcgagtgttaaatatcaagcagtgcaaatcatgttatttaatgaatttggacctcctctttctaatgttacaaagctcacattggaaggaagaactgatgtcagtgatttgggcctccagtacatctccaaattatgtgtttcattgtgtcacctgaatattaaaggatgcatttctgtcactgatattggcatatcagatctcatatccacgagtaaaaaacttaattcaattgtggtttgtgatacttcatttggggtaaattcagttcaagctctttgctcagctatttctgatagtggcaacatctctctgcattctagagataagcgtttgaattcagcggtgtctaattttgaaacattgcatattggtggctgccagggtgtttctaagtcatctctaatagagcttatgtctcaaacacaagttttgaagagtttatgcctgagaggaactgacctgattgaccaggcactgtataactatgtaggttcttccttggagatgcttgatatttcaaatacaaagatttctagggctgcattagcttatgttattcaaggaaatccaagtttaaagtgtctgaaagcaagagactgtcgaaatttgtttcctggagacaattgtgctgaaaaaagagaatctgattttccctctttgcatgaaaaactacacgctgagttaggaaaaatgtatagattggaagagattgagtttgggtggggcttttcttccttctctttcatttctctggaacctgcactgatgtcattaaaggccatcaatataggtttaggtggaatgctaggtgaagatgctttgaaacggttacctgcaatctgtcccttgctagaaacaataatccttcattttcaggtcatatctgatataattgtgatgaactttgttgcatccttgaaaaacttgcaagtattagctatgtgctattgttttggtgatatatccatgtcaagcttcaaattcccgatgcaaaatcttagaaagctgaggcttgaaagagtaaccccatggatgacgaatgatgatttggttgttctaactcaaaactgcagaaatttggctgagctttcattgctagggtgttctcttcttgacgcagactctctaccgataatttcgtgtggatggccaggcttggtttctatccatttagaggactgtggagaagtaacagctaatggggcttctgctcttcttgactgcaaagctcttgaagatatcctgctgagacataatggccctgggctatgcagaaacttcgtttgttatgctacttcagagatgccattgcttcgaaaattgtcactggatatatgcgatgcaagggaaggtgattttgacattccaaattatgcaggcagatactctttgagtaccttaaacatagctagatgcaaatctaaaaaatgtgcatttaatctcccagcgtctacctcaggggctcgcagtagatccgtgcatatcgaaacgctggtgctcgtgtggaacaacagagatctaatcagaacagtggtgaaggaaagactttagtaaatacatgtctgggcattaatttgtgaggggtatcatcatccttttctcgaagatgattagttagtttttaaacaagtggtttggtggcaggaagtaaaatgcttagtgattaagatggtcacttgtgacg

SEQ ID NO: 576 - DNA, 1421 bp, Phaseolus vulgaris
tctttatctttacgctaaccacacatcaaaatacaagaaatgaacacatatatataaaccatctctgcaaagcttcgaatgcagattttatctcagccatgaaagttctgaatgggaaggggaagtatgcacaaggaaacctaaaccttctcaagagtgttgttatccttcttccattcaccctgcttattctcatgttgccgttttctcttacgataaactctagtttttcctctcctaatgaggtgtatgttagtagaagcagctatgattttaacgtgacagagataaaacgatgcaacgtgttttctggggagtgggttccgtacagtaaaggagcttactatgacaatgagacctgtgatttgataatagaccagcaaaactgcatgaagtttgggagacctgacagagagttcctcaaatggaggtggaaacctgatgaatgcgagcttccactcttcgatgcaacccttttcttagagattgtcagaggaaagtccatggcctttgttggagactccgtgggaagaaatcaaatgaattctttgttgtgcctcctaaatcctgttgctcgtcctgaggatatttcaagtagatatgctacagatcccatatatttcagaaggtggttctatgcggattacaactttacagttgtaacactatggtccccatttttggttagaagcagcgatgtccacagcagcctcacgaatctgtatctagataaggcagatgaatcgtggagtggagaggtgaaaaacttcgattttgtcattatctcagctgggcagtggttctttcggacagcattgttctacgaaaaaggacaagttgtagggtgccacaagtgtgagcaaagcaacatcacagagctgagtcactactatggatacagaaaagcattccgaactgcactgagaaccatagtaaagatgaaagggtacaagggggtgacatttttgagaacattctcccctgcacatttcgagaattctgagtggaacaaaggagggagttgtgagaggagaaagccttatgggaaggaggaaatgaagtttgatggttacatttttgagacgtacaaggttcaagtggaggagttcagaggagcgagaagggaaggaaggaagaggggtttgaagtttttgatgttgaacacaactgaaatgatgctgcgtaggcctgatggacatcccaataaccatgtgtggggacatgaaatgaagaacacgcacagtgattgtgttcattggtgcttgcctggccctattgacacatggaatgagcttttgttctatcagttgaaaactcatcacaaatcttttatttcatcgtagggatttgtgtaggatacattagatttacaaaaaggtatattatttctcatagccttcgatcatggagatgtctcgaat

SEQ ID NO: 577 - DNA, 1139 bp, Phaseolus vulgaris
aaagtcgaccatcagctctctcacattctcagaatgctaaccctcaatcacaatgctatttcttcttcgttctcaactgttccatttcatgccaattatgcactctctactccaactcaatttttattttcttccaatcttaattactcctttgctacaacagcaaccagaaagttcaagtcttttcagctcaaggctggattttgggaatcaattaaatctgggttgatgaagaataactcaatgcaagtcattgatccaccctctatagatgaagaagatgaagaacctctgcctcaagagtttgtccttgtggaaaagaccgaacctgatggaacaattgagcaaatagtattctcttcaggtggagatattgatgtttatgatcttcaggccctctgtgacaaggtagggtggccacgcagaccactgtcaaaattagctgcggctttgaaaaatagctatatagtggcctcacttcattctataagaaagtctcctggatcagagggggaagaacagaagagattaattggcatggctcgtgctacatctgaccatgccttcaatgccacaatttgggatgttctagttgatcctagttaccagggccaaggtcttggtaaagctcttatagagaaactgattagagctcttctgcaaagggacattggcaatataactctgtttgcagatagtcaagttgtggaattttatcgcaatttaggctttgaagctgaccctgagggcataaaaggcatgttttggtacccgaatcactaattgcaacccccacaaagcttgctttttctgatgttaacgtttcaatttgcaaccacaaagtatataaaagagaagcagtggcaaatttacctattacttgtaccattaaggtgcaaagattggacaccaatcctgtgattgattattgcgttaggtgttagcaagttttttttaaaaagttttactacttttgattatagtatgtctgctttatattttaaaaaactgaaaaccatcactcattatcacttagtgattgtgattttttttactttttatgtttgttcattttggatgaattgtattgtataaagatagtagttttcttctgttgtttggacgttgagggatccttt

SEQ ID NO: 578 - DNA, 3234 bp, Phaseolus vulgaris
tcgaaattgaaatccaagtgtgaacagaacagaagaacagaacacaacacagaggttgatttgtttgttccaatcggtgttgtcgggggcatggagagtgtgaatgatctgatccaagaggccaagctccgcactctctggtgggccctctgtatatttgccgtttcctatttcctaactcatacaagtaaatcaatgtggatgaatctacccatgtcgatcatatttgttgcggggctgcgtattctttttaatagggtggagttccgttggaaggttcaagagcctaaaccgctgacctatttatcacatttggagaaaaaacagttgtctctgaaggattcacgcctcactagtttacctccccctgcgaaatggaagagaaaaatcgattcccctgctgtggaggctgcaatgagagagttcattgataagattttgaaggatttcgtggttgatttgtggtactcagatattactcctgataaggagtttccggagcagattcgggcaataatcatggatgttctagctgaaatatctggaagggttaaagagataaatctggttgacttgctgacaagggatgtagtagatttaataggtgatcatttagaacttttcagaagaaatcaagctgctataggtgttgatgttatgaaaacattatcttctgaggagagggatgacagattaaaattccatctattgaattctaaggagctacatccagcactaatatctcctgagagtgagtacaaggttcttcagcagctaatgagtgcagttttagctacagtactaagacaacgggaagctcagtgtcctgtgattcgttctatagctcgagaattattaacttgcttggtaatgcagcctattatgaatttggcaagccctgggtatattaatgaactgattgaagctcttattcttctccttaatgatgatgatacggaaggtatgggcagtaatcagtcaactaatgtagcaggtcaccatcatggacattctgttgtcagtgagggtggacacaacaatctcacaccctctaataagaatccatcattaaatcaaggaactgagatgatattggctaaaacgagtgatcaaggagggacatcattgcaaggtaacaatctccatcaagaatcttcacaggccaggcctgctgattgggcacgaatgttggaggttgcaactcagaggagaactgaaattctcatgcccgagaatcttgagaatatgtggacaaagggaaggaattacaaaaggaaagagaacaaaattatcaaagttggctttcaggatcttcctgctaagagcccctctacagacagtttgcctcctagaaaattggctcaggaaacatcagcaagtaaacgtggaaaatatgaagatgcagaggggaattctcctcttccaaaatttaatgccttgggttcagatcccctacaaaatgttgcaactgcaaaaatttcagaatcttctcaaaatcccgaaaaggaattatcttttgcgaaagaccttgctactgatggttatgaaagtccactgaagaggtccaatagtgcttcttccttaggaatcctaactaacaaaggaggctccataatttcagagttttataaccccgaacttgagaggcacagtgaaggatttcggggaaaaagttcttctgacatggttgtcaggaaagaaaggccgttggtttctaagctccggtgccgggtgttgggagcgtattttgagaaaattggctccacatgttttgctgtttattcaattgcagtgactgatgcacaaaataaaacttggtttgtaaaaagaagattcagaaattttgagcgattgcatcggcatcttaaagatattcccaattacacattgcatttgccacctaaaaggatattttcctcaaacacagatgacgcttttgtacatcaacgttgcgttcaacttgataaatatctccaggatctcctatcaatagctaatgttgctgaacaacatgaagtatgggatttctttagtgttacctcaaagaactactcatttgggaaatctccttcggtgatgaagaccttggcagtcaatgtagatgatgcaatggatgatattgtacgccagtttaaaggggtttcagatgggttgaggcgaaaagtcgttggttcatcatccctcatgagtgagggatctgttacatcttctaccacatggaacttgtccttgaattcagatgaaattgacaaaatcattccaaggcaaggtacttcagaaagtgtgttaagctccgatgaggaaggtgaaaagaacaacaattttgatgatgagaatattgttagcgaagtagcacaagttagtggattgcattttgacaatgcattgatcttaaagggttactcatctccattaaacaaccgtgatgaagagtccaacaacttggattttgatagaaagcatgatatggtggtggaagctagggttggcaatgatgttcctgctacgaatttcattctgattcctgataatttggaggatccagttggagggccacctgagtggtccccacctaatgttagtgtccctattttggttttggttgacaacatatttcagcttaagaaaagaggctggataagaagacaagtctattggatgtcaaaacagatattacaactagtgatggaagatgcaattgatgattggctcctgagacagatacattggctccggagagaggaaacagtagcccaggggattcgatgggtccaagatgttctctggccagatggtacgtttttcttaagagtagggattcctcggatgataagtagcgatgatgatcaaatgccttctcaaacaacaagcagatcaggcggaagcaacatcaagaaatctgagtcaggctcttttgaggaacagcttgaggctgctcgtagagcaagtgacatcaagaaactgttgtttgatggagctccaacaacattagtgagcctaatcggccataagcaatacagacgttgtgcccgggatgtatactactttagtcagtctaatacatgcgtgaagcaacttgcttatgcaattttggaacttgtacttgtatccatcttccctgagatgcggaatgttgtgttgagtgttcaccaacacgtcaagagttcttcttctatatgacataacacgttttatggctttgctggtgttgctggtgggatcatgaatgtctag

SEQ ID NO: 579 - DNA, 1207 bp, Phaseolus vulgaris
ttgaaggaataccgctggagattcagaataatgtccgaaacgataagagaaaacgatgccagattaacgtcccaaacgtcgacaagctccaggttctggcctcgttggattcccacttccattgatcatatcatcgctgccgagaagcgtcttctctccgtcgtcaaaaccggttatgttcaagagcatgttaacataggttctggtcctcctggttccaaagtgagatggttccgttcagctagtaacgagccgcggtttattcacaccgtcacgtttgacagtaaacctggttctcctacgcttgtgatgattcatggttatgctgcttcccaggggttcttctttcgcaattttgatgtgcttgcctctcgatttagagtcattgttattgatcaacttggatggggtggatcaagcagacctgattttacatgcaaaagcactgaagaaactgaggcatggttcattgattcttttgaggaatggagaaaagccaaaaacttgaccaattttatactacttggacattcttttggtggttatgttgcttctaaatattcgctcaagcaccctgaacatgtacaacacttgattctggttggatctgctggattttcatcagactcagatgcaaagtctgagcggattacaaggtttcgagcaacatggaagggagcacttttgaatcatctatgggaatctaattttacacctcaaaaacttgtcagaggtttaggtccttggggtcccaacatagttcgcaagtatacaagggctaggtttggcacacattctactggggaaatactgacagaagaggaatcaacattgttgacagattatgtttaccacacattggcggccaaagctagtggggagctgtgcttaaaatatattttttcatttggagcatttgccaggatgccccttcttctcagtgcctccaagtggaaggtgcccaccactttcatatatggtttcgaagactggatgaattatcaaggtgcccaagaagctcgtaagcttatgaaggttccatgcgaaatcatcagggttcctcagggcggacactttgtgttcattgacaacccaactgccttccattcagctgttttttatgcttgtcgaagattttttacacttgatccggacaatgaacctcttcctgaaggtttaaccttggcatagtttaggtcttattgac

SEQ ID NO: 580 - DNA, 894 bp, Phaseolus vulgaris
attgctcccaaacagttgactcagggaaaaacaaggagccagaatccatggaaacacagtatgaggaactcgcgagagaagactctattcccgacagttcctcagaagatgaggaggaggagatagagaaggagttagctgatgtaacgtttgaggagctgcagaaagcacgttcgaatggggcacatgcttttttccagaaacccaaagaagacaaaaagttaaaaagggctaacaagaataggcctatggaggccagtagcaagaagccggtttctgcttttagagaggccatccaagctccaaagaaggttatacgtgatccacgatttgaatctctttgtggtacacttgaccctgaagggtttaggaagaggtataatttcttatatgaaaacgatcttcctgctgaaagacaggctctgaagaaggaattgaaaaagtataaagatccaaagcgcataagtgaaatagaagaacatatatcatggattgataaacaaatgaaatctgattcaaggaagaatattgatacgcaaatattggctaagcataaaaagaaagagagagaagcagcaaaggaggggaaacgtcctttttatataaaaaaatctgaaatacggaagcaaaggctgattgagaaatataataatctcaagtcatctggcaaacttgaagcatttgttgagaaaagaaggagaaggaatgctgctaaggaccacagatacatgccgtatcgtagatctggtgatgtggaataaattttgtacctttaagactctttcttaagctataattataatagaatgtagcaccaaaaagaaaagtaatttatgtttttggctgccagttttggggattaaatattgacgtttgttgattatgtttgttgtg

SEQ ID NO: 581 - DNA, 2356 bp, Phaseolus vulgaris
aaagtcgacctagcatttgttggtggtgttgttcaggctcagtactcaaagggaaaggatttaggaaagagatctggtatatggttgtgtgtgtgaataatagagtgcttgaggttgtggtgttggtgaagaatatttgtggagatgtcaggaggaggatgcagcatagtgtggtttaggagagatctgagggtagaggataacccggcactggctgcaggagtgcgagctggagctgtgattgctgttttcatatgggctccagaagaagagggtcaatactacccaggtagggtctctaggtggtggctcaaacaaagtttggctcaccttgattcctctttgagaagccttggcactcccctaatcaccaagcgctccactaatagtgtttcttctctattggaggtcattaagtcaacaggggctactcaactctttttcaaccatttatatgatccattgtcacttgtgagggatcaccgaacaaaggaggttctgactgctcaaggcattaccgtacgttcattcaactcagatttattgtatgaaccatgggatgtgaatgatgctcatggccaaccattcacaactttttctgctttttgggaaagatgcctcagcatgccttatgacccacaagcacctcttctcccacctaagagaattattccaggtgatgcttcaaggtgcccttgtgatacattggtgtttgaagacgaattagagaaggcaagcaatgcgcttctttctcgagcatggtcaccggggtggagcaatgctgacaaggcattggctgcattcgtaaatggtcctctgattgaatactcaaagaatcgtaggaaggctgatagtgccacaacctcatttctctctccacatttgcactttggtgaggtgagtgtaaagaaagtgttccatcttgtccgcattaagcaagtgttttgggccaatgaagggaacaaggctggtgaagagagtgtgaacttgtttctcaagtctattggtcttagagagtattcgaggtatatcagtttcaaccacccctacagtcatgagaggccccttctgggccaccttaagtttttcccttgggtggtgaatgaagggtacttcaaggcttggagacaaggcagaacagggtaccctttggtggatgctggaatgagagagttgtgggcaactggttggttgcatgatcggatacgtgttgtggtttcaagtttctttgtgaaggtgctgcagcttccctggagatggggaatgaagtatttctgggatacccttttggatgcagatcttgagagtgatgcccttggttggcagtacatatctggtactctccctgatggtcgcgaatttgatcgaatagataatccacagtttgaggggtataaatgtgacccaaatggagaatatgttcgacgctggcttcctgaacttgctagattaccaactgaatggatacaccatccgtggaatgcaccagagtatgtactgcaagctgctggaattgaacttggttcaaattatcctcttcccattgtgggaatagatgctgcaaaagttagattacaagaagcacttatacaaacgtggcaacaagaagcagcttcaagagctgcaattgaaaatggaaccgaggaagggcttggagactcatctgaatcagcccctattgcttttccccaagacacactcatggaagaaaggcctgctgaacctgttaggaacaacccacctcatggtactcggcgctatgaggatcagatggtcccaagtatgacttcttcccatgtgagagtggaagaggaagaaacatcttcagaccttcgaaattcagcagcagacaacagagcagaagttcctacaaatgtgaccacacaacaaaatgcaagagagacagtgaatcaaggagagctgctgaatgtaaatagaaacactcgagtacagaataatgctacaatgtggctgagaaatgcagctgaagattccacagcagaatcttcaattagtactaggagagaaagggatggaggtgtagttccagtttggtctcccccagcatctaacttttcagaacaatatgcagatgatgaaaatggtattggagccagttcatcttacttgcagaggcagcatcctcagtctcatcaattgatgaactggacgcggctacctcagactgggtaattcagaggtagaacgtgctgattagtatcagggagatggaaaatgcagtctcccctcatcttttgggaaaagtgggatggcgaatctcgtattggacctacatgtgatcatttcctacatccttaaacatgtcttgacacatgattaacggctgggatccttt

SEQ ID NO: 582 - DNA, 1714 bp, Phaseolus vulgaris
aaaggatccgtcagtcgtcatggaagtctcaaaagatcctaactcaaacccgggtcacttcgaagattcagattccgaactcgaactctacaccatcccaagctcttcaagatggttcgcgtgggacgaaattcacgaaaccgagagaacagcgttcaaggaatttttcgatgcgagctcgatttcgagaacccccaaaatatacaaagaatacagagacttcatcatcaacaagtacagggaagaaccttccaggaggctcacattcaccgaggtgagaaaatcgctggttggtgacgtcacgtttctgcacaaggcgttcctcttcctagagaattggggtttgatcaactacggcgcgccctctgctgcagacgtggagaaggaagaggaggaggaggaaccgtgcaaggttcgcctcgaagaaggaacccccaatgggattcgcgtggtggccacgccgaactcgttgaagccgatattggtgcctcgcggtgcgaagactggtggaaatgcgaccgcggcttctctcaaattgccaccgctcgcctcctattcggatatttatggggatttgattaggcagaaagaggggaactgtgggctttgcggtggcaaatgtggttcaggacattacctatgtactcaggataatatcattatttgtgcaaattgtttcaaaagtgggaattatggggagaaaaggtcttcagaggatttcgtattgagtgagtcaagtgaaaatagtggcaaacatgacactgtctggactgagggagaaattcttctccttttggaatctgttttgaagcatggagatgactgggagcttgttgctcaaaatgttcaaaccaagactaaacttgattgtatctcaaaactcattgagctgccttttggggagctcatgttgggccctgctcacagaaatgtcaacattaatagtgctaatggcgttgtggtgaacaatgccaaacaagttcagtcatcttcgtctgacaaccaagaaatttcaaagacaaaggatcaacctcctgagcctacaaatgaaaatgagcagaatggggatgctgtgaaggaaagtccttcaaaaagacagcgtgttactcccctgtcagattccagttgttcactaatgaatcaggtgggactgatctctaatgtggttgaccctcatatcacagctgccgcagctgatgctgctgtttcagctctttgtgatgagaatttgtgtccaagggatatatttgatgttgaagaagattcagcaagagatcttgagggtgaaggtttagagatggagaggtcctctctatcagaaatacctttgccactgcgtgtaagagctgccactgcaactgctcttggagctgcagctgctcgagcaaagttgttggctgaccaggaagtcagagagattgaacatttagtagcaactataattgaagctcagatcaataaattgctgtacaaggttaaacattttgacgatctggagctgttgatggaaaaggaacatgctgaaatggaaaatataaaagattctatcttgactgaacggattgatgtgttaaggagaacatttagatctggaatcactagatggaaggattattcttatgtaaaatcttagaccatgtatagttttggtactcgatgggtacgattggactgccattttacctaagggccaacgaattactgtggtaccttt

SEQ ID NO: 583 - DNA, 728 bp, Phaseolus vulgaris
acaacatggaatatacttattcagcagaggcagaaacttacaccagtagcagtaccaccccatcaagtgccatgagatcaaagaagaaagccaacaacaacacaagaaggttcagtgatgatcaaatcaaatcattggaaaccatgtttgagacagagtcaaggctagagcctagaaagaagttgcagctggcaagagatcttggattgcagccaagacaggttgctatatggtttcagaacaagagagctaggtggaagtcaaagcaactggagagagactatggtatactacaatccaattacaacagtttggcctcacgttttgatgctcttaagaaggaaaagcaaacattactaattcagttgcagaagctgaatcatctaatgcagaagccactggaagcaggtcagagtcgcacacaagatgaagcagcaaacagcatggacagtgaatcagaaaatggaggcaccatgaaatgtgaacatgaggaaaagccaagcccaacaatggaaagatcagaacatgtgcacggtgttctgtctgatgatgacgctagcataaaggtggaagactttggcctagaagatgaacatgatctcttgaactttgttgagcatgctgatgactccttgacttcaccggaagattggagtgcttttgaatccaatggtctcttaggccaaacgaccagtgattaccaatggtgggacttctggtcctgataa

SEQ ID NO: 584 - DNA, 2032 bp, Phaseolus vulgaris
cgaatccctaattacaattgctgaaccaatgtcggaggagaagatgagtgagaaggattccactgaagctcagcagaatcccaatctggaggactgcttgaaactgctgaaaggagagcgagacgaacagcgtcttgcagggcttcttctcgtaaccaacttctgcaaagctcacgatcactcctctcttcggagggtctatgatgctgttggccctcgctttctctatcgtcttctcagaactggtctcggaagttccctcaatgagaatcgcgatgcatatttaagcctatccatcactgttcttgctgcattttgtcgcgttccagatatagcttcttctgacgacatgctttttaatattccacttgtgttggaagtaatacccaccctgtctggctcgtctcttcttcaagaatgctacgagtttttgtacttggtgtctgctgcttctgaaaatggaatcacgagattttgtgaatctggaggcatcaaggtactagcttctcaaatgactgttctgcaagatggttcatatctgatggaagtatcttttaaacttctgcaattgattctgggtaggatgtccttggacataatccagagtaatgacttatctgacattccagttattgtggcagcaatagcaaggcagtttgctgttttgcacaattccttgaaatttgaagccctccacttgctaaatgtcattcttacctcaaaagattcatcacaacttcgtgaggccttacagttacttcctcaagaaagctggtcgcacaatatccgcactggtataatggctgttctgcagaaccgtgttgctcctgctgaaaggttgcaggctctcattttagctgagtctatggtttccatgcatggagaagattggttggttagccaagtaaacacaaatgatgcacgagatccagcttcagctgacatgtgcctgttacttgtcttggagcagtcaagggttgaaattgctgttcttctgaacgagttggcatatttaaaatatgaagcccctcaggatacttcagctacttctgaagcaattttttcgaagcgacataatgtggctgttgcttactctttggttgagaagataataaaattaatatcaaatgttgaggaaaatggtggaaacctccttgatgaaggaacattaacaaaggtgattctccagcttaacgagacaattgctgttgtcctagagtatttggaagatgcaaaggaacatgggcaaaagaaaggggatgatttacttgcttcggtgcgaattattgggagctatcttgcagaagcacccttagcatgcaaggagaaggttcaagatcttttagggtatatgctttacattgaaggtgaagatgaacaaagacccttctactctgtttgctttcttctacctttgctgtctcaaattactatgaagatcgagggatgcaaagctttggcttcatgcaaaggaattgaggctgttttagattgcttcaataaattagttgggtcaaatgcttttcttgaggataatggttgcatctttttggcgtgtgatacaatactgaacctactattgaagaaagacaaagtgcatacgatgttggatgagtcagctagtgttagtcttcttaaagcattagcttattggacagataacactgatgaaacgtcgagtatgatgatggcttcaagcatttgtgcactggtatttgaatatacatcagaagaggctctcttgaatcgacctgatttcaactatagcactcttcgcagtctttatgtgctcattgctagatgtctgacttcatcagaacaggatactaaagaggatatggatctttcggagattgtctcttctggcttctctcgatgggctcatcggtacccccgtatccgagaagctgtcaagaactgattttgatcctcttaatctggattttaaacttcaaggtattctctgttgaaatgatgatgtgacaatgcatgcaattggaagaagggttaccaatgagatgggatagggtct

SEQ ID NO: 585 - DNA, 1235 bp, Phaseolus vulgaris
aaagtcgacaaacaatggaagtatctcaggtactgtgcatgaacggtggcgttggagacgcaagctatgcaaacaactctcttgttcagcaaaaggtgattagtttgacaaagccaataagagaggaagccataactagcctctattgcagtaaactccccaaaagtttggcaattgcagatttgggttgctcttctggaccaaatactttgtatgttgtgtctgaactcatcgagactgtggagaagctttgccgacagctgaaccataaatctccagaatacaaggtgtttctgaatgatctccctgggaatgacttcaacaacatctttaagtccattgacagctttaaagagaaattgcaaaatgaaatggaaggtggtccatgctacttctctggggttcccggatctttctatggcagggttttcccaagtcgaagtttgcattttgtccactcctcttacagtcttcaatggctatctaaggttcctgagggtgtagacaacaacaaggaaaatatctacctaggtagaacaagcccatcaagtgttgtgagagcttactatgaccaatttcaaagagatttcagtctttttctcaagtgtcgagcagaggaactagttgaaggaggtcgtatggctctgacatttttggggagaagacacgaggatccatgtagcaaggatggttgctacatttgggagcttatggcttcggctcttaatgatatggtttctcagggaatgataaaggaagagcaagtagatagttttaacatcccacaatacaccccatcaccatctgaagtgaaattggaagttcttaaagaaggatcattttctatcaatcgtctagaagtgtctgaagtgaactggaacgctttagatgattggaacgctcttgagtttgaatctgaaaggtttgaatcagttggtgatggtggatacaatgttgcacagtgcatgagggctgtggcagaacctatgctggttagtcactttggtgaagacatcattgaagaggttttcacccgctaccaacaaatcttggctgatcgtatggccaaggagaaaactaagttcttcaatgttaccatacttttgactagaaaaacatgaacaacaactttgcgtctaaggagaaaattgagttcatcaatatcactgtatcattgactagaaaagaataagcaagaagtttgtatctgtatgtatggtttgctggaattcttt

SEQ ID NO: 586 - DNA, 955 bp, Phaseolus vulgaris
gaggaagcagagtgtgtcactgtaccccaatttcgtgtgttttttttgtgaagcatttggaaacacctatacactatgccttcagctcaagatccattctatgttgtgaaggaggagattcaagaatctattgataagctgcaatctacttttcgccaatgggaaaaagctgctgatgccggcgagcgatccaatctttcaaaggaagttcttactagctgtgaaagcattgattggcaggtagatgaattggacaaagcgatatctgtggcatctagagatccttctttgtatggcattgatgaagtggagcttgagaaccggaggaggtggaccagtgaagctcgtagccaggtgagcacagcaaagaaagcagtggaagcaggaaaacgctcaaatataacaaacaatgctagtctaaatgggatgcacagggaattaatgaggcttcctaattctcaccaaactgcgtctggccaatatcctacccaggataatgatgatttcatggaatcagaatcggacaggcagatgcttcttataaagagacaggatgaggagttggacgagcttactgtaagtatacaaagaattggaggtgttggacttactatacacgaagagctccttgcacaggagaagattgttgatgaactgggtaatgagatggacagtacatctaatcgtctagattttgtccaaaaaaaagtagcaatggtcatgaaaaaggctagcgcaaagggccagatcatgatgatcctgggtttgctggctctgttcattttcctctttatcttggtattcttcacctagtcattgagacgaaagctgtcaatgctcttgtttgtacatgaaaaaggatctaaagcttctgtgaagttacaagattattgggacatccaatatgtttagaaatctagtggaagcctctttggtttgttgaaggcagtgaaat

SEQ ID NO: 587 - DNA, 4045 bp, Phaseolus vulgaris
aaaggatcccacaataggacccagggaatggtgaattacgatattttaattcttgattggtagcatgttttggctggaatttggataattgcttttcattgtcagaggtagaaggaaacaatacctggaaagtagatagatgtcttcttcttcttcttcaatggctgctcccagtgaaaagtggattgatcgtcttcagttctcctcattgttctggcctcccccgccagatggtcaacaaagaaaggatcaaattgctgcatatgttgaatacttcattcagtttacatcagaacaatttactgacgatattgctgagttgattcgtaaccgttatccgtccaaggagattcttctctttgatgatgttctggccacatttgtccttcatcatccagagcatggacatgccgttgtgcttccaattatttcatgtattattgatgggacactagtctatgataaggctagtcctccatttgcttctttcatatcttcagtctgcccaaaagttgagaatgaatactcagaacaatgggctctggcatgtggtgaaattttgcgtattttaactcattataatcgccctatttacaaaatagaaagacaatatggtgaaacagaaagaagcagtagtggcagtcatgccacaactagtgaacctattgatgggaaatctgtgcataattctttgacaaatcaggagaagaaacctataaggccattgtctccctggattactgatatattgttggcttcaccagtaggcattagaagtgactatttccggtggtgcagtggtgttatgggtaaatatgctgcaggagaactcaaacctccatcaactgcttcttctcgtggttctgggaagcatcctcaacttgtaccttcaactccaagatgggctgttgccaatggtgctggtgtaatattaagtgtttgtgatgatgaagttgctcgcaatgagactgctactttaacagcagctgctgttcctgcacttttgcttcctcctccaacaactgctcttgatgagcatctagttgctggattaccagctttggaaccatatgctcgtttatttcatagatattatgcaattgctactccaagtgctacacaaagacttcttcttggactcttagaagcacctccatcgtgggccccagatgcacttgatgccgctgtgcagcttgtggagcttcttcgagctgctgaagattatgcatctggcataaggcttcctagaaattggatgcatttgcatttcttgcgtgcaatagggactgcaatgtccatgagagctggcatagctgctgatgctgcagctgctctgcttttccgtatactttcacagcctgcattactttttcctcctcttagacacgttgatggagttgaagttcaacatgaacctttgggtggttatatttcttcctataaaaagcagatagaagttcctgcggctgaagcctccattgaagctactgcccaaggcattgcatcaatgctttgtgctcatggtccagaggttgaatggagaatttgcaccatctgggaagctgcttatggcctgattcctacaagttcctcggctgttgatcttccagaaattatagttgcaaccccactacaacctcccatactgtcatggaatttgtacatacccctacttaaggtcctggaatatcttcctcgtggaagcccatcagaggcatgtcttatgaaaatatttgctgctacagtggaagctattcttcaaaggacatttccacctgagtccactagagaacaaagcagaaagtctaaatacctgtctatcattggctctgcctctaaaaaccttgctgtggcagaacttcgtactatggttcattccctcttcttagaatcatgtgcatctgtagagcttgcttcacgcctactttttgttgttttaactgtctgtgttagtcatgaagctcaattcagtggaagcaagaggccaagaggtgaagataactatccagctgaggaaattattgaggacttacaaacatctgaaaaccagaaaaaatcaaaaaataggaaaatgaagaagcaaggtcctgtagcagcatttgattcttatgttctggctgctgtttgtgctcttgcctgtgagcttcagttgttccccttgatttcacgagggagtaataatttagtttccaacaatgctcaagttatagccaagcctgctaaactgaatggatcttcccatagacagaatggatcttcccatattagacaaaatggatcttcccatattagacaaaatggatcttcccatgacttgcgaaatgggttagattctgcagtacgtcatactcacagaattttagcaattttagaggcactattttcattgaagccatcttctgtcggcactccttggagttacagctcaaatgagattgttgcagcagctatggttgctgctcatgtttctgaactgtttaggaggtccaaagcttgcatgcatgctttgtctgttttaattcgttgcaagtgggacaatgaaattcactccagggcatcatcattgtataatctcatagacattcacagcaaagctgttgcatctatagtgaacaaggcagagcctttagaagcaaccttaattcatgcacctatttggagggattcccgtatttattgtggtaataaaaggcagaatcagtgtgaaagtaactgctttgaccctgggcagacatctattataccttcagcagattcattcccgtcaaaacctgtccatacttctaagaaaaccccttgttcaaatgaagcagcaggttgtaccttgggtaaaggtgtctctggttttccattggatgcttctgatctagccaactttctcacaatggacaggcatataggattgaattgcaatgcacaaatttttctaagatccatgctggcagagaaacaagaattatgtttctctgtagtttcgcttctatggcacaagttgattgcttctcctgagactcaaccttgtgcagaaagcacttctgcccaacagggatggagacaggttgttgatgccttatgcaatgttgtatcagcctcaccaacaaaagcagctactgccgtcgttcttcaggcggagagggaattgcagccctggattgccaaggatgatgatttaggtcagaagatgtggagaatcaatcagcggattgtaaaattgattgtagaacttatgaggaatgatgaaagtgcagaatcattggtaattgtggcaagttcatcggatttactactgcgagccacagatgggatgctggttgatggagaagcttgcactttaccacagctggagttattggaagcgacagccagagcggttcagccagtgctcgagtttggagaatctggattggctgtggcagatggcctttcaaaccttttaaagtgtcgtctctcagctacaatcagatgtctttctcatccaagcgcccatgtccgagctctgagtatatcagttcttcgtgacattttgcatactggttcaatcagatataatcttaaacctcggagaataaatggcacccacaacccttcttatcaatacttcaattcggatgccattgactggcaagctgacatagaaaaatgcttgacttgggaagctcacagccgactttcaaccagactgcctattaactttcttgataccgctgccaaagagttaggctgtaatatttccatgtgaaatggaatcaaactctgcaaccatccatcatagtctgtgacatttttttactagacttgtagaaaaaaacacacattattgatgcttatggaactaacgtgtttacaaaaataagcaacatcattatgctagtcctgttaaaagagtcacagtcacaattctagtatgtttatagaaagctcattttgtatcatgcatgtattgtagttaaactaagttttcacctacaacttggtcgtgactctggtctcaatagaacagacttgtacagtaacgatagacgaggctgtaaccaggggtaccttt

SEQ ID NO: 588 - DNA, 1033 bp, Phaseolus vulgaris
aaaggatccattctattaggctttcatctcagacagagtgttgtgagaaatgatagatctaagcacactcaatcccgcacagattactgtgatgggatctgcgttttgtgttatgctttccatgcatttcacatcgcagttattgtctcagcatctcttctattggaagaatccaaaagagcaaaaggctatactcatcatcattcttatggctcccctttatgcaactgtctcctttgtgggtctcttggatattagaggaagcaaggagtttttcacctttttggagtcagttaaagaatgttatgaagctttggtcattgccaagtttctggctttgatgtatagttacttgaacatatcaatcagtggaaacgttgtgcccgatgaaattaaaggcagggaaattcatcactcttttcccatgacactttttcagcctcatactgttcacctgaactaccgcaatttgaagcttctaaaatattggacatggcaatttgttgttatccgtccagtatgttccattctgatgatttcattacagttacttgggctgtatccaacttggttgagctggacattcaccatcatcctcaacatatctgtgtcgttagccttgtattctctggtggtcttttaccatgtgtttgctaaagaactggcaccacacacacctctagcgaaattcttgtgtatcaaagggattgttttcttctgcttttggcagggaatgttgctggaggttttagcaaaatttggcgtcattcaatctcgtcatttgcggttagatgtggaacacattgaggaagcaatgcagaatattttggtatgtgtagagatggttatcttttctgttcttcaacagtatgcttatcatcctgcaccatatagtggagaagttgagaaaatgcttagacaaaacaagaaaaatgactaactatgatagctaaaaacatcaggctacagatatgtatttaagagttctctattgtggcgcttgaaacatgaaacattgatgccaggtaccttt

SEQ ID NO: 589 - DNA, 2830 bp, Phaseolus vulgaris
gttttcgtggtcgggatggagcaaaacgaacccgtaaccctaaccctgaccgctgaagcagagctcaagaaagaccatgctatatcggatcccgacgagaagatggaggaaaaccaatccctaaccgcagaagatgagcgcgacaacgacaaagccgtgtctgattccgatgactctgattcagaggacgaagctcagcagaatctcctacttcaatctctccacaccgagcttgctgctaacccctctaattacgatgctcatttgcaatatataacgcttctgaggagaaccggtgatgttgataaactgacaagagccagggaagctatgagtgaactctttccattgagccctgcactgtggcaacaatggatcaaagatgagctttctctcatccctgcttctcggcccgaggctttctctagaattctgaagctttacgaacgaggagtgtttgattatctgtctatctctctttggtgtgactacattaattttgtccaagagtttgatccaatggtacgccaatgtacgcctactggtatttccaaggcgagggatctgtttgagactgcccttactgcagctggtttgcatgttgctgaaggcagtaaaatatgggaagcatacaggcaatatgagcagtctatacttttatccaccaatgatactgatgcacaggccaaagaaaaacaagttcaacgcattcgtagtttatttcaccgccagttgtctgttccccttgctgacatgagttcaacacttactgcctataaggcttgggaggcggaacagagaaatcttcaagatgttgaatctgttgacttggttgatatttatcctcatgttccatcttcataccagaaggccttggagatgtacaatgctcgtattcatcttgaagagtacattttgagcccgaatatttctgattcagaaagaatacaacactacatgaactatttgaaatttgagcaatcttttggaatgccagccagaattcaagttctatttgaacgagctattactgactttcctatatcacctgatttctggattgattatactcgctatttggacaacactttgaaggttggtaatattgtcaccaatgtttattctagggcaactaagaactgcccttgggttggagaactttggattcggtatatgctttccttggagcgtggtcatacttctgagaaagacttgtctgaaatctttgagaagtccctgcattgtaccttatcaactgttgatgagtatcttgatttgtttcttacccgggtagatggcttaaggcgaagaatggcatccagcagtcaagaggatttggaatataaaataattagagagacctttcagcgtgcatcggaatatctgtcaccacacttgaagaacacagagggtttactacacttatatgtgtattgggctcgtttagaaacaaaacttgggaaagatgtaattgcagctcggggagtttgggagaattgcctcaagatatgtggttcaatattggagacatggactggttatatagcaatggaagtggaattgggtaacataaatgaagcaaggtccatatacaagagatgctacagtaaaagactttctgggactggttcagaggatatatgccattcatggttacgctttgagagggaatttggcaagttggaagattttgatcatgcattacacaaggttacccctcggctggaagagcttaagttatttaggatacagcaggaatccaagtctggagaggaaagtgaaaagcatcttaagagaaatgctcgtgaaaagagaaagctggggtcagatataactgaagaacagtctccatcaaagcgacttagagaaattggaaatccgaagaaagcacccgaggagaacaattatcaacagcataacacttctcaggtgacaaaagtggaaggggtcaattggaagaataataaaactgacgataacccaagcgagcaacagtctaaccacgaaaagaacagggcatactctgaccagtgcaccgcgtttatatcaaatcttcatcctacggcaaattatgagcatattcgtaatttcttcagtgatgttggtggaattattgccattcgcatcctacatgacaaattcacaggaaaatcaaggggattagcatatgtggacttttcggatgatgaacaccttgctgctgcagtagccaagaacaagcaaaagttaattggaaagaagttaagtattgcgcggtctgaaccaaagcgaggtggaagggaatcttctaatcccaaaacattgacagaacatgcacacacctctaatcattctggtagaaaaggttccgtttccaatgaaactgatgatgcttacaaaggagatgtaaaggatgcaaagttctcttctagaaaaccaggaaatgataacatccagcttagagggaagaatacttttgccgtgcctagaaatgtcagaccacttggttttactgtaaataaaccaatatcagaagagggggatgaaaagccaaaatccaatgaagaattcagaaagatgttcattaggtaaggattttgtgcctctaatatgttactccgaagatggcggttatctttcaaaaataggcaaaagtggacatgatgcaagttatttggctccagagtatggttgtgttgtgatttgcatgattaattacatcagtctagtagattaaccttcaggtagtcttttactttttacaattgacacaatctgttttggttgcgactctgtatagtgtacgtacataaaattttcgcagtaatcgacccgccaaacagattatctt

SEQ ID NO: 590 - DNA, 953 bp, Phaseolus vulgaris
aaaggatccactgcaaattcaactttaacatcgaaaattcaggcgcagaacaaccatgaagaattccgaagtgtatcacgaaaggcaaaaattacagttctgtcttgttcattctctcaactccctctttcagcaaaaggatgctttcactcgagaaaaattgaatggaatttctgaaaggctcgcacttgaagattccaccacagaaacgtggacaccgttctctgttctattcaaaccccatcacaatgttttcactggaaactatgatataaatgttctaattgcggctttggaagagaaaggaaagagtgtggtgtggcatgatcgtagaaagggggcatcttgcattgatctcgatgcacctgttttgatggggattgtgatcaatgtgtcagtgactaggtttggtgggatttggaaaagtaggcactggattgcattgaggaagattgatggggtttggtttaacttggacagtgaccttcctgcccctcaaccttttattgatgcacataaagtaagggagttcttggattttacattggcacaaggaggggagattttgatagtcttgaatgagaaacagtcttgaaaattttaagttaatgcttcatttcgagtcaaatttgggcatccatgtgtacagtaccaaactgattgcatttcaatggagaatgtagcctcaatcatcctcgtgtctctgaagatttttagtgagtttgttgtgaataatggttgaaactgcttctagaggatgttctcaataggagatagtgtgttgtctgtaatacacttgtctctagtttccatgtgtgtctgtacttcttttgaaccattaggcaatacatgtgtttttctttcttgaactgttgcatatacaaaatttactatgcaattgttatagcagaaagagactgttgtgtgcgatgtacttcagcattggtaccttt

SEQ ID NO: 591 - DNA, 1523 bp, Phaseolus vulgaris
aaaggatcccacactcattgatccacttctccggctatgcataactccggtggaggcggcggaagcggcggcgtatgccacttggtggctatgccgttcccggggagaggccacatcaaccccatgatgaacctgtgcaagatcctggcatcgagaagacccaaggagattctcataaccttcgtggtcaccgaggagtggctcggcttcataggctccgatcccaagccggaagccattcgcctcgccgccatccccaacgtcgtccctaacgagcgccacaaagccgccaattttcccgctttctacgaagccgtcatgacaaacatggaagcgcccttcgatcggctcctcgatcggctcgagccgccgccgaccgcgattctcggctgcgttgagctgcgctggcccatcgccctcgccaatcggaggaatattcccgtggctgcgttttggacgatgtcggcgtcgttttactccatgctgcatcaccttgatgtctttgcacaacaacggcgtttgaacgttgacaaagatacgctggatggagaagtagagaacattcctggaatttcttcggctcatttggcagaccttcgaactgtgcttcatgaaaatgatcaacgggtcctgcagcttgcattggaatgtatttcgaaggttcccaaagcaaattatcttttactcaccacagtccatgaattagaagctgaaacaattgaatccttaaaagctatatttccatttccaatctatcctattggccctgctataccatatttagatttaggagaaaacccttcttcagtgaacaatgatcataaccctgactatataaaatggctagattctcagcctcctgaatcggtattgtacatttctttgggcagtttcctttcagtgtctagtgctcaaatggatcaaattgttgaggcactaaacagtagcaacgttcgttatctttgggtggctagagcggatgcttcttggttgaaagacaagtgtggagataagggtgtggtggtgccatggtgtgaccaattgaaggtgttgtctcattcttccgtaggtggattctggagccattgtggatggaattccactcttgaagctctctttgctggtgtaccaatgctcacattccctcttttcttggatcaagttccaaatagcagccaaattgtagatgagtggaggaatgggtgtaaggtggaacaagagaagttggacattgaagagattgtggcaaaagaaaagatagaaaagctggttaagaggtttatggatcatgaaagccaagagggaaagcagatcagaggcagggcaagggaaatcagggccacgtgtctcaaagccattggcacaggtgggtcctcagatgggaaccttgatgcatttattagagacatttcctaaaactgatgcattcataagctttgagtgacagattaaaacgaacttatctttatgtacggataatcttaattgtcgttacctgactttccatagtggatggtaccttt

SEQ ID NO: 592 - DNA, 2465 bp, Phaseolus vulgaris
aaaggatccctctgctaagcatctttgcctcctcacttttccattcttttatctgccttcccaatccttcattcctcttggaatttcttcttttctcaatcagattaccttggtttcagttctattcctaacatgccattatatattgctaccccttctcccctaaattgctacttctttaggtgaattcttgcaggttttcattttctcactcacaaaagactgcttccttttgtctattttttctcaatattttaccctcccaatttcagaccatcctctctcaattagaaatctgcatgccctgatctcctttcagggtcccattgttcaccccagaaaaggccagaaaacaaaatccagttttggaacttcccctgatctaaaaatctgaactttctggtaatttttactagtgttttgaattctgcttctgggtttttgtttccatggggctgtgtcatggaaaacccgttgaaacctcacaaagtgaaggtgggcaccacgttttccccggcgggaaagaggtagtggtggcaccgagtcccaaaatcgctacaaaaggttcaaagtttccgttttacagtccaagcccgttgccgagcctgttcaagaactcgccggcgaactcgagtgtgagttcgacacctctgcggctcttcaagcggccctttccgcctccgtcgccggcgaagcacattcgcgccttactggcccgccgccatggctccgtcaagcccaatgaggcctccatccccgaagggagtgagtgcgaggttgggctcgacaagagcttcggcttctccaaccacttccacgctcactatgagcttggtcccgaagtgggccgtggccactttggctacacttgctctgccaagggaagaaaaggcaccttcaagggtcatgatgttgctgtcaaagtcattccaaagtccaagatgacaacagcaattgctatagaggatgtaaggagagaagtaaagatattgcgagctttgactgggcacaagaatctggtgcaattctatgaagcctatgaagacaatgataatgtttatatagttatggagttatgcaaaggaggtgaactgctagataagattctttccaggggtggaaagtactcagaagaagatgccagaattgttatgattcagatattaagtgtggtagctttctgtcatctgcagggtgttgttcaccgtgatctcaagccagagaattttctctatatttctacggaggaaaattccactctgaaggtcattgattttggactttctgactatgtgaagccagatgaaaggttgaatgatattgttggaagtgcatattatgtagctccagaagttttgcatagatcttatgggacagaagcagatatgtggagcattggtgtaattgcttatattcttttatgtggaagccgacccttttgggcaaggacagaatctggcatatttcgggctgtcctgaaggctgatccaagttttgatgaagctccttggccatctttatcagctgatgcagtagattttgtaaagagactgttgaataaagattatcggaaaaggctaactgcagctcaggctctcagtcatccatggctgacgagtcattgtgatgatgtgaagataccttttgatatgataatccacaagcttgttaaagcttatatatgctcatcttcattacgcaaatcggcattaggggctcttgcaaaaacattaacattagtgcagctagcatatctgagagaacaattcaacatgttagggccaaacaaaagtgggttaatctccatgcagaacttcaagacgggtattttaagaagtgtcaccgatgcctcaaaggattcaagggtcttagattatgtgaacatggttagttcaatccaatatcgtaaattagattttgaggaattttgtgctgctgctataagtgtccatcaactagagggaatggagagctgggagcaacatgcaaggcgtgcctatgagttgtttgaaaaggaaggaaataggccaattatgattgaagagcttgcctcggaacttggtcttagcccttcagtaccaattcatgtggtactccaagattggataagacactcagatggtaagcttagcttcttggggtttgttagactcctgcatggggtttcttctcgcacatttcagaaggcttgagagaaaacacacttgattgctattacttttttgtcacccttattgatcataaaccttttgaatgcatactccaacagcagcaggtttcttcatcttggttgcacacatggcttgagcaaaggcaaaagctatatctagaagggtggtgatatgcaacatctccctttgttaagttcctcctgatgcgttctagaaacacacaacactttgctccatccttgtagtccttcagattgattggtggtgctggagttaaggcttgtaggtaccttt

SEQ ID NO: 593 - DNA, 940 bp, Phaseolus vulgaris
tggaagcaatttgatgaagtctccctaaagatttacatttaagtagcgccagttgatgaaaatgactttagaaacaagtcaaaaagaaacaaagaaaaacaaagtcaaattctggggttttttattccacaattctaattcttaataataaaaagaggaggtaatgagtatattgaaaaaacgatcaaaagaagtactgatatattctataacagagtcaaaaataagcaatatcttttcagccttgatcatttttttaggttcattggggttattgttggttgcaatttccagttatctcggtatggatcttttccttttttctgaggaaattagtaatttcccatttattccacaaggggccacgatggctttttatggaattgggggtctctttattagtttttatttgtggtggattcttttgtggaatataggtggtggttttgatatcttcgataaaaaaaataaaaaagtatgttttattcgttggggatttcctggaaaaaatcgtcgtattattctcaaaatacctatgaacgagattcaatctatcagaataatagcaggagttcaagaacgaggtattttgactcgtacccttacttatgagagtatcgtttatatggaaacaatagaacaggggtttattcccttgactcgtattgaagataatttgactccgccagaaattgcaaataaagctggcaaattagctttttttttaggtgtaccacttctgtattgatgagaattggactgaactagaaagaaacttgcacaaaaagtttcagaattgtcctatttatttggtgtaccgattgaaatattttgaaaaaaaagtttttttttcaaaatatttcaatttttaaagatgggacgttatttgatttcgaaatctgaatattatagtcataactcgaagtgctccttggtgtat

SEQ ID NO: 594 - DNA, 1463 bp, Phaseolus vulgaris
aaactcgaggttagggataagtataagccgtaaaagaaatgggtctaattccttcagaaaccacaccttcccacgttcttcttttcccgttcatgtctaaaggccacaccataccccttctccacttcgcgcatctcctccaccgtcgttccatatccgtcaccgtcgtcacaacccccgccaaccaccctttcatcacggattccctaaagggaaccgccgcctccgtggtcacgctttccttccccaccatcacaaacatccccgttggagttgagagcacggacaagcttccctccatgtccctcttctacgagttcgtcactgccacgtcagcaatgcaaccgcagttcgaacaactcctccagacccttccacgcgtaaacttcatggtcaccgacggcttcctctggtggaccctagactcggccactgcgtttggaatccccaggtttgtctactacggcatgaattgctatattaaagccgttttaattgaagcaatgagaaacgggattcttaagggctcccaacccgacaacgagttagtcgagttgactcggttcccgtggatccgagtctgcaaagaagattttgaccccaccttcagaaaccctcaccccagtggtgttgaatacacgttcaccatgaattcgatatcatcctcacaacgcagtcatggcatgttggttaatagcttctacgagcttgagtctacctttgttgattacgtgaacgcggattcctctcctaaaagttggtgcattggccctctctgtttggttaaatggacaccgaaggtttactctgatgaaggtctgaaacccaggtgggtgacgtggttggaccacaagcttgaagagaagtgtcgtgttctgtacgtggcgtttgggtcgcaagctgagatttcatctgagcaactggaagagatagcattagggttggaagaatcggaggtgagtttcctgtgggtgatgagaaaggaggagtggggtgttcctgatgggtttgaagaaagagtgaagggaagagggatggtggtgagagagtgggtggatcagatagagattctgatgcatgggagtgtggaagggtttgtgagccactgtgggtggaactcggttctggagagcgtgtgcgctggggttcctattctggcatggccaatgatggcagagcagtatttgaatgcgagaatggtggaagaggaggtgaaggtggggttgagggtggaaacatgtgatggttcagtgagagggtatgtgaaaagggaagggctgaagaaagcggtgatggagatgatggaaggggagaaggggagaaaagcaagagaaaaagtgagggaattggcggagatggccaaattggctacgcaagagggtggttcatcgtcgtcgacgttagagtcacttcttaatcaggcatgagcttgtcataaagactggcttaaatgaaggcctaaa

SEQ ID NO: 595 - DNA, 1609 bp, Phaseolus vulgaris
cccgtcgacgttggtttccttgatggcagatcagaagaatgagaacccaaatcggggaagtgttaatgttgaatcagcaaaaggaaggaacaaacttccaaactttctgctatctgtgaggctgaagtatgtgaagctagggtaccattatgtgatctccaatgccatgtaccttatgctcataccccttcttggcatagcctctgctcatctaacaaccctttccatcaaggactttctccaactgtgggagaatctcaagttcaaccttgtctcagtcacagtgtgttccagcctcatggtgttccttgctaccctttacttcatgacccgtcccaggggcgtgtatttggtggattttgcatgctacaagcctcacgtggactgcacgtgcacaagggagacttttgtggagaagtctggtctgacagggtcgttctcggaggagaacttgtcctttcagaagaagattctggagaggtctggtttgggacagaagacttatctgcctccagcagtgttgagtttgccaccaaacccttgcatggctgaggctaggaaggaggctgaggaagtgatgtttggagccattgaccagctgctggcaaagactggtgtgaaggccaaggatattgggattctggtggtcaattgcagcttgttcaatcccacaccatctctctctgccatgattgtgaatcactacaagctcagagggaatgtcctcagttataatcttggtggcatgggttgcagtgctggccttatctccattgaccttgccaaacagctcctccaggttcatccgaactcttacgccttggtagtgagcatggagaacatcactctgaactggtattttggcaacaaccgatcaatgctggtgtcaaactgtctgttcagaatgggaggagcggcgatcctcctctcgaaccgctccggcgaccggcggcgggcgaaataccagctagtccacacagtgcgcacacacaagggagcagaggacaagtcgtacgggtgtgtgttccaagaagaggatgagacaaagagagttggtgtggccctctcaaaggacttgatggcagtggcaggagaggccctaaagacgaacatcacaacactaggacccctagtccttcccatgtcagaacagctccttttctttgggaccttggtggctaggaaagtgttgaagatgaagataaagccctacatacctgatttcaagttggcatttgagcacttttgcatccatgctggagggagggcagtgttggatgagctggagaagaaccttgagctaagtgagtggcacatggaaccttctagaatgaccctacacaggtttggaaacacttccagcagttccttgtggtatgagttggcctacactgaagggaagggaaggatcaaaaagggtgacaggacttggcagattgcatttggatcaggattcaagtgcaacagtgctgtttggagggctctcagaaccatcaatccagcaaaggagaagaatccttggatggatgagattcatcactttcctgttcatgtgcctaaagtggcaccaattgcttcctaaatcaaatcacacccttaaggatccttt

SEQ ID NO: 596 - DNA, 1269 bp, Phaseolus vulgaris
aaaggatccttgaagaaagtgtgagaaaatggtagtagtcacccctccaacagcgtctaacaaatggacacagttatcttctcttgcatctcagatagatgatcgcaaggcctctatgggaagagtcatggaaaaaccaacccaagatcttcttcagcagcagcaacaagccctcaagtgccctcgctgcgactcttcaaacaccaagttctgctactacaacaactacagtttgtcacagcctaggcacttctgcaaagcctgcaagcgatactggaccagaggtggaactctcagaaacgttcccgttggtggtggttgcagaaaaaacaagcgtgtcaaacgtccaaacggtgacgcttctgctaactcccccccttcttcctccactcctagctccaattcaaaccctccttcacggccccacatcccttctagttcaaccgcaaaccatgtcaatgtaaaccctttgttttatgggctacccaatagtaacggttgtgatgtcatggatgttcctttcccaaggtttaatcttcagtctcagctgaatgcccttgggttaggtttttcgtccggggttaacgttatctcaagtgaacctagtgataatgggtttagtactactactactacttcaaatactaacaactttctttcggcttataattccatatttggttcttcttcctcctcaacttgtgcaccctcaactcctgttatggcttccttgctgagttctactctcctgcagcagaagtttatcggtggtgctggggtgaagggtcatcatgatggcaatggtttccagggttttgcaccgcttcaagggttgcaaatggaagggagtaataatattagctcaaaagaagtgaaagctgaaggaccaaacaggttggagttggagtggagtaataataacaataacaatggtggtggtggtgcttgtcaaaaccagatggagcatgtgggcttgtctgatcctaattcactttattggaacactgcaacaggtttgagtgcttggagtgatcaacctaactttggtccttcagtcacgtctctgatctagaaagatgaagcatcgttttcaaagctatatatgaaatctctctccctcgtttaattaagggcatgtttttgttctttaggcttagttttgctacttttcttttggggtcaaagttggttggatttactacttacaccgaaaagaaaaaaaataaaaaaagaagatacttgagatgagaggagtttgggggtaccttt

SEQ ID NO: 597 - DNA, 696 bp, Phaseolus vulgaris
aaaggatccccatagcaatagaagtgacggtggtgacataagaaaacaagagaaagcagaaagaggatgggaagagtctttgtgatggagcttgagggaaggtcttatagatgcaagttttgtagaactcacttggcccttgcagatgatctcatttcaaggtcgtttcattgccggaggggaaaagcatacctattcaataacgttgtcaacttcacacttggaacaccagaagaaaggatgatgctttcaggattacatactgtggcagatatcttttgctgtagctgtggtcaaattattggctggaaatacgaatctgcacacgagaagagtcaaaagtataaagaagggaagtttgttcttgaaagaggaaggatagttgatgaagttgatttctctactgaattctacatcgacagtcgtggctgcatgagtgatggtgatgaggcttaaacatgtgctgctggacttgttggatcagaagaaaaaatacactacttctgtatatgatcaacaataaaggtgacccttgaaaaatgttcaaaactagtgaggtttattttgttttttatttacatgtggtatatatatgagaacgagagttgtgttatatgagaatgagagttgttaatggtgtgtaaattgtggagaaagaaaaagatgaaacgtggtagtctctgtgcaggtaccttt

SEQ ID NO: 598 - DNA, 1137 bp, Phaseolus vulgaris
aagaagatgaagaagcagcagacgcagaaaagcgagttcgagttctgcaaagcgtgcggcataaaccacgaccaaggtctccgccacaagtacttccctaaccacaagaaatccctctccaccttcctatctcgcttccgtaaaaaactctccgatgttcgctttttcctcaacgcccctatccctctcaatccccaactggcttctcgcaatcgcttctggtgtgtcttctgcgaccaagacatccacgaacactccagttcctttgcctgcgccaatgcgattcgccacctcgccagtgccctacacctgaagaatttgaagcacttcttctggaaatacggtgctgcggcggatcaattggacgcgtttatgttttccgatgatgatgtgaccaagtgggagaagaagtgcgtggcgcgaaaggatgaagcgaatgagggaagtcgcagaacggtggttggtccttcaagtgatgatcatatccataatcaactcaccagtggaaatagtaatagttttgaaacaaatgtttattcccattctgtgaagtcgtatccttcaaatcctgttttacctttaccaaactatacaaatgagtatcagatatctagttcaggactctctggaatcgccaatgttgctacctcgtcggaagcgcgccctgatgcaaaacctattgtttttcaagattttttgggtgtacaattgatcactcagatttcttctatgcctattgaaagtgctgagaaaaaagtttattctgaagcacctccaccatggattgacacaactgaggcagttcagatgcattctagttcaaacaagttagggaagtccaaaatgttgaatccaaatcgggtgggagcagcttgggttgaaaagagaaagattgaaatggagaaggagaaaaggggagagacgataaggaatggtcgtgatgccagctggcttcctaattttggtagagtctggcaatctggtagcagaagagaatccagaaaagaatttgagagggagaaacagttgcagaagttaaatgttgaaacagagtctgagatggcaatcaaaattcagccttatgtaagcaaaagaatgcggatggatagtgtaggtgataatgcaagcggatgataa

SEQ ID NO: 599 - DNA, 359 bp, Phaseolus vulgaris
agataatggagggtgttgtgaagtttgcatgccttgttgggtttgtggtggtggtgagtattgcaggggtggatagtgctggggaatgtgggaaatcgactaccccagataatgaggcttttaagcttgctccatgttcctcagcagcacaagatgagaatgctagtgtttctcaaagttgctgcgcacaggtgaagaaaatagggcagaatcctagctgcctctgtgcagttctgctatctaacacagccaaaatggctggagtcaaccctcagattgctgtcaccatccccaagcgttgcaacctcgctaatcgccctgttggttacaagtgtggaccttacacacttccttaataa

SEQ ID NO: 600 - DNA, 1777 bp, Phaseolus vulgaris
cccaaacaataacacgatgtggcgaaggagcttcagcagcagcacccccaccgccaccgccactctcaagggcaagaaatgggacgcgctgataatcggcggtggccacaacggcctcacagcggcggcttacctcgcgcgcggaggcctgtcagtggcagtcctggagcgccgccacgtgatcggaggcgccgccgtgacagaggagcttattccggggttcaagttttcgcggtgcagttacctccaaagccttttgagaccgtccgttataaaggagctggagttggggaagcacggcttgaagcttctgaagcgcaatccgtcgtcattcacgccctgcctcgacggacgctaccttctattaggacccgataagcagctcaaccactctgagatatccaaattctcgctcgcagatgctgaggcttatccaagatacgagagtcagcttgagaacttctgtaagttcatggatctagtgctggattcgcctccacctgaatctgtgcagcataaattgtctattaatgaaaagttgaagaataaaatacagaattcagtattttgggcgagttgtctgcggcatgtgtcttccatgggacaaaaggatatggtggacttcatggaccttctgttgtccccagcttctaaagtgttgaataactggtttgaggcagatgttctgaaggcaacccttgcaactgatgctgtgataggcagtacggccagtgtccacaccccaggaagtggctatgttctgctacatcatgtgatgggagaaactgatggggaacgtgggatttggtcatatgttgaaggtggaatgggctcaatatccaaggctattggtaatgctgctattgaagctggagcgcatgttgtaaccaatgctgaggtgtctcggttgttgattgaaaattctagcactgtctgtggggtgactctggctgatggtactgaagtgcattcttcaattgttttgtccaatgcaactccatataaaactttcatggaattagtgcctgacgatgtactccccaatgattttgtccgtgccattaagcactctgactacagttctgccactacaaaaataaatgtagctgttgataaattgcctgaatttcgctgttgcaagttggatcatcctcatgctggtccacagcacgtcggcacaattcatataggttcagaaagcatggaggagattcactccgcttgtcaagatgcagcaagtggaacaccatcgagaagaccggttattgagatgacaattccctccgtactggacaaaactatttctccacctggtaagcatgtaatcaacctgtttgtgcagtacacaccctacaaaccattggatggtgactggcaagatcacaaatacagagaatcgtttgcacaaaaatgcttcacgttgattgatgaatatgctcctggcttcagcacatcagtcatcggttatgacatgctgactccaccagaccttgaaagggtaatcggtttgacaggagggaatatattccatggggctatggggttggattcccttttcctcatgcgacctgcaaaggggtggtcaaactacaagactccgcttcaagggttatacttgtgcggaagtggagcacatcctggtggtggagttatgggagcacctggacgtaacgctgctcgtttagctcttcaagatattagagaaagaacttaaggggtgatagtgatactcaattatggctcgtccacattgttacttctgcaaactggcttgtaa

SEQ ID NO: 601 - DNA, 703 bp, Phaseolus vulgaris
gtccaagccttatcttcattcttctttccaaattggcatggcttccacaatgttcacatatccttctcttcatcttcacatctactcacataaaacatcaaatccatcagagtattccattcacagtcaacccagaaagaacttttccattagatgcacatctctggagtccactcctcctgagggtgagtttctaaccccagaccctaccttcagcacagtgaacagtgaagagtcttttcccattgagaagagaaggaggtcagagatagtgagggagagaaggggaaagaaacttgtgcagcctgagcctccaaactttgaaattggatggaagaggaccaaagaaataaaccaagaggtgccagtagggtatgtcatagctgacttcttggagaagctagagaccctcatggagaaggagtttggatcaacagaactgctggcaaaggtgggggaaattgtggctgagagagcaagagaagaggcagaggttctgatggatgaagggaaagtggaggagagaatggtgacagaactgtttagagtgttgaagttgatggagatggatttggctatggtgaaggctgctgtcaaggaagagacattgggagagaggcttgagctggccaaggcaaggtgcaggcaagccatacttgttgcttattccttttgaactctttcatggggattctgtcactag

SEQ ID NO: 602 - DNA, 1280 bp, Phaseolus vulgaris
aaaggatccgggttgagatatagagtaagcagtgtgtagtgaaaactgaaggtctagattctgtttccatgcctcctgttcctatttctcctgtcaaagttgggcacattgatgatgtccaagagctaagaaaaactaagccaaggacaattcctcaaagatttgtacgagacatgacagaaagaccaacactttctactacacctctccccccatcaaatactcacatgcctgtcattgatttctctaagcttaccaatggaaacaaagaggatgttcttagtgaaattttcaatcttgcaactgcttgtgaagagtggggattttttcaggtaattaatcatgagattgacctcaatctggtagagagaatagagaacctgagcagggagtttttcatgctacctttggaagagaaacagaaataccctatggctcctggtactgttcaagggtatggacaagcttttgttttctcagaggaccagaagttggactggtgcaacatgtttgctcttggacttgaacctgaatatgttaggaacccaaatctatggccaaaaagaccagaaagattcagtgaaacggtggaggagtactcaggaaaaataaggaaactgtgctataatctgttaaagtatatagctctaggcctggatttgaaaggggatgtgtttgagaagatgtttggtgtatcagtgcaagctataaggatgaactactaccctccatgctccagacctgacctggttttgggtctgagtccccattcagatggaagtgccctcactgtgctgcagcaagcaaagggaggcccagtgggacttcagatactcaaagacaatacatgggttcctattcagccaattccaaatgctcttgtcattaacattggagacacaatagaagttcttacaaatggaaaatacaggagtgtggagcatagagcagtggctcatgaggagaaagatagactctcaattgtgacattttttgctcctagctatgatgtggagcttggtccaatgccagaatttgtggatgaaaaccacccatgcaagtatagaacatacaatcatggagagtacagtaaacactatgtaaccaacaagttacaagggaaaaagacactggactttgccaagatccaaaccaaaaacacaaactaggatggtccccaactagctaggagtactataattagactgactatgtgtgtgtatataattgtgttccacataaaagtgcatcatggtcaaatctctcaatagggtaccttt

SEQ ID NO: 603 - DNA, 2370 bp, Phaseolus vulgaris
aaaggatcctgaacacacagttacagtgacagcgtgctgatggtctctattggttcaaaagcattggtttcaagaagctcaatgggggaccacgattctgaatcccccaagcaagccaaaagtaagaggagaaagcataagaaaggaggagccgctcatgaattcgattccaatcccaaacacacaaactcaaactcaaactccaactccaacaccttcacttcccctcctcaactctcccgcgttaggaaacagcttgaccctgaaacaacccaatacttctcagaaattgctaatctttttgaaactgagggggtggaattggaggaacgatcacttatatgtgctaatgctctccaagaaactaaggggaaagaattcgaaatagcgtcggattatattgttagccacactttggagaccattctccagggttgtgatgtagaccacctttgtgatttccttcactcttctgctaacgacttcccctatattgcaatggatagatctggttctcatgttgctgagaccgccatcaagtctctagccgttcatctccaacatgatgaggctcgccctctggttgaggaggctttaaccgtcatatgcaaggtgattgcagcaaattctgttgatgtaatgtgtaactgctatggttctcatgtgcttcggactcttctctgcctttgtagaggagtaccattagacaagtctgcatactatttatcaaaatcgactaccctgttagcagagcggttgaattcaaaggagttttcaaagaaagatgatgaaacaaattttgagcccggatttccaaatttacttaaagtacttgtgtctgatatgttaaagcatgctaaaaaacgtatcaagacactacaagttgaccaattcagtagtttggtttttcagacagtgctgagggtcttggcaggtgatgatgaagagttgctacatgtgattcctttccttcttggctgcaaggataagtataatgcagaggaaagttttataaacacgaaagtagtagcagatctcaagaatttgttaaaagaatctaaatttagccatctaatggaggtcattttggaagtgtcccctgaggcgttgttcaatgaattattcactaaagtattcaggagttccttgtttgagttatcatctcatcaacatgggaactttgttgtccaagcattaatttcttattcaagcaatcaagatctgatggagttgatatgggaagaacttgggccaaatttggaggatcttttcaaaatgggaaggtcaggtgttattgcttcacttgttgctgccagtgaaaggcttcatgttaatgaacgcaagtgctgtcaagtccttgctgatgcagtatgtccaccagatgattctccgaaagggattgttccacgactcatgtttcttgacagctgtttctcatacgaagacaagtccaactggagctggcaaagtggtgctagaatgaatgtcatgggttctctgatcttacagacagtattccggtttagaagtgaatatatacaaccttatatcacaagtataacttccatggaggcaactcatgtacttgaagcagtgggagattcaagaggatcacatgttattgaggcttttctttgttcaggagcttctgggaaacagaagcgcagattggttatcaaactgaaagggcattttggggaggtcgcactcaactcatctggtgcttttaccattgataagtgcttcactgccagtaatctgtcactaagagaggctatagtgtctgaggtgttggctgtgcgaagtgatctttccaagacaaagcagggctcttacctaataaggaaactagatattgacggatttgctgcgaatcctgatcattggaggtcaaaacaagtatccaaagaatctacttataatgatttttacactatgtttggttccaatgatacaaagttgacgaaaaatgattcctttctgagtgacaccttgaataataaatctaatccaaaagctgtaaaggaaatgaggaaagaaattgaccaatctctaggttctggtgcatctttcttgagcttccaaaagaacccaaaaaaagaaaagcacaaaagtaagaaaaatgcttatattagtggagacgatgatgagtcgtctaataggaagaagaggtctaaaaaggaaaaggttgaaagtgggtttgatactgctgctactgcagcaaccgggaagacattgaagaaacgacgaagagatgacctttccgaggcttcccagaagaaagtgaaggcatagagttaaagacaatttttccccccaaagacgaagttattttaaagggaatggtgttaagcaggtctgggtaccttt

SEQ ID NO: 604 - DNA, 2103 bp, Phaseolus vulgaris
aaaggatccgaattggaaagaagcactcaacgtttgcaagaaaatgacagaacacggtgtcgggcctgatcttgttactcacaatattattctatctgcatttaaaagtggcgctcagtatttgaaagctctgtcatattttgaactaatgaagggaactcatattcgtcctgacacaacgacacttaatattattatccattgtctagtaaagcttcaacaatatgacaaagctattgatatttttaattccatgagggagaagaaatcagaatgtacccctgatgttgttacattcacaagtatcattcacttgtattctgtgtgtggacaagttgataattgtgaggctgcattcaatatgatgcttgcagaagggctgaaacctaatatagtctcatataatgcactaattggtgcatatgctgcttgtgggatggacaatgaggcacttttggttttcaatgagataaaaggaaatggttttcggcctgatgttgtatcttatacgtctctccttaatgcttatggaaggtcacaaaaaccccaaaaagcaagggaaatatttgatatgatgaagacaaacaagttgaagccaaaccttgtcagttacaattcactgatcgatgcctatggatctagtggttttctgacagatgcaattgaagtcttgcgagaaatggaacaagatggaattcaaccaaatgttgtttcaatatgcacactcttggctgcctgcggacgatgcagtcggaaggtgaagattgacacagtgctaacagcagctaagatgcgaggaattaagttaaacacagttgcttataattctgctatagggagctatatgaatgtaggggaatatgacaaagctataaacttgtataaatctatgaggaagaaaaaaattaaaactaattctgttacttacactgtgttgataagtggttgttgtaagatgtcaaaatatggtgaagccctatcttttatgaaagaaatgatgcatctaaaacttcctttgaccaaagagctctactcttctgtcatatgtgcctatagcaaacagggtcaaattgaagaagcagaatctacatttaacttgatgaaatcatctggttgttaccctgatgtggttacatacacctccatgcttgatgcctacagtgcagctggcaattgggagaaagcctatgcactctttgaagaaatggaagcaagtgacatcaagctagataccattgcctgtgcagctctaatgagatcttttaataaaggtggtcaaccgggaagggttcttaatcttgcagaaagcatgagagaaaaagaaattcctttcactgatactatattttttgaaatggtatcagcctgtagcatattacaagattggaggacagctgttgatttgatcaagtacatagagtcctcacttcctgtaatttcatccgggtgtttgaatcagttcctgcattctttaggaaaaagtggaaagattgaaactatgttgaagttattcttcaaaatcttggcatcgggtattgatgttaacttaaacacttactctattttattgaagaaccttttatcatctggaaattggaggaagtatttagaggtattgcaatggatggaggatgcaggaattcatccatcaaatgaaatgtaccacgatatatctgcgttttctcaaaaatgctgtgggcacgaaaatgctgctgttataaaagaaagacttgaatccttgaaaagaaaatctgaggatcaaatttctgccaaccgaccaggtgaaactcctgttcttagttgaccactgtcatggaatcacaattttttggcttagctgtgacacaccggtccaacttttgctgaacttctgcctgagattttgtgaagattgaagttggaactcaatgtgatggatcacacgctactcttgtataaatattaggaaaaatgctattaacacatttcattattgaatgaaattttgacgaaaaccacaagatctcattaaataagtgatatttacaaaaattgtgatatcaataaattttactgagtaatagaaaaatgttcagaagggtgtgtaaatgattgggtaccttt

SEQ ID NO: 605 - DNA, 721 bp, Brassica napus
cctaagttgcaaccatgggtatttctcgtgactccatccacaagaggcgtgccactggaggcaagcagaagcaatggagaaagaagcgaaagtacgagatggggaggcagccagctaacaccaagctgtccagcaacaagacggtcagaagaatccgtgtccgtggaggcaacgtcaagtggcgtgcgttgaggctcgataccggtaactactcctggggaagtgaagctgttacccgcaagaccagagtccttgacgttgtctacaatgcctccaacaacgagcttgtccgtacaaagacacttgttaagagcgccattgtccaggttgatgccgctcctttcaagcagtggtacttgcagcactatggtgttgaggttggtcgcaagaagaagaatgctgctgcttctgccgccaagaaggaaggagaggatggtgaggatgctgcaccagctgctgctgctgcacctgaggaggtgaagaagagcaaccatgtgcagaggaagatcgagagccgtcaagaagggcgcactcttgattcccacattgaggaccagtttgcaagtggacggttgttggcatgcatctcctcaaggcccggccaatgtggacgtgctgatggatacattcttgaaggcaaagagcttgaattctaccagaagaagattcagaagaagaagggcaagggtgccgcttaaaactcgttgtctgcttgaaagct

SEQ ID NO: 606 - DNA, 1135 bp, Brassica napus
ctttagatccggaagttgcttggcgagagaagatgacagtgatcgacattctaaccagagttgacacgatctgcaagaagtacgacaagtacgacgtcgacaaacagcgtgagtccaacatctccggcgacgatgcttttgctcgtctctacggagctttcgagactcaaatcgagacggctctcgagaaagctgagattgttaccaaggagaagaacagagcttctgctgttgcgatgaacgctgagatccgcaggaccaaggctagattgtccgaggaagttcccaagctgcagagacttgctctcaagcgggtgaagggccttacaacggaagagcttgctgcgagaaacgatttagtacttgcgcttccggcgaggattgaagctatacctgatgggacagcgggtggtcctaaaagcactagtgcttgggctccttctacaacttctcgtcctgatattaagtttgattcagatgggcgttttgatgatgattactttcaagagtcacatgaatccagccagttccgacaggagtttgagatgcggaaaattaaacaggaccaaggtctggacatgatctccgaaggtttagatgctttgaagaacatggcgtctgatatgaacgaggagctggaccgtcaagttcctctgatggatgaaatcgactcaaaggtggacagagcaacctcggatcttaagaacaccaatgttagactcaaagatactgtgaaccagctgaggtcaagcaggaacttctgcatcgatattgttttgttgtgtattgttctgggtatcgctgcatacttgtacaatgtactgaagtaatgagatgaacaagaaaggacccatcactactctctcttgccatctgctattaaagtttcttacccgagtcaatgtctgtgtgcttgtttctggtggtatttgtgtgatctttcaacgggagtttcttcttagtgtcaagactgttcaagttgtttcttctgttgagttgtttccatgttgttcatgtccattacatgatgaatatatataaccttgttaaatttaccaaatttatgtaattccattcattcgttgtccctgtcaatgtaccgtctagctagtcgtttactatgtgctgagtctgc

SEQ ID NO: 607 - DNA, 1651 bp, Brassica napus
aaaggatccaacacacttgggtaatagaaatctgtctttctttgggtgaaatggcactagcgatcaacgtttcttcagcttcttcttctgtgatctcaacctctagcttcccttcctcagagctcaaagtttcggctccacggatcggttcattgaggttatccgatcgtgtcaatgtctcaacggcgtctctgagtctatccgggaaacaatcatcatcggtgaagcctctgaatgtgcagtcagttgcaaaggagtcgtttgttccttctcaagcagcgtccatggtgacttctgaggttacagagaaactagatgtggtggaagtggaagacttcgaggagctagcaaagagtctagagaccgcttctcctcttgagatcatggacaaggctcttgagaagttcggaaacgacatcgcaatcgcctttagtggagcagaagacgttgctctcattgagtacgctcacttaaccggaagacccttcagggtgttcagtttggacacagggagattgaaccccgaaacatacagactcttcgacaccgtggagaagcactacggtattcggatcgagtacatgtttccagacgctgttgaggtccaagctcttgtaaggaacaagggtttgttctctttctacgaagacggtcaccaggagtgttgccgcatcagaaaggttagaccattgaagcgtgcgttgaagggcttacgcgcttggatcactggacaaaggaaagatcaatccccagggacgagatcagagatccccgttgttcaagttgatccggtgtttgaagggttagacggaggagctggtagtttggtgaagtggaatccagttgccaacgtcgaagggaacgatgtttggaacttcttgaggactatggatgttcccgtcaacacgcttcacgctgcggggtatgtttcaatcgggtgtgagccgtgcacgagagcggttttgcctggtcagcacgagagagaagggagatggtggtgggaagacgccaaggctaaagagtgtggactccacaaagggaacatcaaggagaacagcaacgcaaacgcagcggctaatgtcaatgggacgtcatccacggttgctgatatcttcaaaagcgagaatgttgtgagcttgagcaggcaagggattgagaatctgatgaagctggggaatcgtaaagaggcttggatcgttgtgctttacgcgccttggtgcccgttttgtcaagcgatggaaggttcgtttgatgagttggcggataagttgggtgggagtggcgtgaaggtggctaagtttagagctgatggtgaccagaaggagtttgctaaaagggagttgcagcttgggagcttcccgacgatacttgtgttcccaaagaactcttcaagaccaatcaagtatccatcggagaagagagatgttgattctctgacatcgttcttgaatcttgttcggtaaaaagagcaaaaaatcagtcgactttgcaaaacaaaaccattcagtctagttctagagtgctagaacagatgaagtaagagcttgagattctctatttgaaagctttcacttttgtatagttgtggtctatccttttgtaaaacatttgcctttgtgatgatgatgatatgagcaagtttggtaccttt

SEQ ID NO: 608 - DNA, 725 bp, Gossypium hirsutum
tgaaaatggagaattgttacccttttagcttgcttgaacctccaaattgtgatggttgcaatgctgctgctataagcaatgagcctcctttcgtagttccatggccagtcgaacctcttttctcagcttctagctcggttcgttgccacgggtttacttcgccagcgatacctgataaagctacggtggcttccaagagccatagtgaagccgagaagcgtcggagggatcggattaactcgcagcttacagctttgaggaaattgattcccaagtctaacaagatggacaaggcagccttattaggaagtgcaatagagcaagtcaaggatctaaaacgaaaagcaacagaaatcggcaaagcttttgctataccgtccgaaaccgatgaagtatctgtcgattacaatgttcccgaagacaagacattcatcagggtttcgatttgttgcgatgatcggccggaagtgttttcggaactcatccgagtcctcaaagggctaaggcttagcattgtggaagctgaaatttcaagtgttggtggaagaaccaaaagcaatttgatcctttgcaatgagagtgataatagagaaggtgtttcaagcaatctaaaacaatctttgaatgtagttgtgaacaagattaatgctttatcatcggatgaatcgaaatcgaattatcggataaggagtaagagacaaaggttgttcttgtcttcttagtaa

SEQ ID NO: 609 - DNA, 809 bp, Gossypium hirsutum
ggttcatttatctttcgcctccctctcttttcttttttcaatcccctccttctttcaggtaaaatgcaacgggcagttcgagctttttcggtgcacggaaatactgtgaaaaatgcgatcttgcatcgcattcgggttgtcaatccggttatacgacccgttatgttttccagatcacttacatctgctagtatggaagaacatggcttcgagagcaccactatttcagacgttttgaaagccaaaggcaaaggtgcagatggatcctggctttggtgcactacggatgactctgtgtacgatgctgtgaaatcgatgactcaacacaatgttggtgctctggtggttgttaaacctggagagcagaaatcaattgcgggtatcatcacagagagagattatcttaggaagataatagtacatggaagatcatccaagtcaactaaagttggggacatcatgactgaagagaacaagctcatcacggtcacacctgagaccaaagttctgcaagcaatgcaattgatgacagataaccgaatcagacacattccagtgatcaatgagaaggaaatggtaggcatggtttccattggagatgtggttcgtgctgtggtgagcgagcaccgtgcagagctggaccgcttgaatgcttacatacagggaggttactagatgatgatgatgatgatgatgatggaatatagtgtatgtttcacttgttggacctaagcaagcaagcaaggggagagcttgcaaatatgctatgttttcgtggtttttctgtgaagatgcaagtgatgttggaa

SEQ ID NO: 610 - DNA, 601 bp, Gossypium hirsutum
aaaggatccagaaaggaaaaccatggctcctagatcaaaacccagcccgattagcccgaatcccgacccgaattctaaggagatccgctaccgcggcgttaggaagcgcccatggggccgttacgcagccgagatccgagacccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcccgtgttcttccctccctgtgacggcgcagcgtccggtttacttcttcgatgccttcgctactggcggttcgggttgccccgcatccggattcgctcaaagcgactccgattcgtcgtcgtctgttgtagattttgaaggaggagtgcggcggagagtgtttgatcttgatcttaaccagttgccagctgaaatggattgatttgcctccttttttcaatatgtcgttttcagcttctagggtaccttt

SEQ ID NO: 611 - DNA, 1230 bp, Gossypium hirsutum
aaaggatccaaagcgcaacattctccttatctctccacagtcgttctccctaattttcctccaccgctatgcatccgtccaaaccactcaatctcttttttattttaacggtcatgatccgtctctgcttcgccgatctaccttcttttcgggaggcaccggcatttcgaaacggcagagaatgtccacaaacaacatggtcctccctcgacaaagagatccacaatccctccattatccacatcgctatgacattagacactgcttacctccggggctccgtcgctggagtcttctccgttctccaccacgccacttgtccggaaaacatcgtgttccattttgtcaccacgcaccgacacggagctaaactcacgcgcgccattacctccactttcccttacctcaacttccatctctactacttcaacactaacctcgtcaaaggaaagatctcgtcttccatccgacgcgccttggatcaaccattgaattacgcgcgtatgtacctagctgatctgttgccagctggggtccggcgtataatctactttgactctgatcttatcgtcgttgatgacgtcatcaatctatggagcatcaacttgagaagccacgtgttgggcgctcccgagtactgtcatgccaacttcaccaactacttcacttctaaattctggtccaacccggctttttcggcgtcgtttaaaggaagaccaaggaatccgtgctatttcaacactggcgttatggtaatcgatttatggaaatggagagaaggtaaatacacggagaaattagaaaactggatgaggattcagaaaaggtatcgtatctacgagcttggttctttgcctccatttttgttagttttcgccggagatgtggaggggatggagcaccggtggaaccaacatgggctcggtggtgacaacttggaaggcttatgcagggctctgcaccccggtccggttagcttgttgcattggagcggtaaaggaaagccatggctgagaatcgactctaagagaccctgtccgttggattccttgtgggctccttacgatctgttccgccatccgtctttgttctccaatagctaaaatacggtggagagagttcatcggatttcgtaggagaataaggacacgtgtaaaaaaaggaaagcaccttgcaacttgcttcgccagtgaaaatatggagttaccgcgggtataagttggtaccttt

SEQ ID NO: 612 - DNA, 787 bp, Gossypium hirsutum
ttatcgctttgtctttgattttatttggggttgttttgagttaattaatatggggagtgaagttttacgacctcaggattgtttgatcgaacggattcggttacctccgacggcgtgtcctcgccggagatacggaaacggtagctttaatcctagttattatcataactacaacaataacaatggaaatggtagatctaacaggaaacccgttcagaggaagcggatcggatcggagcaggggatttcgaagaaatacagctccgccgatgacttgaagacggtgaggaacaatgttatggtggagaaggttacgattatgagacgaggtgagtcgttggattcgaagatcaagatcgacaatggcggtggtggaagggaagggggtttggttgttatgggtacggatcgtttgggtccggatccggaaatggtccctaaacagatcaaaatcgtggatgctaagtcttcggtgaccgtaaaatccgacgtgtatgccggatcggctttctccgtttctccggcaccgagctcacttcctttaccaactttctcgaagaagaaacaggttccggtcgatgattcagctacaagggatctcaggcgtttgctacggcttgatctctgatacccgaatatttagatttggatccaaataagcctgcgtctctttttatctccatctctctcttgatacgtttcgtctctatttagatatctccggaattttcaagatccgatgccctccgtgatattttttgaagacggtggacggatttgaaaatct

SEQ ID NO: 613 - DNA, 1176 bp, Gossypium hirsutum
aaagtcgacccgctgttaaatacctccataaacatcatcccctcagaaaagtagaagcttctctctcccattaaccctaaatacacaacaaataaaattacttcaaaacaataggatggcagaagcagaggtaggatctggtgaaggaaagccccaagagatgtcgttgaaggataaagggaatgagtttttcaaggctgggaactaccttaaagctgctgctctttacactcaggccattaaacaagacccttcaaatcccactctttatagcaatcgagcagcagcgtttctacatttggttaaacttaacaaagcgctggctgatgctgagacaacaattactttgaaacctcagtgggaaaagggatattttcgaaaaggatgcattttagaggctatggaacgatatgacgatgctttagctgccttccaaatagctttgcagtacaacccacaaagtgcagaagtctcaagaaaaattaagagactttcacagcttgcaaaagataaaaagcgagctcaagaagtgcaaaacttgcgatccaatgtagatatagcaaaaagcttggaaacattgaaatctgaaatgtctgaaaagtacaaatcggaagatagttggaaagagatgttttcttttcttattgagacaatggaaacagctgtaaaatcatggcatgagacttccaaagtggatcctagagtctacttccttcttgataaggagaagagccaagccgataaatatgctccagttgtcaatattgacaaggcttttgaatcgcctcatacgcacagcagttgtttttcatttcttaggcaatatgctgaagattctttctctagagcagcttgtttagttgctcctaaaagtatcatagcttatccacaggtctggaaaggtcagggttcaaggaagtggaagcatgggcaacatgatggtttctttgttcaattcgagtcaccactcttgcgaaaactatggtttatttcgagttccaatgagatggggaagacactgtgcagggatccagaggttctagatataggtgcacatgaagtacttccacgccttttcaaagaaaagctatccagttcctcatgagctttatcttaggctgaaggaaattgctaggcatgccggtggactttgattgcgaggtttacgaattcttt

SEQ ID NO: 614 - DNA, 2000 bp, Gossypium hirsutum
cgtgttagattcacccactgactcagccgcgtttcttttttttttttttttgttttttcttcctatcatagtgaaaattttctggttttttttttcgagtgaagacctctcaaacaagaagacgatgatgatgaagaagaactggaagtttgtaagactaagacaagagtttcgagttggtgttttgctgcttttattatgtcaaagtttggcttgttggtcgttgaatgaagaaggatttgctttgttgagactaagagagagagtggtgaatgatccatttggtgctttgtgggcttggaaggaagaaaatggagagattaaccattgttcttggtttggtgtcgagtgctgtgatggcaaagttattgctttgaatttgaaagatctttgtcttgaaggaacactggcacctgagcttggaactctaattcatattaagtctattatcttgcggaacaactcttttaccggaactatccccgaagggatcagcaaactgaaggaattagaggtattagacttgggatacaataatttcaatgaatcgcttccatctggactcagcaacgatctctccctaacaatccagaacagtgaccgatctgaaggtgcagtgctaaggagattgctgcaagaaacggcaaacacttctgcaaagtcaccaaaagcaccccctttaaattatagtatgcctccatctcctcgtacatctagagctccaactcatcctgcatcttctgaaccatccacaaatagtacatatttaaggggtgctcctgttccacgacctccctctgctcctgcttctaaaccttctggaaatgatacagtacctaatacttctgctccatcaccatcgggaagcaatccttctattcctgactctaagtcaagtcatcaagcagcaatactagtcggaagcatagggggtggtacatttcttctaatattaataatcattgcctatctcttgaaaacttacaaggtatctactgtgaaaccttgggccacagggctaagtggacaacttcagaaagcatttgtaactggtgtaccaaagctgaagcgatcagagcttgaagcagcctgcgaagatttcagcaatgtaattggttctacaacgattgggacggtgttcaaagggacactgtctaatggagttgaaatagctgtggtctctgttccagttgaatctaccaaagattggtcaaagaatttagaaacacaattcaggaagaagattgacacattatcaaaggtcaaccacaaaaattttgttaaccttcttggatattgtgaggaagataatcctttcactaggatgttggtttttgaatatgctccaaatggcactctctttgagcatttacactttaaagaatctgagcatttggactgggctatgaggttgagaattataatgggcatggcttactgcctcgagcacatgcaccagctaaacccacccgtaccccataacaacctgtcatcctcagctgtcagtctaacagaagattatgcagccaaaatctcagatccgtgtttctggaatgagttgactgcatcagacagggaaggagacagaataaacctttcggataccacaatggcaagcctagaaagtaacgtatatacctttggcgtattattatttgaaatagtaacgggtaggatgccttacttggtggataatggttcatctgaggacatggcatcagactatttgagaagggagcaagccctcgtagagatggtcgatcctactctaaactctttcgacaaggaccaatttgacctgattggggaggtcataaaatcttgcatcgaccctgagcctggacacagaccggatatgagaggagtcagtgcaagattgagagagattactgcaatcactcctgataatgcgatccccaaactttctcctctttggtgggcagagcttgagatcatgtctagtgaagcaagctagaggatgaacttgacgctgtaagtaa

SEQ ID NO: 615 - DNA, 814 bp, Gossypium hirsutum
aacgtcaccttccaatacaacccacaatgaggcaacaatatgtcttcactactctcacgttgctcatcctgttttccctcagttgttcaacaacattagcccaatctccggcactggccccggcaccttctggtccaacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtgcagctggtgcaattccacatcgtcccaacatacctcacctcgtctcagttccaaaccattagcaaccctttgagaacccaagctggtgatagtggcgatggcaagttccctctcaatgtcaccacttcggggaactctgtgaatataacaacagggttgacaaacaccagtgtttccggcactatttacactgatggtcagcttgctgtttatcaaatcgatcaagttcttcaaccattgcaaatatttgcacctaggcctccagctcccgcaccggcaccggcaaagtcgaagaataagaaggctaccactgttgctgatagccccgatgttaccccagctgataactccaaagcggccaccttgcaaaatgttggtttgtttggagttgctgctctagttattgcactttctttgtgaccatgaaaatggagaaaagaagaagacagtgattttgatggtggtgatcaagatgg

SEQ ID NO: 616 - DNA, 1068 bp, Gossypium hirsutum
aaagtcgaccaaactacctgcttctagctctccttttgaatcaatctccatttttagttttcgtaaagtgaaaggatgttaggcattttcaagaaagaattaatgaatccaccaaaggagctgcatagcccagcttcactcacttcatcaaacaagaccaagcttcccaatcaaatcatcaaccatttcctttcttcaaatcccaacaatgctttctcaatggggttcggatcctcagcttgctttgcttatgctcccacagagaatcgtttccccaatcatcaaaggttgttctgtggagtggatgaaatatactgcatattcttgggggatttgaataatttgagcagcctgctaaagcagtatgggctgtcaaagggcaccaatgaagccatgtttatcatcgaagcatatcggaccctccgcgaccgtggtccgtacccggctgaccaggtccttaaggatcttgaaggcagctatggatttgtggtgtatgatagcaaagctggaagtgtatttgctgcactgggtgcagatgaaagggttaaactctattggggtgtagcagctgatggatcagtagttgtttcagataacttgaagcttataaaagaaagctgtgctaaatcatttgcaccatttccacctgggtgtatgttccacagtgagcaaggattgacgagttttgagcatccgaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattatgttttttttttttgttgggggggggggttatttcctcgtttatgaaatcgtaaaatgccttgtaaaaggcatgtttgataaataaaatgaaaaaaaattagaaaagaaatcctaacatggcttgataactgaaatgcctggaagagttttatcatctaataaatgatgcagcttagcatttggaattcttt

SEQ ID NO: 617 - DNA, 1953 bp, Gossypium hirsutum
ccttggtgggtgtttctttaggttttcttgttcgcgacgattttcggtggcttgtaaatggcagcgtataggctcctgattttctccctctttttggccctagttttcaccaagattggagccgatgcctcaactgaaccgctgcttgaaccggacgccgccgattcttctgctcttaagatggagttggatcaactgaagtctaagatccgtcttcttgaatcaaatgttgaggagaaaattcgagaattgaaaaccaaggatgagatgataaagcagaaagataaaattatagaagaaaaatctgacagcatggcatcgttgcgctctgaattatcatctcttcagaaaaaaggaacctcagatgctgaggaacgggtgggaaaagctcatgcgaaagctcttgaattgcagaaacaggttgataaacttaaaactgaactagaagcaaaattgaaggataaagattatttggaatcccgtgcaactaaagctgagaacaatttgaatgaattgaatttgcagctagagaatcttcaaaagatcaataaggaacaggagaacaaactagcaaaaactgagcgagctctaaaaattgcagaggaagaactgataaaggcaaagtttgaggccacttcaaaggcaaatgagttgatggaggttcacagcgcatggctcccaccttggcttgctacacagttaattcgtggtcaggccttcattcagacacattggaatcagcatggaaaaccaaacatggatatggtgatccagaaggctctagagagaaaggccttagctaaaaagtgggctgaaccccacatggaagcaattaaaaccaaatgggttccagctgctaaggatcagtgggtggcggtaactacatatgctgaaccacatgtgcaatcgctaactgcaaaaactgttgaaatttatgaggtatcgaaggctacaataactcctcatattatcaaagttcaagaaacagttgatccttacttccaggaagccaagaagttcagtaagccatatattgatcaggttgctactttagcaaagcctcatgttgataaaatttctgtggtgatgaagccctatacaaaggaggtagttaaagcttatgggaggtttttggaatcagcaacaacataccatcaacaggttcaagcctctgtgcaagaaactttgaagaagcatgagctgacaagacctcttgcaaccaaagagcttgagtggttttcggcatctgctctattggctctacctattattattttgttcagaatattttcagcaattttctgcaaaaagacaaagaagcgtgttcgacatactaatgcagtccaccatggtcgtcgtaagggcaaaagggggcacacagacaagtagactgcgtgtatttaggttttggtctctgaatgttgggaaatattagaggctaactggacgtatgtttttactttttaggggctctaggtgatcatgttgggtagggagctgtggtgttgcaattgggaagtatttaatcttctcttacccctcaaggtccctggttttaatattattattattttttggggagggtgtggaattagaaaaagttaagaaccctagtgacgctacaaggttgaaatcttgagattcctagttgtagtaggagttgtgtattttatttatgttagtgtaattttattttgttttgtttttttttcttctggattcacaaacgaaacaactcagtctctgtttcagaaatcatcatactttttaagttgagacatccaaggggttttatactcttatcttgtctttgtctccaaggattactgtttgtttattgcctactttagctagtctctggatgggatcgcatgggagagcgttgcaatttcaactttccaccgactctatatgcatagacatagcccattctaagggattggcatgactagc

SEQ ID NO: 618 - DNA, 932 bp, Gossypium hirsutum
aaaggatcctctttgggagcaagagatatggcaagcacattctcttataattcttttggattccttctcattcttgtcgcctttagttccttgataaatataagttcagctggtaggcaaattgcccctaaaactagcattgagtttatcagaacatcttgtagttcaacgacttaccctaaactttgttacgaatctctcttaacacaggctagcatgatccaaacaagcccccaactcatcgcccatgcagccctaaacgtgaccctttcaaccgccaagtcaacctcggccatgatggtgaagcttgccaaaagccaaggattgaagcctacagaggtgggcgccatgcaagattgcgtggaggaattggaggacacgatagatgagctgagaaagtcaatcagcgagatgggtcagattaaaggctccaattttggactaatgattaacgatatacagacatgggttagcgctgctttgacggatgagaacacctgcgccgacgggtttggagggaaaaacatgaacggcagtataaagactgctgtgagatccaagattgtcacaatcgctcatttgacaagtaatgccttggctttggtcaacagctatgcttcatttcatggttagctatttaatcaactgtacagggaaatttagtcattatttacggtagcaattgtatttatggatttttagaaactacttctgttttcctggtaaatgtaaaatatatatgtggtccaaagaagggaatggagatgtgtgtgtgtgtgtgtgtgatcttggtgtcttaatgaaaatgaacggagtgatctatattatgtgcacacgttgtatctgtacaataaattgctttttgtgaacatagtaaaagtaaagttgatgaagcctctgttgcagcatacaagcagaggtttggtaccttt

SEQ ID NO: 619 - DNA, 920 bp, Gossypium hirsutum
aagggaaatacgaatcacaagcgctgatgaacaatctggaagagtgcaaagccgacaacccacaacatctacaacaagaagagatggcagcttccgcgggggcgatggatggcttggctgcatccgctttccgctccgttctccagagagtccaccagaccgccgagcggtgtggttgtgaatcgcagcggatccgtgtggttgccgtcagtaaaaccaaacccgtctccgtcattcgccaagtgtacgacgctggccatcgctgtttcggtgaaaactatgtccaggaaatcgtcgaaaaagctcctcagcttccggatgacatagagtggcattttattgggaacttgcagagcaataaagtgaagcctttgattgctggtgtgccaaaccttgccatggtggaaactgtagatgatgagaagattgcaaatcatcttaatcgtgttgttggaagctttgaaagaaagcctttaaaagtattagtccaggtgaataccagtggcgaggaatcaaaatctggtgtagagccttcaggttgtgtggaacttgtaaaacatgttagtctgaattgtccgaaccttcaattttgtggactgatgacaatagggatgcctgattatacatcaacaccagagaatttcaagacattagcaaattgcagaagtgaggtctgcaaggctcttggaatacctgaagaacaatgtgaactatcaatgggaatgtctagtgattttgagctagctattgaaatgggcagtacgaatgtcagagttggatcaaccatctttggagcaagggaatatcccaagaaaaactgaaacaaagcttatgaagtagaggggcttaatctttagatcttcattgcgttgtttattaaaagagttgtaggcaaacacaatcctcggtctgttgttctc

SEQ ID NO: 620 - DNA, 1350 bp, Gossypium hirsutum
aaaggatccccaacccatatttcatctcctcttttttattttttgggaaccaaatctatctttagggttttgattcaatcattcattgttctttcacaaaggaatgacgactactaaaaaaaacatgttacctcctggtttggttaacaatctccaggaagttcttcttagcagaaaaggcggaaactccaacaccaataacgatgaacaacaacaaaaacccgacgccgttactgattctactgagacatctacttctgcttctgatgaaaacgacaactccaagcctgtcgttttggttaccaacggtgaagggatttattcacttggccttgtttatctcgttcaagctttggtccgttctggcctctacaatgtccatgtttgcgcccctcaatcggacaaatctgtgtctagtcattccgtgactgttcgagaaacaattactgttactccggcagaaatcgatggtgccactgcttatgaagtttcagggactcctgtagattgtgtatccttagcattgtctggggcgttgttctcgtggtctaagcccctgctggtaattagtggaattaaccggggatcaagctgtggtcatcatatgttttactcgggtgttgtgggtggagctagagaagcactagtttctggtgtaccatctttgtcaatatcactgaactggaagagggaagaaagccaagaaagtgattttaaggatgcggttgctgtttgtttacctttaataaccgcagccatcagagatatcgaaaagggtgttttccccaaaagttgctttctaagtatagaaattcctacttctccttcagcaaacaagggttttaaattgaccaagcaaagtatgtggagatccgcaccaaattggcttgctgtttcagctaatcggcatccttcttctgctgctcatttcatgtctaatcaacaaagccttgggctccaacttgcacagcttagccgagatgcatctgctgctggtgctgctcgccgcgtatctgcgcaaaggcagaatgtggaagtagagtcggttggggctgttaaatccgatacaaataaagtgaaaaagtactttcgactggagtttataaataaagaacaggaagaagcagaagaggatttggatttcaaggcccttgacaacggatttgttgcagtaactcccttctcactttgtcctcaaattgaggtggacattcaaaccgctgcatcagattggatctccggtgcacttcaggtggagcaatagaaccctgggaaggccaacaaaaaaaatcttaaatcaatcaatttgtatacatccgcaggaggcattacatttagtcaggtaccttt

SEQ ID NO: 621 - DNA, 2048 bp, Gossypium hirsutum
aaagtcgacgctgaggatcaaacagattgtgtttttggttaacgagtgattttgcttgatcgagtgattgtttgctgttagaagacgaaggtgttactagtattatcaacgaattctatcgaaaatcgagcgctttattgataagtggggttcggtttagatgcaaacgtctcagaaacaccaaactcgggtcaatatccacagattgtatcaccaacctgctaaggatgttgatcaattttgcttgcctcatattcagatattagagaacaatgcatgttcggatgtcggcagtcaaggacccagtgtgtcctatcaagcctacaaggaccagatttttactctggaatcatccacggcgactgctagtttcgttgcttatgattccccttctgctataagtgtctcgtcgagcaggagtcctttctccccacaaggttcccaatcgtggatgtctgatcctcatcattcccccgacaatacacatggatcaccgttcagtggatcttctgttgttgatgatagcaacggattgaagcacaagttacgagagctggaagtctcgttgttggggcctgaatcggatattatagacagctgcaattgttgctttactagtggagctcaccaagctgcttcaatggcaggcttgaaccacgagcaactggtggacatgattcctagattagacttgaaggaggtgcttattgcttgtggtcaagcgctttacgacaatgacatgtcgagagtggcaggtttaatgcatgtattggagaaaatggtttcagtatgtggggaaccactccaacgattgggcgcttatgttcttgaagggcttagagcgaggttggaatcatcggggagtaatatctacaaagccttaaaatgtcaagaacctacaagctcggaactaatgtcttacatgcatattctctttcgaatctgcccgtactacaagtttgcatacacatcagctaatgctgtcatcaaggaagtcatggaatacgagcagagaattcatatcattgatttccaaatagcacagggtacccaatggatgtaccttattgcagctctttcaaaacgccctggtgggcccccatttatccgtgtaactggtattgatgattctcagtcaaatcatgctcgaggcgggggacttagtattgtggggcagaaactatcagaatttgctaagtcgtacaatgtgccattcgagtttcatgatactagcgtgtctacttccgagattcaagtacagaatctcaacatttgtcccggggaagccctagccgtgaatttcccttatgtattgcatcacatgccagacgagagcgtaaccatctcgaaccacagagaccgattgttgagattggtgaagagtttgtcccccaaagttgtcacacttgttgagcaagagtctaacaccaacacatccccctttttttctcggtacatcgagacacttgattattacacagctatgttcgaatccatagacgtagcttgtccaagagatgacaagcaaaggatcagtgcggaacagcattgcgtggctcgggatattgtgaatatgattgcttgtgaagggcaagaaagggtggaaagacacgaacttctcggaaaatggaggtcgagatttatgatggccggcttttctccatatccgttgagttctttggtcacactagcggtacgagatatgttaaaagaatataacaacaactatagacttgtagagagagaagggtctctctatctagggtggataaacagagccatggcaacctcttctgcatggaggtgaaaaaagcatggaggaatctgtaaattctacccaaatacccttttttttcttcttaatttatagcatcaacctttagtgtgtgtgctgtaaatttatagaaaaatatgagcttagctttgtgttgtttttttaggcaaagggactgaattgcaaaaatcacagtgtacatttcttatgaaacagctttgagcagattttagtcactttgtggacattggctcacatcaatcagggatccttt

SEQ ID NO: 622 - DNA, 683 bp, Gossypium hirsutum
tgtcagaaaccatggccatctctcatgttccatattacttgtcaaaattgccttctccattgttcaattgccgtttggcggccaagagaatctcagaattttccatggagaatccgcaacaccctgaaggcaaagaagcatgtgaatccaatccaaccaacgtgaagcgtgtatccgatgatataatgcctcaccttcttaacttatatggatctcgtgtcacaccacgcgactttgaaatatacgccgcggacgcttcttttgaagaccctctcatgtgtgctcatggagtgaaacaaatcaaatcatcattttattcactttctaaggtttttagtgaatcaagaatcgttgaatatagcatcaacgaaaaagaaatttcagctggaaagcatgagatattagttgacaacaaacaacaatacaagttcttgggaagaaacatagatatgatatcattgatcaggttgtttgtcaaggacggaaaggttgttcgtcacgaagattggtgggataagaagcctcttcggaatagagaaacagttaagcttccatgtgtcggccgaatgattgaactgactcgcaggggttcgatgttcgtaactcatgctttaatggggttcggaaaggatcctcctaccggatgatgctacaagtcgactgtatgcaagtctgtctcggtg

SEQ ID NO: 623 - DNA, 752 bp, Gossypium hirsutum
atttagcgagtcaaagacgtggcaaatgggattctgaaggtaaaaaaatccttaggcaactcagtgaagaaattattgagatttgagatcaaacatcacatagatttcagagattttcaatggcagccgaagaaggcaaaacagcagatgcacagtttttccacctcctttccaatctactccatcaggtagaagcattgactaaccaggaagaagttgaactgcgttcgaaaatcgaagcccttggattggaggttacaaaagttccttccatgtctacacacagccttgatgagctggaaattgcgagagagttggacaagttatcggctaagttagacggtgtggatgagatgatatcctcagccatggcagcagacccgcaggtgcgatcccttttgagtggcactgctgatttatggatgccggttattactgccaatgctgatgagcgacacaatttggctgcatcaatcagtactgataataacccgcttggcaacaatgaagacgacatcaaacccgacaattgatgtttcaccggtcagtcacctccgccatactttgttctaatactaatttgttttcgggtttttggggatatgtcatatgactagaatataccattgcattaatcattttgttttgtctattggggaacaaaaagtaagtttcttattctgttgtatccgtagttacattgggtctcattattttaaactcgaattgggttagacgcaagacggagaaag

SEQ ID NO: 624 - DNA, 1289 bp, Medicago truncatula
caatcatggagatggaacgcatggctgaattctctcgcaattacatggatcgcccaccgagaaagagagcgcgattgggttgggacatccctgaaacccctaaggctcaggtaggattgttttgtggacaagaggttgagaatatttcaagctatgctccttcagaacataatatcactagttctctgtttaagggagttgctcgaaatggttctcccccatggcgagatgacgacaaagatggccattacatgtttgagcttggagataatttaacttctcgctatagagtccacggaaaaatgggtgaaggaacatttggacaggttttggagtgctgggacagagaaaggaaggagatggttgccattaaagttgttcgtgcgataaagaagtatcgagaggcagccatgattgaaattgaaatgctgcagcaacttgggaaacatgataaaggtggcaatcgttgtgtgcaaatacggaactggtttgactatcgtaatcatatctgtattgtgtttgagaaacttggaccaagcttatacgattttcttcggaaaaacaattatcgttcatttcccattgatcttgttcgcgagattggaagacaactattggaatgtgttgcattcatgcatgacttacacatgatccatactgatctgaagcctgaaaacattcttctggtttcatcagagtatcttaaaatccccgactacaagagttcatccagagcaccgtgctccttttacaaaagagtgcccaagtcaagtgccataaaagttattgattttggaagcactacttatgaacgagaaaaccagaattacattgtatcaacacgtcattatagggcacctgaagttatccttggacttgggtggagctatccatgcgatgtttggagtgtgggttgtatattagtcgaattatgcactggtgaagctctgtttcagactcacgaaaatttagagcatcttgccatgatggagagggtgcttggtcttttaccacagcagttgttgaagagagttgaccgacatgctgagaagtatgtccgaagggggagattggactggccagagggtgcaaattccagggagagtattaaagctgtaatgaagcttcctcgactgcagaaccttataatgcagcatgttgatcattctgctggagatcttatacatcttttacaggggctacttagatatgacccatttgaaagagttacagctagagatgctctgagacatccattctttatgagagatcaccttaggagatgataa

SEQ ID NO: 625 - DNA, 3548 bp, Medicago truncatula
tctcatgttcggtctttgaagcaaagatctagttcagtgttgcagattttagtgtggtgaagatgtcatctctgagtagggaattggtgttcttgatcttgcagtttctggatgaggaaaagttcaaagagactgttcacaagcttgagcaggagtcaggatttttctttaacatgaaatattttgaggatgaagttcataatgggaattgggatgaagttgaaaagtacttatctggtttcacaaaagtagatgataataggtattctatgaagatattttttgagataaggaagcaaaagtatcttgaggcattggataagcatgatcggtcgaaagctgtagagatattagtgaaggatttgaaagtgtttgccacgtttaatgaagaattgttcaaggaaatcacacaactattgacattggagaattttagggaaaatgaacagttgtcaaagtatggtgatactaagtctgcacgggcaatcatgttggttgagcttaaaaagctcattgaagctaatccgttatttcgcgacaaattgcaatttcctaaccttaaaaactcgaggttaaggacactcatcaatcaaagcttgaattggcagcatcaactatgtaagaatccacgtccaaatcctgatataaaaactctttttgtggatcactcatgtggacaaccaaatggtgcacgtgctccttcacctgctaacagtccgttattaggatccttaccgaaggctggtggatttcctcctcttggtgctcatgggccttttcaacctaatccggcagcagtgccaacacagcttgctggttggatgtcaaatcctaccactgtagcacatgctgcagtttctggtgctggagctataggtcttggtgctccatcaatgcctggtgctttgaagcatccacggactcctccaattaatccgtctgtcgactatccatccggtgattcagatcatgttgccaagagaacaaggccaatgggaataacagatgaggtaaatctacctgtcaatgtgttgtcgggaacattcccaggtcatggacatagtcaggcttttaacgcacctgatgacttgccattgccgaagactgtcatgcgaactctgaatcagggctcatctcctatgagcatggactttcatccagttcaacaatctttactgctagttggcacaaatgtgggggacattgccttatgggaagtgggttctagggagaagttggtctcaaggaacttcaaagtttgggatcttagtgcatgttcaatgccatttcaggctgctcttgtcaaagatccaagtgtttctgttaaccgtgtgatttggagtcccgatggtgctttatttggtgttgcatactcgaggcacattgttcagatatactcttaccataatggtgatgatgttcggcagcacttagagatcgatgctcatgttggtggagtaaatgatcttgcattttcccatccaaataagcaactgtgtgttataacctgtggtgatgataagaccattaaggtgtgggatgctgtatcgggaacaaagcaatatacatttgaaggtcacgaggctccggtttattctgtctgtccgcattataaagaaaacattcagttcatcttttcaacagcgctagacggcaaaataaaagcatggttgtatgacaatttgggatcacgtgttgattatgatgctcctggtcgatggtgcacaaccatggcttatagtgctgatggtacaaggctattttcatgtggaacaagcaaagatggagaatcatctattgtggagtggaatgaaagtgaaggagctgtgaaaaggacttaccaaggatttcgtaaacgatctatgggcgttgtgcagtttgatactaccaaaaatcgttttttggctgccggcgatgatttctccattaagttctgggatatggacaatattcaacttttgactacagttgatgctgatgggggtctacctgcaagtccacgtattcgtttcaacaaggatggaactcttttagccgtttcagcaaatgataatggaatcaaaattgtagccaatgctgatggtattcgtttattgcgtacattagagaataattctatgtatgatgcatcaagagcagcagagttggcaaagcctacaataaactcaatgtcttctgctgccgccgcaactagtgctgcactagctgagagagcctcatctgtagcagctattgctggaatgaatggagatactcgaagcatgggcgatgttaaacctagaataagtgaagaagccaatgacaagtcaaagatatggaaactcactgaaatcaatgaaccatctcattgtagatccttgaagctaccagagaatgttagagtaaacaagatatcgaggttgatttatacaaattcaggtaatgctattctagcattggcatcaaatgccattcaccttctctggaaatggccgcgaaatgatcgtaactcatctggcaaggccaatgcttccgtgccagctcagttgtggcaaccatcgagtggcatcctgatgactaatgacatcgctgatagcaatcctgaagattctgttccgtgctttgctctctccaaaaatgattcgtatgtaatgtcggcatcaggagggaagatatccttgttcaacatgatgacttttaagacgatgacaactttcatgcctccgccacctgcggctacttttcttgctttccatcctcaggataacaatattattgctataggcatggatgattcctctattcagatatataatgtccgtgttgatgaggttaaaagtaaactcaagggtcatacaaaaagaataaccggtcttgctttctctcatgtattgaatgttcttgtttcatctggagcggatgctcagatttgtgtgtggaacactgacggatgggaaaaacagaagactagattcttgcagctacctcccgggaggactccatcagcacagtcagatacacgtgtacagtttcatcaggatcagatacagttcttggtcgtacacgaaactcagcttgccatttttgaagcaactaaattagaatgtctaaagcagtgggccccacgggattcttctgcaccaatatcgcatgcaacgttttcgtgtgacagccagctgatatatgcaagctttttagacgcaacagtctgtgtatttaatgcttcaaatctcagactgcggtgtcgtatcaatcctcctgcttatcttcctgcaagtgtcagcaattcaaacgtacaaccactagtaattgcagcacatccacatgaagcaaatcagtttgctgtaggactatcagatggtggagttcatgtgttcgagccactcgaatccgaaggcaaatggggcgtgccacctccaaacgagaacggatcatctagcaataatgtagcagtagctacttcagttggactttcttcagaccaagcacaaagatgaaatgataaaatgaatccattttcagccaaaagacaagtttcttttacatacttggcttgttggtcattttag

SEQ ID NO: 626 - DNA, 455 bp, Medicago truncatula
tagtcatggctagcagcagcatggcatcagcagctactggatttttgttgtcacttaatgttgctgccaacagcacaacctcttcagcttcttcaaggagtaccatgttgatgttccctttaaagtccaacaatattggttcttcttcttctagacttgttgtcagggcaaccgatgaggctgccccggctgcacctgctgcccccgctgctccagctgctgatgcagctcctactcctaaacccaagccaccaccaattggccccaagagaggttctaaggtgaagattcttaggaaggaatcctactggtacaaaggcactggatcagttgttgctgttgatcaagaccccaagactcgctaccctgtcgtggttcgattccagaaagtgaactacgccaatgtatcgacaaataactatgctttggatgagattgaagaagttgtttaataa

SEQ ID NO: 627 - DNA, 1208 bp, Medicago truncatula
tcgaaatggctattttctctgcaaccctaggttcctttggtgccatttccttcctctcatcttcacaatcacaacaacacgatccttcttcttcttccatcgtcaatcctttcaatttccctaaatgccctcacaagttaccaccaccttgccaatggcatcctcactatcgtcatcacaatcctaaaatcatggtatctagtagtagtagcagtaacaatactcatattgatgaattcgacagcggtcttcttcaacgcccttctgctcctgactcttatgatgctcttcgtcaagccaggagatcgtcagattggaaggctgcaaacgcatatagagacagtggactcatttacaatggtagggttgagggttttaatgctggaggcctgctggttcggttttactctatcatgggctttctcccgtacccacagctgagccccgtgcattcatgccaagaaccagatcaaactatcaaagaacgcgcaagagagttgatcggtgccatcttatcagtgaaggtaattatagtagacgaggagaaacggaaattggtcttatctgaaaaggaagcttcatggtttaaacattcaaaacatatcaacataggggacctttttgaaggaagagtcggttctgttgaggactatggggcttttgttcatctgcgcttccctgacggtctttatcaccttaccggactaatacatatctcagaagtgtcgtgggatctagttcaagatgtaagagacttcttaagagaaggtgaagaagtgagggtcaaagttatcagtattgatactgtaaaaatgaggcttacactgtcaattaaacagctagaagaagatccactgctagaaactctggacaaagtaatacgtcaggatggttcaggtgttcccaattctatcagcagtactactagcagtcccatcgatcccctaccggggctggatacaatacttgaagagctattgcaggaagatggcataaacgaggcaagaatcagccgtcaggggtttgaaaaacgagtggtctcacaagacttgcagctttggctttctaatgcacctccgatggaccaaaggtttactctccttgctcgagctggaagacaggttcaggagatacatctgaaaacttcccttgaccaggaaggtataaaaaaggcaatacaacgagtattggagcgtgttccttgataa

SEQ ID NO: 628 - DNA, 1091 bp, Medicago truncatula
aaagcatgaatactctctccctccacttctacaccccccactccttcctctccctcaaaccaaaaccccaacctcgtatccaatgttgttctaccaacaacaacataatcgacgacatcgacatggtaaaaaccaaacaaggaacctacgaacaaaaacagaacaaagtctgtgtcctctgggacctcgacaacaaaccaccacgcggaccaccctacaacgccgccgtatctctcaaaaacctcgccgaacgtttcggcgacgtaaccgacatctccgcttacgccaaccgccacgctttcattcatctccctcaatgggttctcaaccaacgccgtgaacgtaaaaacctcgacatcctcgaacgcaaaggtatcatcaatccacctgaaccgtatgtatgttctgtctgtggtagaaaatgtaaaactaacgtagatcttaagaaacacttcaaacagcttcatcaacgtgagagacagaagaagctgaaccgtttgaattctttgaaggggaagaagaggcagaagtataaggagaggtttgtgagtggtgatgacaagtataatgatgctgttagggagattttgaaaccgaaagttgggtatggtttggcttcggagttgaggagagcgggggtgtttgtgaagactgtggaggataaaccacaggctgctgattgggctttgaagaagcagatgatgcactctatgagtagagggattgattggttgtttttggtttccgatgattccgattttagtgagatgttgaggaaggctagagaggctaatttaggtactgttgttgttggggatgttgatagggctttagggaggcatgctgatttgtgggtgccgtggaatgctgttgagaatggtgaggttatggatatggatttgattcctaggaatagagatagaagaagaacaaattcaacatccacaacaatggatgattttggtgatgtgttgttttttcacgagggcgaggaaatggaagacgattttatgttggagtatagtgatgatgacgattttgatgaggattctgatgaagaagatgaagatggattttatatttattgataa

SEQ ID NO: 629 - DNA, 1878 bp, Medicago truncatula
gatacaatggtggaggaagctccgccttcttcgctgatttctctctgtatcgatcatctcgctaaccaactcctcttcggggaagatgaagttattgctattattccagttatatatgaacttccatcacatttgcttgatgatttgatttcacgtttaactcctcatgcattgtatcatttccaccttcacacgccatttcaggatgtaaatgaggaagatttttcgcgtgatgactcaacgaacaacaagagaaaacgttccagggattggaatctaaatacagcctggcagaagttgtttgagttgcggtggcctgatctcattaatcagattcaaccaaccgactggcagaaagcatattgggaagcccatttgcaaaactgtctggatgaagcagcagagatagcactaatttcaccctttaaaggacgtcttgctgacataaatatttcagagagcatactgcgccatattggttttgtgagacttgcagagcatgaatacgatatatattcaaaactctcttatcattgcctacaatttggaagccatgtgagttgtctgagactgcagaatattctgtgctctgcagaaactactcgtttattgagagaatgcaagctgcagagtatggtggtaagatgtatccgatctgtggaacaagttaatggattatgcagactgatcactcaacatagcaggacattaacgtcgctggagtttattcactgcacactctacgaaaattttcttaatacactacttgattctgtcgtcagaaagagcgtacataaatatgcgctccaaaaacacgggcttcaacacctctcaatcgtctcctcaagtttcggacaatgcactggttctttacctactgggcttcaatcactcttgtcttcagcaaggtccatgtgctcattaaagctatgtggtagtcgccttggacggaattttgcaaaagctctttttgtgactcttctcagtgtttcctcatgcatatctgttcttgacctttctgagaatgaaatatcgggatgcctttctcactttaacaggagactaccaagtgatttacgtgagtcacatgttggaattggagagtccttgcaactcttgcgtgtactcaacctgagggggaacaatctacggaaagatgatgcagaaaatcttggatatgcttttgcatacatgcctaacttggaggacctagatataagtgacaatccaattgaggatgaaggactcaggtatttgatcccatatttcgctggaacatctgaaatgtgctcccgcctggcttgtttgaaattagaggcttgtgacctgtcctgtggtggagttaaccatctactagattcccttcccgtcctcaacggaacattgaagtctctttccattgctgaaaattgccttggaagcaaagtagcaggacctttaggaaggtttttgagcacacctatcgaagtacttgatgcatcaggcattgatttgcttccatctggttttctagagcttcaaaatatgctgacaatagaggaggagcttagtttggtgacaattaatataagcaaaaaccgtggtgggattcaaactgctaggtttttgtcaaaactcttgccacaggctccacgacttgttgacgtgaatgcagcaagtaattgtatgcctattgaatcactgtccatcatctcctctgcattaaagtttgcaaaagctgcaggtaatgttctgaatttggacttgacgggacatgagtgggattatacgccagagcttacttccctttgcactgaatttgtacataatggaaagcctatattgatgcttccagtatcatcggccactgctgctcctattgatcatgatccttagtaa

SEQ ID NO: 630 - DNA, 1124 bp, Medicago truncatula
acgcaatggtgttgttttgtgtgaatcgtatttcgcatcattttcgagactgtgaacttctccattttggtgttggtttcagatttcatagttttcatctttctttcccacgctctctaaaaccctgtctccctggtaatgctatctccgttaccaatagaagcaacgaaaacaaatgctattcttctaagtattctggaggagcaggagaaattccccttcttttcgattcttctttcagccaacaagaagatgatcgtgaaattatatccgacgggatatctgcagttgcaggtggaattgtggcgctgggaaagtttgatgctctgcacatagggcatcgagaacttgcaattcaagcatcaagggctggacctccatttcttttatcatttgttggcatggcaaaagtatttggttgggaacatagagctcccatagtcgctaaatgtgatcgaaagcgcgttctttcatcttggtttccttattgtggtaacatggtcccagaagagtttgagattgagttttcaagcgtgcggcatctcagtccgcgacaatttgttgagaagttagcaaaagagcttagagtgcgtggagttgttgcaggtgagaactaccggtttggatataaagcagctggtgatgcatcagaattacaaaagctatgcgaggagtatgaaatggaagcttacataataaaatctgttatggacaagaaccaatactcaacaaatataaattccagtattggctccaaagagaggggtcaggtctcgtcaacccgtgtccgcgaagcgcttgctgtaggagacatgagatatgtctcagagcttttgggtagacaacatcgtcttgtattaatggccacagatcgagaaacgttcagctttagccagtataaggtgtctgctcctaaatcatgcttattgaatctagcaccaaaggaaggtctatatgagaagtgttcacttttacttggtcaagaaaatgttatgctatgtagggtaattattgacagcaagtttgtccatatagaaacagattacggcggttcgagtgatatttttggtactcacgatttgcagtacttgcttattgaatttggtgattccagtacttgataa

SEQ ID NO: 631 - DNA, 1447 bp, Oryza sativa
gctagaagaagaagcagccatccgagtcgtcatcggcggcggcggcggcggcggcgaggcgatgggggtggtgggggcgttgctgggaccggaggcggaggcgctggtgaggctgcgggcggcggcgtggcggctgcggagggaggtcgccgccgccaccgacgacgacgagcactgggccttcgcctactccatgctgcaccgcgtctcccgcagcttcgccatcgtcatccagcagctcggccccgacctccgcaatgccgtgtgcgtcttctacctcgtgcttcgggcgctcgacaccgtcgaagatgatactagcatccctactgagattaaggtgcccattcttcaggaattccaccgtcatatctataaccgggattggcatttctcatgtggaacaaaggactgcaagattctgatggataaattccactatgttttgacagctttcttggagcttggttcaggataccaagaggcaattgaagaaattaccaggagaatgggtgcaggaatggcaaagtttatatgcaaggaggttgaaactgttgatgattatgatgagtactgtcactatgtggcagggctagtcggcattggactttcaaggctctttcatgctgctgggttagaagatcttgctcccgaatcgctttctaattcaatgggtttatttttgcagaaagtcaatattactcgggattacctggaggacataaatgagataccaaaatcacgcatgttctggccacgagaaatatggagtaaatatgttgacaaacttgaggatctcaaatacgaaaataattcagtgaaggcagtaaaatgcttgaatgagatggtgactaatggtttaatacatactgaagattgccttcggtatatgtctgctctaaaggatattactattctccgtttttgtgcaataccccaggtaatggcacttgcaacctatgctctgtgctataacaatgtgaatgtatttcgaggagttgtgaagttgaggcgtgggctgactgcacgaataatcaatgaaacaaattctatggctgatgtgtacactgctttctatgaattctcttcactgcttgcagaaaagattgatgataatgatccaaatgcgtcgcttacacggaaacgtgtgaatgcaataaaggagacctgcaaatcatccggtttgctgaagataaggggatatgacttggataggccaaaaaggaaccctgctatgatcatgatgctactgctgctcttggtagctattttcttgggagctctgtataggaggtgatcgatcctctgtaatgaccacctacgtacctttctattcaacaatcttataacctatattgtttcagcccatgagaccaccataaacatatttttgtatcagtactgttgtataagtggaagactaacgttagatgttgtgctggttgcttag

SEQ ID NO: 632 - DNA, 1180 bp, Oryza sativa
aaaggatccatcgtcatcatctcgtcccccctcttcccggcgcggcggttgctctccagccatggccgccgccgccgccgccgccgtcgcctgcggcatgtctacgtccttcctcatccgcctctcgccttcgccgccggcgtcttcccacgtgcctctccctcggtctccggcttcgtcggcgcgcccgcggcgagcgtcttccgtctccctctccaccgcgcctaggccgagggcacgcgccgccggctccgactctccctccaactttggaggtcaaacatcactgatgccaccattcagccttatgcttgatgaaggctctagatctaaaaagccatatagatggcaaagggtgttgcttaaagtaagtggggaggctcttgctggagatcacacagaaaatattgatccaaagatcacgatggcaattgcaagagaggttgcttctgtcaccagactaggtgtagaggttgctattgttgttggtggcggcaatatcttccgcggggcctcttgggctggatgtagtggactcgaccgctcatcagcagattacattggcatgttggctactgtgatgaatgccatatttcttcaagcaacaatggagagcattggaataccaacccgtgtccaaactgcatttcgtatgtcagaagttgcagaaccatacatacgccgaagagctgtcaggcatttagagaaaggaagagttgttatatttgctgctggtacagggaacccattctttacaactgatacagctgctgctcttcgttgtgcagaaatcaatgcagaggtagtacttaaggcaacaaatgttgacggtgtgtacgacgcagaccccaagcgtaacccaaatgcccgccttcttgaggctgtgagctaccatgaggtgcaaacaagagacctctcagtaatggacatgactgccattacgctatgccaagaaaacaacattcctgttgtcgtgtttaatttgcaaaaacctggaaatattgcgaaagctattgttggtgagaaggttggcacgtttataggctgcacaaaagatcaggaccagattgtggggaatgcactggatcaagaaagaagattggtgaacgagttatgatttcactggagctctctgtcgctagctgtgtagctgcattgcctattgcttggtggtaccttt

SEQ ID NO: 633 - DNA, 1103 bp, Glycine max
cacgtaacaccacacccttcttttcttactcttactcttatgcttttcaccttcttcacttcactaccctttacccttctctgtgacacacactctttctgcttcacgttttcaatggcttcatgtagtatagggaccccaaatattaaagtattgaacttgcactttggtggaaaaaaagttggcctctcacgacaatttggtacaagaagctggatcagtaggctgcagtatactagtttggttatgtcacgacagacagttaggtttttagcatcatccaatggcccatcgacagagatccaatttgctgcaaggtcagaaggttctgaagagattagatcttcaggtctgacaagtgagcttattcctaatattaatgaggtggagttcctgctcacaaaattatgcgacacaagttcaattggggagttagatttaaaacttgctggatttcacctgcatgtagtgagggatttgactgaaaaaactaaaactctacctcctctgattcctgcttctgtaagtataattaatgtcacagaaacacctaaaacaaatggatcagttcctacaacttcgttggctgtctcgaagccagtagacccagtaccttcttcagggtccatccagagattcctagacaaagctgctgatgaaggcttggtaataattcagtctccaaaggtgggtttctttaggagatcacggacgataaaggggaagcgtgctccaccatcatgtaaagagaagcaaaatgttgaggaggggcaagtgatttgttatattgaacagcttggtggtgagctgccaattgagtccgatgtgtcgggagaggtcatcaagatactacgacaggatggcgaccctgttggatatggtgatgcacttgttgcaatattgccatcatttcctggaataaagaagcttcaataactcgaatttatggaaaagagacattcttgccagccatgcagtaattgagtcatacatatatttcattatttttgagttcccgtggtccataggttatttgtttttagtattagttttgcgtagcaaagacaaatttgttttctcatactttcctgtttgtgttggtg

SEQ ID NO: 634 - DNA, 2629 bp, Glycine max
ttgcgcggagcttcttcattcagctcgagagagagccatggcgaacgaagacttgggtagttggactgatctgctacattcctctacgaagcttctcgaacaagctgctccttctgctcagttccctccacttcagaggaacttagatcaattggaagcgttatccaagaagcttaaatccaagaccataaggactgaagcaccttctcaatctattgctgcaacaaggctccttgctcgtgaggggataaatgcagagcagcttgcaagggatctgaagtcatttgaactgaagacaacttttgaggatgtttttcctgttgaagcaacaagcgttgaagagtatctgcagcaggttcatgaaatggcaatggtctctgctgtccaggaagctcagaaggataatctcaggagtttcaatgattatatgatgaaagtattagaggaggattggcaaaaagaaaaacgtgatttccttcagagtttaagtcgaatttcaacattacctaggacaaacattgctgctaacagcaacgtgggtaccctcccgggtcagcttgcatttgtgtcttctacttcacaagtctcttctggtatgcctagcatggagattgttcctctgactggcagacctattgtggagaaaaaggcatctgtctatgctgaggtagtgaaaaaactgaataaagcaagggagtctgggtcaccatttaaacctgctgcagctttcaaaggtgcatatgaaaatttgggcattgatgctagtggtggaaagtcagtaacgatgcgaaagatatggcaccttgttcagatgctgatgggtgaggaatcagccgtgcaacgtgtttcaaaaaggatgtcattgattattggtgcaagacgccaccttgaatggggacatgagaaatacatcatggataccatacaaagtcatcctgcacaagctgctcttggtggtggtgttgggaatttgcaaagaatccgtgccttccttcggattcggttgagggattatggtgtactggattttgatgctggcgatgctcggcggcagcctcctgttgataccacatggcagcagatatatttttgcctgaggtctggttattacgatgaagcaagaaatgttgcccaatcttcacgtgcttcacatcaatttgctcctttgctgacagagtggattaataaaggagggatggtaccagaagagattgcagctgctgcatctgaggaatgtgaaagaatgttgagaactggtgaccgggtaggtcgaactgcatatgacaagaaaaagttacttctatatgccatcatatcaggttctcgaaggcatatcgatcgcctgcttagagatcagccaagtctctttagtacaatagaggatttcttgtggttcaaattgtcagctgtgcgggattgccctagtggaccttcatccattgttctaagtgatggtctgattccatacagtttggatgatttgcaaagttacctgaataaatttgagccctcatactatacaaaaaatggaaaagatcctttggtatatccctatatcttgctgttaagcattcaattgcttccagctgtattatacttgtctaaggaagcaggagatgaaggatataacattgatgctgcccacctttcaattgtgctagctgatcatggggtcctttctgaaggtgctggttctgggcaaaagttgggagtgatggatgcttatgcggaagtgtccaccattatcaggcagtatggatctatgtatttgcgtcttggtgatctccaaatggccctagaatactacgcacaagctgctgctgcagtgggtggggggcaattgtcgtggactggtagaggtaacgttgatcaacaaaggcagagaaatttgatgctgaagcagcttctaactgaactattgttaagggatggaggcatatatcttctacttggtgcaagaggtgcgggtgaagaaggtgaattgggacgttttgtgactgatccgaaagcaaggcaactatttttaattgaagctgcatgccactgtcaggaggctggaatgtatgacaagtctatagaaattcagaagagagtgggttccttctcaacggcactggataccatcaataagtgcctgtctgaagctatttgtgcccttttccgtggaagattagatggcgagagccggactgctggcctcatccattctggcaatgagattttggagacatacacttattacccagatgccagtcttcaagagagagaacatgttttggaacagcaaactgtgttacgacaacttgagtcaatattgtctattcacaaattagtaaggcttggacattatgttgatgcattaagggaggttgctaaacttccatttattcctttagacccccgaggccctgacattgctgttgatgtgcttgaaaatttatctcctcatgtccaagcttgtattccagatcttttgaaggctgctctcacttgtctggacaatgtgacagactctgacggatctcttcgtgccttgagggctaagattgcgagtttcattgcaaataatttaaagaggaattggcctcgtgatttatatgagagcgttgcgcagaggctgtgaaattaa

SEQ ID NO: 635 - DNA, 1982 bp, Glycine max
acaaaatggaagacacagtttctgcgttgaggtctttgatggtttctcactctccgccgctggatgccttagtggtgccctctgaagattatcacctgagcgaatatgtgtctgcacgagacaagcgccgcgaattcgtttccggcttcactggaagtgccggcttggcacttataacaaagaaagaagcactgctgtggacggatggacggtattttttgcaggctgagaaagaacttagtgctgggtggaagctaatgcgaattggtgaagatcctgctgtagatatctggatggccgataatttgccaaaagaagcatccgttggggttgatccctggtgcatttcaattgatactgctcaaagatgggagcgtgcttttgccgaaaaacagcagaagctggttccaacctcaaaaaatttggtggatgaagtttggataaatcgcccaccggcagagataaatgctgttattgtacatcctgtgaaatttgcaggtcgctctgttgcagataagttgaaagatttgagaaaaaagcttgtacatgagcaaacccgtgggattattttcacagcacttgatgaagttgcatggttgtataatattcgtggaagtgatgtggcctactgtcctgttgttcatgcatttgctattgtgacatccaattctgctttcatttatgtggacaaacaaaaggtttctgttgaggtacaaactcatttagtggagaatggaattgaaattcaagagtatacagccgtaagctctgatgcgacattgcttgcaactgatgagctagatgctgtatctactgccaaggctgctttagccgaaacagaggccagaaaaattcccagtgaaattgataagagtgtaaatggtgaacatcaagcagaagaaaatagtaatgacctcatatgggctgatccagtttcatgctgttatgcactgtatgcaaagttgaaccccgatacagttctcttgcagcaatcacctttagcccttgcaaaagctttaaagaactcggtggagttggatgggttaaaaaaggcacatattcgggatggtgcagcagttgtgcaatatcttgtctggctggataagaagatgcaggatatttatggagcttctggttactttttggagaaggattctgtgaaaaaggagaaacatttgcaatctttgaaattgactgaggtgactgtaagtgaccagcttgaaggttttcgagcatcaaaagagcatttcaaaggattgagtttccccactatttcttcagttggctcaaatgcagctataattcactattttccaaaggcagaaacatgtgctgaacttgatccagacaaaatttatctttttgattctggagcccagtatctagatggaacaacagatattacacgaacagttcattttggtaaaccttcgactcacgaaaaagcgtgttatacagcagtcctaaagggtcacattgctcttggaaatgctagatttcccaatgggacaaatgggcattctcttgatattcttgcccgaattcctttgtggaaggatggtcttgattatcgacatggtactggtcatggaattgggtcctatctgaatgttcatgaaggacctcacttaatcagtttcagacctcaggctcgaaatgtaccattgcaatcttcaatgactgttacagatgaacctggttactatgaggatggagagtttgggataagattggagaatgtgcttattgtcaaggaggctgatacaactttcaattttggtgatagaggttacttatcttttgaacacattacctgggcaccatatcagacgaagttgattgacctgaaccttctaagtcccgaggagataaattggctgaactcctatcacgccacatgtaggaatattctggcgccatatttggatgaagttgaaaatgcatggctgaagaaagccactgaacctgtaggtgcatgatga

SEQ ID NO: 636 - DNA, 929 bp, Glycine max
aaaggatccgctaaatcagcattgcttgctcgaacgtcagtcagattcaacagataatataatgcagactcaggaatattttctcccggataagatggtacttcctttggcagatgaggccattgatcctcatatgcgtgctccacttgcttctgcctttgatgcatatttacctccaggtgtgaggcagataacacccttcgaaagatttaatgtgcaaccctctgaggcttgccccaagaactttgttatctttgatcaaacagatcaacgaagcaggatcatgttccatcctgcaatgacctacaaatttaacagtcctggcttaaatgttcatgctactggttctcaagattttgagaaaaataaagccaatcaaatggaaagagaagtgtcatctccttttgaagaagatcctaatgacattgacgcattgttgagcataggagtggatgaactagatgactttgacgaggaagaagtcagcacagcaaggactcaagaaaattatgaaagtttatccgatacttgctccagttattgctcaaaatcaaggaagaggtcatcgtcatcttctgtacagaagtcgtctggggccgggggtttctgccacaatgaagggaagcactgggagatgaagaggatggtgaggatgttgagaaagattgtgccaggtggaggtaatcaaatggattctgttgctgttttagatgaagctgtaaaatacctcaagtctctcaaagttgaggttgaacaattcggggttgaaccatgaaaaatgtaagttggtcatatgctgctgcaacagttgactatttccccaactttgtttgttagcttctatgaatagcaccctttctcgcctcgctcaccatcctagttataacttttatgagaagaggccatgctacctgagtaatggtaccttt

SEQ ID NO: 637 - DNA, 1059 bp, Glycine max
aaaggatcccgcttcgtcatttcctattctcagcttccaattctcctcctccttcttctaattctacttcttttcgagggttttcgttcctctgtgcctgattgatccctaattcgataccatgcggaagaagctcgatacccgtttccccgctgctcggataaagaagataatgcaagcagatgaggatgtcggaaagatagcgttggcagttcctgttttagtttctaaagctctggagttatttttgcaagatctttgtgaccgcacttatgaagtaaccctacagagaggagcaaagaccatgaattcattgcatttgaaacattgtgtacaaagttatagtgtttttgactttctaagagacattgtcagcagagttcctgactatgggcatggccatggccatggccattcagaggctggagctgatgatcgtgcacttccaaagagaaggaaagctgttggtgacgacggcaatgacagtgatgaagaggctaagaggagtaagatgcgtgaactgggccacactggcactcctggtaggggaagaggccgaggtagaggaagaggccgtggccgaggggctcgaactattgaaagagatatctgtcatcagcaggttgaatccgagccttgcacctctattctgcaaagtagcaatgatattcctaacactagtgtgccaatagataatggtctacaatccaaggagttaccaaaggagaactttgtgatttctgaggaaagtactcaatctttccgcaacattgatctgaatgctaacttaaatgaaaacgaagacaaaaatgctggcacagctgttccggcttcattgcctgagcccacttccatggacactgccatggagattaaacatgaagaaattccaggctggtccctatctgatgtggacaagatgggcattgacactatgcagcttgcaaacctaggtagtcgactagaagaggacgaagaagattatgacgaggaagggtaaataacatacactttgggggattaactctgctggaagctcatggtaacagtggtaccttt

SEQ ID NO: 638 - DNA, 3248 bp, Glycine max
ccaaaatggagtgtttgaaatcccccttcctcttctccacttcacttctccctccaccttctcatcaaccctactccattacgccaaacataaagaacaagaagaataagaaacctcgagttcccatcttcattcgctgcaccatccagcgcgacccgtggtccccgacttccggcgaccccacccgacccaagcctcggagtcggaacccgaagaagccgctgtccgacgacaacgcgaggcgcatcataaagggaaaggcggcgtaccagagcatcctgcggcggaaccagggcccgcaggctcagaccccgaggtggattaagaggacccccgagcagatggtgcggtacctgcaggatgaccgcaacggccaattgtacggcagacacgtcctcgccgcggttaagaaagtgcgctctctctctcagagagtcgacggcgactacgacatgaggatggtgatggcttcgtttgtgggcaagctcagcttcaaggagatgtgcgttgtgctcaaggagcagaaggggtggaggcaagtcagagacttctttgcttggatgaaattgcagctgagctaccgtccaagtgtaattgtctacacaatagttttgcgcctatatgggcaagttggaaagctgaaactggctgaggagatcttcttggagatgcttgatgtaggttgtgagccagatgaagttgcttgtggtaccatgctttgttcgtatgccagatggggacgtcataaggctatgctgtctttttattctgctataaaagaaaggggaataattctttctgttgctgtcttcaactttatgatgtcttctttgcaaaagaaatcactccatagagaggttgtacatgtgtggaaggatatgctaggaaaaggggtgatacctaataattttacttatacagtggccatcagctcattcgtcaaagaagggctgcacgaagatgctttcaagacttttgatgagatgaggaattatggagttgttcctgaggagttaacttatagtctgcttataaatttaaatgctaaaagtggcaacagagatgaagtgcaaagactgtatgaggacatgaggtttcgaggaataattcccagtaattacacttgtgcttctcttctatctttgtattacaaatatgaggattaccctagagccctctcccttttttcagaaatggtacgcaataaaatttccactgatgaagtcatatatggtttgcttataagaatttatggaaagcttggtttatacgaggatgctcacaaaacatttgaagagacaaagaaccgagggcagctcaccagtgagaaaacatatttggcaatggcacaagtccatcttacttcaggaaatgtagacaaggccttggaagttattgaactcatgaagtctagcaatctatggttctctcgatttgcttatattgtgctgctgcagtgttatgtgatgaaagaagatgtagcatctgctgaaggaacatttctagctctctccaagacaggaccacctgatgctggctcctgtaatgatatgctcagtctgtacatgggacttaatttgacgaataaggccaaggagttcattgtccaaataagggagaatgagacaaattttgacaaggagctttatagaacagttatgaaggtttattgtaaggagggaatgctgccagaagctgagcagttgacaaatcagatggttaagactgaatattttaaaaatgacaaattcttcatgacattttattggattctttgtgaacataagggggatatggaatctgatgatgaacttgtggccattgagcccattgacaaatttaacgctacagctcttgggctgatgctcagtttatatctggcaaatggcaacttcaacaagacaaaaatattactgaaactgttgttgggttatgctgctgggggatcaaaaattgttagtcagctcatcatcaacttgtctaaagaaggagaaatcagtaaagcagaattgcttaaccatcaattaactaagcttggctgcagaatggatgaagccactgtagcttctctaattagccattatggcaaacaacaaatgctgaaacaagctgaagatatttttgcagaatatataaattctcccacatctagtaaagtgctttataactctatgatcaatgcatatgccaaatgtggtaaacaagagaaagcatatttattatacaagcaagcaacaggggaaggacgtgatttgggtgctgttggaattagcatcgctgtaaattctttgaccaatggaggaaaacatcaggaggcagagaatattgtccaaaggagtcttgaagaaaacttggagcttgacactgtggcttacaatacctttatcaaagccatgcttgaagcaggcaaattgcattttgcatccagcatttttgagcacatgatttcctccggtgttgctccatcaattgaaacattcaacacaatgataagtgtctatggacaagaccaaaagttggatagagcagttgagatgttcaaccaagctagctcatgcagtgtccctttggatgaaaaaacatacatgaatttgattggctattatgggaaagctggtttgatgcttgaagcatcacagctgttcagtaaaatgcaggaaggaggtataaaacccggaaaggtcagttataatatcatgatcaatgtatatgctaatgctggagttcttcatgaaacggagaaacttttccataccatgcagaggcaaggttatttgcctgattctttcacgtatctttcccttgtccaagcatatacgaggagcctgaattattctaaagccgaggaaaccatacatgctatgcaaagcaaaggcattccaccatcttgtgtccattttaatattttactccacgctttcataaaagctggattgattcatgaagccaagagggtttatgaggatctatcaacttttggtttagttcctgatcttgtatgtcatcgaacaatgctgaatggttacctgaaatgtggatatgtggaagaaggaatcaacttttttgaaagtatatgtgaatcaacaaaaagtgacaggttcattatgagtgcagctgtgcatttttacaaatctgctggaaagggaaggcaagctaaagaaatattaaatttaatgaacaacatggggatcccattcctcaagaaacttgaagttggatcaggagagagagtgaaaactccatgataa

SEQ ID NO: 639 - DNA, 1817 bp, Glycine max
gcaccatggaagcgttgcgcgtcgcccccacaaccccacctctcctccgccgccaccaccctctccgccaaatggcgcgccaccccctcacagcgcgcccccgccgcgcgcccctcatcgccgccaccctctccacgccgccggaggccgctcactcttccgtcgccgccgccgtcgccgaagatccctcggaggcggctcctcctccgcgcccccgcgtcttgccggattccctccagtacccgcccggcttcgtcggcgcgattcccgcccgctcccgctccgacggtggcggcggcgggattgatgccatgacttatttgacgaacattctctcttcgaaggtgtatgacgtggcgattgagtctcctctgcaattggcgccaaagctctctgcgagactcggggttaaggtttggctcaagagagaggatttgcaacctgttttctcatttaagcttcgtggagcttataatatgatggcaaagcttccgagggaattgttggaaaggggggttatatgctcgtctgctggcaatcatgctcaaggagttgcattggctgccaagaggttgaattgcagtgcggtgattgctatgcctgtcaccactccggaaatcaagtggaaatccgtggaggcgctgggtgctacagttgtgctcgtgggggattcatatgatgaagcacaagcgtatgctaagaagcggggggtagaggagggtaggacattcgtacctccttttgatcatcctgatgtcatcatgggtcagggaacagttgggatggaaattgtccgccaaatgcagggtccaatttttgcaatctttgtgcctgtgggaggaggtggtctcattgctggtattgctgcttatgtgaagagggttaatccggaggtgaagatttttggggtggaacccactgatgcgaatgcaatggcattgtcactccatcatgatcagagagtgattttggatcaggttggaggatttgcagatggtgtagctgttaaagaggttggtgaagaaacttttcgcatatgcaaggagttgatagatggcgttgttcttgtaagccgtgattcaatttgtgcgtcaataaaagatatgttcgaggagaaaaggaacatattagaaccagcaggtgcacttgcactagctggagctgaggcatactgcaagcatcatggggtccaggggaaagatattgtagtaataaccagtggagcaaacatgaattttgataaacttcgggttgtaactgaactcgctaacgttggccgtaaacaagaggctgtgctggcaactgttttgccagaggagccgggcagtttcaaacagttttgtgaattggtggggcagatgaacatcacagaattcaaatacagatataactccaatgagaaggctgttgtcctttacagtgttgggattcacacagtctccgaattaagagcaatgcaggagaggatggaatcttctcagctcaaaacttacaatctcacagaaagtgacttggtgaaagaccacttgcgttacttgatgggaggccgatcaaacattcagaatgaggttctctgtcgtttcacctttccagaaagacctggtgctttgatgaaatttttggaccccttcagtccacgttggaatatcagtttattccattaccgaggggagggtgaaactggagcaaatgtgctagttggaatacaggtacccaaaagtgagatggatgagttccacgatcgtgccaacaaacttggatatgattataaagtggtgaataatgatgatgacttccagcttctaatgcactgataa

SEQ ID NO: 640 - DNA, 1138 bp, Glycine max
atccatcgtcaacagtgaagtgcgaatactcagcaactggagctggggaaccttgtctctactcgctctcgtccccgccggagatccaccatggccggcaaccccgccaccacttcctcctccgcattatctcccgagaaatttaatttcaatttctcccccgataacccctcccgaatcaccctcacttcggatcaggtcaaccactgcacccaagccctcaacattctgaaggagaagctccacgctcctaacgtgatcactcaggagtttgcacacttgcaggcgaacaggataacgccgagcgagatgaggagaagatgcaccgtcgcgtatgacgacgtcaatttgaggaaaaaccgatacaccgacgttctgccatttgacaagaacagggttgttctcaaatctagtactgattatagacctgaagcacaggggtatatcaatgcaagccttgtctcgacctcctcagctggaaacgtgtcccagtttatagccacgcaaggtccacttcaacatacttacgaggatttctgggaaatgatcatccaatatcactgccctgcaattatcatgcttactagattggtggataattacaagatggcaaaatgtggagattattttcaagctgaggataggcctagagaagttggtaatatttctattattggtaaatgggagaacacgactgaaacttcactcgtgctgcgccatttggaggtgaaccatagagaggtagaagatgcgccattatctgttttgcatattcagtatcctgaatggcctgaccatggagttcccaaagatacatttgctgtgcgtgaaattttgaaaagattataccatttaccaccaaactttggtccaatagtggtgcactgcagtgcaggtattggtagaactggaacatactgcacaattcacaacacaattcagagaatagttgctggtgatatgtctgctgtagatattgctaagacaatagctatgttcaggtcccagcgtattggaatggttcagacccaggatcagtacattttctgctataacgctatcatagatgaactggaagaccttgtatctcagcagcagtcggagtagaaggtgctggaacttggaaggatgttgaagc

SEQ ID NO: 641 - DNA, 1664 bp, Glycine max
aaaggatcctctaattccgttccttccgtaggcccccagatccgttttgccctatttcggagatgaagaaccccaggaagaagaagagaccgaagccgcagaagaagcttgagaagaacaaaggcgttgttgctgctgctgctgttgttgccgagaacgaaaacgaaaacgaagaagaaaagagaaaacgcagcattttggaggcactggttgaggccttctccttgtcttcagtcagggaagcttccatggcctataacattgccggcggtgatcccgacagggcttcggagatcctaaggaagggtttttcggacagatccgaggattcgttctcgtgtttttcttacggctcttcttcttcttcttcctcttcgtcggggttggaattgggttcgaaaggtggttggaggcagcagcagcagcagaagaagatggttgcttcaaccggcactgtttcaacggttttggggaaggaatatgtgaggaggaacaataataatataaggaacaaagggttaagttctaatggagtttttgaaatggaggaggcagagcagttcctctgctctatgcttggcgatgattctgatattaacttggctgttgttagagacgttctttgtcagtgtggaaatgatattgaaagggcctcagatatattgcttgatttagctgcttccacaaatgagaaaccgaatactgctagacatcctaactacggagtggacaacatagatgatgagaggttctttgctgaccccaatgacagtttgatagacaggagattagagtgcacatctctttcatgggaaggttatctttctaataatccatggtctgttggatcttttggaaggaaatatgcggaggttctcaataattctaaagctaattctgctgttagcccaggatgtacaaagtctgagattcctcagaaggtgttggaatctttgtttaacattcccaaaagcactgaacatgacaaaaataccatgaattggagaaatgtagtaaagaaaattcagtctttgggacctgggttctatgtttctccgcatgttgcagaatctcagcaacgtacttgtgccaagggagatgaatatcatgtgtttagggaagattcaaggaagcaatgggattcagtgaaatcttattatacgaaagctgcaacagcatatactaaacgggaacgagcttatgctgcgtatctttccgaccagggtaaagaacaaactaaattagctcagaaagcagacactaaggccagccatgacatatttgtagctagaaacaaaggtatagaaaatgtgataactattgacttacatgggcagcacgtaaaacaagcaatgagaatgctgaaacttcaccttctgtttggatcatatgttccctctgtccagactctaagggtcattacaggatgtggatcacatggtgttggaaagtctaagctgaaacaatcagttataaaccttttagatagagaagcaattgaatggagggaagagaaccggggaactgtgttgattaaactcagcagatggagagagtatagctttctggacaccagcagtgacagtgacagtaatgattaagcatgtctaagtgcatcagcttgttgtaccatatttagatcaattgcctggtagggtaccttt

SEQ ID NO: 642 - DNA, 1463 bp, Glycine max
aaaggatccctttccattccaccgcatcgaaaagcttttacttcacgctgacacacactacacaaacccctaaccttccttccttccattcactactactccttcactttacttcaaaatttcacccttccaaatccccaacttttacaattttactattagaatttacaatctctctttctcttcctcaatccaatccaatccaatcccctctcaatcgaagcaagaaaaccatgtatttatcggagaagcctcgtcccatcgatttctacaaggaggaaggcgcgcgcgacatgatgatcgaggtcgtctccaacggcgacctccctcctccgccgccgccgccgccgatgattctcggcgagagcagcggcgaggaccccgaggtcgagatcaaggccccgaagaagcgcgccgagacctgggtccaggacgagacgcgctctctcattggccttcgccgcgagatggacgcgctcttcaacacctccaagtccaacaagcacctgtgggagcagatatcggcgaagatgagggagaaaggtttcgatcgttctccaaccatgtgcaccgataagtggcgcaacctcttgaaggagttcaagaaggccaagcaccaggaccgagggagtggttccgccaagatgtcgtattacaaggagattgacgagatcctcagagagaggagcaagaatgtgcagtataaaagccctactcctccgcccaaggttgattcctttatgcagtttgctgataaaggtattgacgataccagtatctcttttgggcctgttgaagctactggaagaccaacactgaatcttgagagaagtttggatcatgatggacatcctcttgccattaccacagctgatgctgttgcagcaagtggagtccctccttggaattggagagagactcctggaaacggtggagaaagtcagtcatgttgtggaagggttatatcagttaaatggggtgattatacaaggcgaataggtattgatggcaccccagaagccattaaagaagcaattagggctgcttttaggttgagaactaaacgtacattttggttggaggatgaagatcagattatcagaagtattgaccgtgaaatgcctttaggaaattacactcttcacattgatgaaggaatggccattaaattacctctctatgatgagcctgaccatatacctgtgcatactgaagataagatattttacactgaagacgatttccgtgattttctgacccgccggggttggatatgtctaagagaatttgacagctacagaaatattgacaacatggatgatcttcgacctggtgccatatatcgtggtgtgagttgaaagcaggtacatggtgtggtcaatgttcagctaccataaaatgtctggagaactgtggtggggactgttcagatctttgatgtatgtgcggcactaggtaccttt

SEQ ID NO: 643 - DNA, 3067 bp, Glycine max
ttactcgcactcacaacctctctctcagcaagttgctttgacaaaatcaataccactcattttaagaagtcatatatccccgtggaatttttggttgagaaaagaagaaggtgtgaagagagatgggaaagaagaacaaagtgaaggaaaatggaggcaaagagcattgctcctcgacactttttgtctccaacttgccctattccttttccaattctcagttggaggagacgttcagtgaggttggacctgtcaggcgttgtttcatagtcactcagaaagggtcagcccaacatcgtggttttggttacgtccaatttgccgtcgaggaagatgctaaccgtgctattgagctgaagaatggtacatctgttgaaggccggaaaattgtagtgaagcatgcaatgcctcgtcctccctgtgaagaacggcaatcaaaaccaaataaagagggcaagacagatgatctcacaaagccaaaagacgatgatgaagacagcacattatctggagcagagaagaacgtttcagttttgaaggaagaagaagtacaagtcagtaaacaaaaaaacatgaggaagcccacagaaacgaaaaaatcagctctctgtgatgatgtaccagatgagggtagttgctcagaaaaacagagggttgctagaactgttatatttggtggtctcataaattccgatatggctgaagaagttcacggcaaagctagagagattggcactgtgtgttcaattaagtaccctctttcaaggaaagatctcgagcaacatggtctcctgcaagatggatgcactttagatgcttcagctgtgctttatacaagtgtaaaatcagcccgagcttctgttgcaacgttacatagaaaagagataggagggggaaacatttgggtgcgccaactgggtggagagggctccaagactcagaaatggaagcttattgtcagaaaccttcctttcaaggcaaaagaaaatgaaataagagatatgttttcatctgcaggatgtgtgtgggatgtatttattccacaaaagacaaacacagatctgtctaagggttttgcatttgtaaagttcacctgcaagcaagatgcggaaaaagccattcaaaagctcaatggatcaaagtttgcaaaacgactcatagctgttgattgggctgtttcaaaaaagatatttagcagtgatacaaataatgctcttgcctcagagaaaggacaacaaaacatgagtgatgaggatagtaccgatgaagattttgagcttgttgataaaagatctggtcaaggagatagtgatacagactactctagtgccatggaggaagaaggcacccctcctgaagataattttgataaggaagcagacattgcaaaaaaggttcttaacaacttgcttacatcctcgagtaaaggaacatctgtaaacaatgattctatgttgatcaaagaaaacaagggatcaagatctgatgaaattgttaaggatgcagatgaaaaagcatctaatgagtctgaaaaggtttcaggtgtttctaagcctgaaatttccagcagaaacaacttattaaatcctaagggaacagaagatgatttgcagagaacagtttttataagtaatcttccctttgaatgtgataatgaagaagtgaaacaacgattttctggatttggggaaatagaatattttgttcctgttctccaccaagttaccaagcgacccagagggactggttttctaaaatttaaaactgtagaagcagctaatactgtaatttcaactgccagggctgcttctgggatgggtattttattgaagggtagaccattaaaagttttgaaggctttggataagaaatcagcacatgacaaggaactggagaaagcaaaaaatgaggttcatgaccaccgcaatctttacttggcaaaggagggacttattcttgagggaactacagctgctgaaggggtttcagccagcgatatgttaaaacgcctagagttggaaaggaaaaagaagacaaagcttcaatctcccaattttcatgtttcgagaactagactcattatctacaacttacctaagtcaatgaatgagaaagaactcaagaaattttgcattgatgcagttgtctctagagctaccaagcaaaaacctgtaattcggcagataaagtttttgaaaaatgaaaagaaaggaaatgttgctcaggagcgctattcacggggagttgcctttgttgaattttcggagcatcagcatgcccttgtggctctgagagttcttaacaataatcctgaaacttttggtcccgaacatcggccgattgtggagtttgctcttgataatgttcaaacacttaaacttcggaaggcaaagctacaatctcagcatcagactcctcaagttgacaacaatgccatggataatgacaaccctggcacggtagaaggttgcaagcctgtaaaggacagaaaacgaaaatctcgagagcatgacgaaccagcaaaggaatcagtactgaatacaaatggtgaatcgggtgttgcagtggcaaatggaaaatccccacaaggacacaaatccaaaagacaaaagggcaacaataagagtaaaaaggcactgaaagaaaatcgagaagcagccttgtccatgaagccaaagaataacgaaaatggccataacaatggtggtgcatcacttgaaggtcaaaacactgccactgactctaatagaagaaaatcagggaataaagatgatgtggggtttagaaaaagaaagatgcaaaaccaagagcaagaagctggccaaaaggttttaaagaaacggcttaagaagaataaaggttcagtagggaaggacgtagtagacaagcttgacatgcttgtagaacaatataaatccaagttctcacacaagggttccctagagaatgatggagagaaaagacattcaaaacagcttaggaaatggttccaatcatagtttactatttcttgatatgaattttgttacttatattattttttgactgcttccgataatttaagcca

SEQ ID NO: 644 - DNA, 365 bp, Glycine max
aaaggatcccagtgctcactgtcttaccacccagcacaaagaatctgaggttgagtgattaaaagaatagaactatgtctaaagtggtcacactcttcactttggctcttctattaagcttcaatttaatccatgcctctcgtcctaatccttcacttaacgttgtctcttcttcgcatgaggatgttgcagctacaaaggaagagatagatgaagagagttgtgaagaaggcacagaagaatgtttgataagaaggacgctagctgcacatgtcgattatatctacactcaaaagcataaacccaaaccttaatggcatcatcgcaggaccttcttcggggaccaaatatagtagggtaccttt

SEQ ID NO: 645 - DNA, 2411 bp, Glycine max
aaaggatccaggtgggtttctcatcctaagccagaaatgattgctctgtagtctgtatatattatctgttaaagcaactcttactcactacataaaaaacatgacgcttttggccatcaaaatgactagatggctgactcaggtagcggtatggagatttgttggttttgtttcaactattgttggacttgtttgttacggtctcagctcctccttcaactacctatttggagagtggagcttgttgaagatctttctttacagtggttttagtctcttcatctgccttgggaatctgtttgcaaaggtatgtcgaccctcaacctcaacgagtctccgattcaaagctcattcatcattcttggttttgaccatcacatctgtgtattcctattttgctgacaaagctatgaatggaaaaccagatgtatatagcttgatttcatgtgtttcctttgctatcatgtcgttcagcctctcaaggcaaactcagtgtggatttgaagtggatcttttttattttttccttggatgtttaattgtattactcttgaagattaaatttgcattagctgttgttggagtaggattcagctattcccttattattcttcgttcctctttagacaccgcattgcaccataatcttggggcccaagttgatcaactggctagtactactgatacttctgcagtagtgcttttcgttgatcaactgggccgtactgatattgatgtagcagcagtgcaagatatcgttgtcgaagggcaacgggataatgcacaacgtgataatgctagtatgatgcaacaactcatggcttgcattgaagttcttaggcagggcaattcgaatctcaccaacatgcttttggagcatacaaaagaatactttgatgataaatcagaactagctggtgtggaccataactttgtgattgatgcgctaccatctggaaaaatcaacgaccttgaggaaaccataaagctcatggtggacgatggacttgagaaagagtgctgcgatgtgtactgtaattggcggagggaaagcttagagcagtgcataataaatttattacggttacaagggatcaacatcgaggaaaaacttgaacagagggaatttcaatattacattttaagatggattaaagctgtcaatgttgctcataggatactatttcccagtgagcgacgactctgtgattgcatcttctcgaggttctcttctgttgctgctctttgtttcaatgaggtttgtaggggagccctgattcaattgctcaattttgctgaagctgttgcaagtggaagcccttcagagtggcgtttgtccaaaatccttgacatgtttgagacattgcgtgacctgattcctgagtttcaatcgttgtttcctgagtcaatggtaaaggaagtaatgaaagtccatgacaaattaggtgaggcaagcagggtcattttcatgaacatggaaaatgtgattttccatatcccagagaccaaggtaattgccccggcagatggcagggttcacctaatgaccaaacacgtcattcgctacctcgtttttactagtcgggcacaaaagatcttggagcaaattttagaacaataccccaagtttgctaatgaagtggcaaaatctaattcagtttctgatcagattgatcaagtaattaagcgattggagacagaacttgtcacagtgtccaaaaactacgacaagcctgctttgcgttactttttcttgatgaataattggaggtgtgtagagctagaggcaattaagttgagattaaaccttggttgtttccataaagacacaacaaaagtgcaacaaaacctcgaactttatcaaagtagttcttggaatatggtgctaaactttttgaagctagagaacaacgagctagtggagcctaatgcgaacgcagagtcactgaaaggcagcctcaatttgttcaacatgcacttcaaggatatatgtagcactcaatctagatggcttgcctttgataagcagctaagtgaaaaaataataatgtcactccaacacatcttgttgccagcatatgggaacttcattgagaagttgcaagatgttcttggtatacatgcttctgagtatattaaatatggattgtttgatattaaagaccaactcaaccatttgtttcttggaagcatgccaatgaatcagtatctgaaagacaaggaaaaattgttaaagcttgcataaactgatatataaactttttgttatcatagaagttgttgtaataagatttatgacttgtactacatgcccttctatgttttccttttagaatgcaaacacatttttcctttctgtgttgtttttgtattttagattggcatgaatcaactcgaagtccggtaccttt

SEQ ID NO: 646 - DNA, 652 bp, Glycine max
aaagtcgactcacaaaacaacatggctgcatacagagaacccatgaacatgaacatgagcgacagagccccggtttctccgcagcaaccacactcgccgtggcattctccggttccgtaccttttcggtggtttagcagcgatgttgggtctcatagccttcgctctgttgatccttgcatgttcctattggaagctctccgggtacctcgaagggaacggggaaacagaacgggacctggaagctggcgaaacggaacaggaccagaaacctgcgaaaccgtacgaggagaagatcttggtgatcatggccgggcaagagaagccaacattcttggcaactccgagcgtgtcttcgagttgcagcactagcaggacctcttcgttcggcgacaacactagcacatgcacctgcgaggagaaccgaaaatcgcttgaaatggccgtcaaagagggaagcgctgccgggactgggaccaccgaaaccgcacacacctcatcagatcagaacctttgaaacatagtcacatgttgggggttttgttttgtagttaggttgctttcgtgaaaaagcaaagctcgtgacacctgggtgtctctctaggttgcatgttcaacaattggtgctgatatggggattctctggatccttt

SEQ ID NO: 647 - DNA, 1191 bp, Glycine max
ggtgaaattgaagaatcaagcacaaaaaaaaatccaaaacagtaccttgccgtttattatcacacaagacagcattacccttctattgttatcatcgacattcttaactcttaagaactgattcaccaacgacccctctgaatttcagaaactatcaatgaagggggaagtgcagcttcagcctccagcggttatgcaaaaccctagtgattcggaccctttgctccataaccaggaggaggaggaggaggatgagtcaccgggaagctctggtgagatcaagaatgaggaagaagacgttgaggctggattactcccctgttgtcgaatttgcctcgaaagcgattccgacccagaggatgaattgatatctccgtgcatgtgcaaagggacccaacagtttgtccatcgttcatgtcttgatcattggcgctcagtaaaggaaggatttgccttctcacactgcacaacctgcaaagcccaatttcatcttagagttgaatcgattgaggacaacacttggcgtaaaataaagttcagactttttgtggcaagggatgttttccttgtttttcttgcagtacaaactgtgattgcagctattggtggctttgcatacatcatggacaaagatggttccttcaggaactcgtttgatgatggttgggataggatactgtcaaggcatcctattccattttattattgcattggagtgctggccttctttgtattgattgggttttttggcctcatactgcattgctcctccctcaatagcaatgaccccagaatggctggctgtcaaaactgttgttatggatggggcatcttggattgctttcctgcatcaatggaggcttgctttgcccttgtggttgttttcgttgtcatctttgcaattcttggtatagcttatggttttcttgctgccaccatggccattcaaagaatttggcagaggcattaccatatcctcaccaagagggagcttacaaaggaatatatagtagaggatcttggtggctgttatttcccaccaaagttggacccagaacatgaaggtcgcttgaaaatgctcaagctcttgtaattacggagcacacacctgtaaaaatgtttttgaatgatttataagtatcaagttgatgctttatttgaccgttacagtctcatgattagcaaccttgt

SEQ ID NO: 648 - DNA, 2929 bp, Glycine max
aaagtcgactagttggagaaacaacagcagcagcagtagcagctccttgcaacccccccaacgcctctcaacattattagggtttttctttttcagctattaaagttgcactctctcttctcttaacaaagaatggccacttgcacttctctgtctctttgtcctcacactttctgttgccgccaccgccctcaccctactcgccgttcccttgcgtcgtgctctctctccccttcttccctcccagatacggatggacctaaagtactgcgtaaaagatctagaagaatagaaggtcctagaaaaagcatggaagactctgttcaatgcaagatggaagaattctacgaaggacaggatgggccacccctcagagttcttcccattggtgggttgggtgaaattgggatgaattgtatgcttgttggcaactatgatcgctatatcctcattgatgctggtatcatgtttccagactatgacgagcttggagtccaaaagatcatacctgatacaacatttataagaaaatggaagcacaaaattgaagcagttattataacacatggtcatgaagatcatattggtgcattgccttgggtcattccagcattagattctcatacaccaatttttgcatcatcctttacaatggagcttataaggaaacgtttgaaggatcatggtatttttgttccatcccgactcaaagtatttagaacgaggaagaagtttatggctgggccatttgaggtagagcctatcacagtgactcattctattcctgattgctgtggactagtgctccgttgttctgatggtaccattcttcacactggggattggaagattgatgaaacgccattagatggtagagtttttgatcgtgaagctctagaggaactctcaaaagagggagtcacattgatgatgagtgattcgacaaatgtactctcacctggaaggacaaccagtgaatctgttgtggcagatgcattattaaggaatatttcagctgctaaaggaagggttataacgacccagtttgcatccaatatacatcgtcttggaagtgtgaaagctgctgctgatttaactggtagaaagttggtatttgttggcatgtcgttaagaacatatttagatgcagcttggaaggatggaaagtctccaattgatccatctactctggtgaaagcggaagatattgatgcttatgcgccaaaggatttgcttattgtgacaacgggatctcaagcagagccacgtgctgccttaaatctagcatcttttggaagtagtcattctttcaagctgacaaaggaagatactgttttgtattcagctaaggttatacctggtaacgagtctcgtgttatggaaatgctaaaccgcatatcagagattggatcaactatagttatggggaagaatgaatgtctgcacacatctggtcatgggtatcgtggagaattagaggaagtacttagaattgtgaagccacagcattttctacccatacatggagaactcttgttcttgaaggagcacgaattacttggaaaatcaactggcattcggcacacaactgttattaagaatggagagatgcttggagtttctcatttgagaaatagaagagtcctttctaatggttttatttcacttggaaaagagaatttgcagttgatgtatagtgatggcgagaaagcgtttggtacatcaagtgacctctttattgatgaaagattgaaaattgcattagatggcatcatagtggttaacatggaaatatttcgccctcaaaatttagacagtccagttgagaacaccttaaaaggaaaaataagaattaccaccagatgcctgtggcttgacaaggggaagctgttggatgctctccataaagctgctcatgctgctcttgcaagctgccctgtaagctgtccactggctcatatggaaaaaattgtgtctgagatgttgagaaaaatggtgaggaagtacagtggcaaacggcctgaagttattgccattgccatagaaaatcctgcagctgttcttgctaatgagataaacacaaagttgtctggaaaattaaatgtggatgggatgtcggcattgagaaaagtggtggatggacatgagaaagagaatcagagaaccgaaatgcaaataagagatcgtattgatgtaggtggtctactacctacaaaagacaatgctatctcaagtggagctgaggatggcttgtctgatgcggaggatccaaatgattattttaaaccatttgttgaatcctctccagttgagaagtcaattaaaactaacaatggttatgttccacgaaaggagaagtcatccccattgaaggatgactgttctgaagacactgaagaatgcaattctgtaaatacatcagattctgaacccaaatcttcaaaatcagcaaagagaaataaatggaaacatgaagaagttaagaagctgattgatatgcgtggggaactgaatgacagatttcaagttgtgaagggaaggatggccctctgggaagaaatatctcagaatttgttggctaatgggatcagcagaagtcctgggcagtgtaaatctctgtggacttctttgttacagaaatatgaggaggtgaagaatgaaaagaagaacaagaaaaaatggccgtattttgaggacatggaaaggattctagctgataacaagacactagaaacaaaatgattataaaggtgatgcaccagacaagaaaaatttgcaagagttttctgcattatgattggtaatatgtctgagcatggtcgctgggaaggtaatccatcagttgcattattcttgcatcttgaactccttcattgaatatccatagttttgtgaggagatggacagcgttaaatgcattaggcctttt

SEQ ID NO: 649 - DNA, 5198 bp, Glycine max
tcctcatgaagaaatcctcctaccctaatcccacccctcgccgccacgattttcaccgtccgccaccacccacccacggctgcggttgggctccccgccccgcctaccaccgcccctaccaccaatggaggccccgattccacccccacgccgcccgcatcgaccgccctccggagccctatttcagggtggagctccgcctcggcagcagccccctccaccgcgacgacgtcgaggccctgatcgacgaatgccactcccggcacgacaccttcactttctaccccgtcgacgacgtcgccgccgttctcagttaccggagctgggagcaggcgcgagacgccgtcgtttggttctgggaggcgcggctcgcggagaagcacgatttcacgccgacgctggattccaacgtcgtcgtcgtcaaggacgatgtggattgtcgccttcgaccggtgttcgcgaggcacgtgaaagggttgacggaagggaaggaggtgaagcggtggatggaggagagtgaacggttgtcgaaagaaatttctcggctttcgagttcgctgagtaagcccttgcgacttggcgtgcacaacgagttggtggagaagaagaaagggcttgttgatgagaagaatcttgttgaaaggaggttgaaggagtttgagtctgcgatgcagtgtttattgaagtatttggagggtggtgttgacgtggagggtgtgactgtctttaggtttgatggaggttttgattggaagcggattcattgtctgatcaaaagggagtgtcggaggcttgaggacgggttgcctatttatgcttaccggagtgatattcttcaggaaatacattatcaacagataatggtattaatcggagagactggttctgggaagagtacgcagttggtacagtttcttgctgattcaggcattggtactgacgaatccattgtgtgcacccaacctcgcaagattgctgccaaatcagtggctcaaagggtccaggaagaaagcattggatgttatgaaggccaatcaatcaaatgctgttctacattttcatcctcacgtgagtttgattccaggatagcattcatgacagatcattgtttattgcagcactacatgagtgataataatttatccggggtctcgtgcatcataattgatgaggctcatgagaggagcttaaatacagatttactgttgactttgttaaagagtttactttgtaggagggttgaaatgagacttatcattatgtctgctacagctgatgcaaagcagctgtctgattacttttttgcttgtggaatttttcgtgtgcttgggagaagctttccagtggatatcaaatatgttccttctgactatgcaggagattctggttctgctgttgttgcctcatatgtttctgatgttgtcagaatggcaactgaggttcacaaaactgagaaagagggaactattcttgcctttttgacctctcagatagaagtagaatgggcctgtgaaaagtttcaagctccctctgcagtagctttgcccttgcatggaaaactttcttctgatgagcaattccgtgtttttcagaactacactggaaagagaaaagtgatattttcaacaaatcttgcagagacatcacttacgattcctggtgttaggtatgtgatagattctgggctggttaaagacagcagatttgatcctggtagtgggatgaatgtacttaaggtttgctggatcagccagagctctgctgatcaacgggctggtcgtgctgggaggactgagcctggtgtgtgctatagactgtacacggaagctgattatcagtctatggacctaaatcaagagccggagattcggagagttcatcttggtgtagcagttctgaggatccttgctttaggagtgaaggatgtgcaaggttttgattttgtggatgctccaagtcctagctccatagatatggcaatcagaaatctaattcaattaggagccattgaactgaacaatgatgttcatgatttaacttctgaaggttggtgcttggtaagaatgggaattgaacctaggctgggtaaacttattcttggttgtttcaaacatggtttgggtagggaaggtatcatccttgctgctgtgatggccaatgctagtagcatcttttgcagagttggcaatgaatttgataaacaaagatctgattgtcttaaagtgcaattttgccattgtgatggtgacctctttactcttctctccgtgtacaaggaatgggaagctttgcctcgagaaaggaagaacaaatggtgttgggaaaacagtatcaatgccaaatccatgaggaggtgccaagacacaattttggagttagaaacttgccttgagcgtgaacatgacgttgttactccgagttactggcgttgggacccttgtatgccctctaatcatgataagaatttgaaaagggtaatactgttctcacttgctgagaatgtagccatgtactccggctgcaatcaacttggttatgaagtggcacaaactgggcaacatgttcaactacatccatcttgttcattgcttgtatttgctcagaaaccaagttgggtagtttttggtgagcttctttccatttccaatcaatatttggtctgtgtgagtgcatttgattttcaatcattatacgacctttgccctgctcccctgtttgatgtatccaaaatggaagagcggaagttgctaatgaagacactgtctggtcttggctgtattcttctcaagagattttgtggaaaagccaactgcaatttgcttgctcttgtttcacgtataaggaaagcttgtatggatgaacgcatcttcatcgaagtgaatgttgacaataatgaaatccacttatatgcctcttcaaatgatatggatatagcccttgggttggttaacgatgttctagaatatgagagaaagtggttacgcactgaatgtatggataagtttttgtatcatggttctggtttctctccacctgtagctttgtttgggtctggtgctgagataaaacatttggaacttgagaaacgttccttgagtgttgatgtgtgtcatccaaacataaatgaaattgatgacaaggagctcttgatgttttttgagaagaatacctctggttgcatctgtgctgtgcacaaattcacaggcaatacgagggatgaagatagggataagtggggcaggataacatttatgtccccagatattgtcagaagagctgctgagctagatggacgggagttttgtggctcatccttaaaagttgttccttcacagttgggaggggataaaacattttcgttccctgctgttaaagcaagaatttcttggcctcgtaggcttagcaggggatttgccatagttaaatgtgatataaaggacgttgattatatcttgagagatttctataaccttgcagtaggagggaggtatgttcgatgtgaagttggcaaaaagagtatggacagtgttgttataaatgggcttgacaaagagctttcggaagctgaaatatcagatgtgctaagaactgctacaactagaaggattttggattttttcttggtgagaggggaagcagttggaaatccaccatgcagtgctttggaagaggcactcctaaaagaaatttacccctttttgcccaaaaggaaccctcacattagtccttgccgagttcaggtgtttgcacctgagcccaaggatgctttcatgagagctttaatcacttttgatggaagattacatttagaggcagcaaaagctttggagcaaattgaaggaaaggtgttacctggatgtctttcatggcaaaagataaagtgccagcagttgtttcatagctcccttacatttcctactccagtgtatcgtgtgattaaggaacaactggatgaagtacttgcaagcttcaggaatttgaaaggtcttgaatgcaacctggacaggacatttaatggttctcaccgagtgaagataacagcgaacgccacaaggacagtggcagaagttagaagacctctggaagaactattgagagggaaaaccattgagcatgacagcctcacccctgcagttctccaactcatgttgtccagagatggctttagtcttaaaaactcattgcagcaagagactggaacttatattctttttgacaggcacaacttgaatttacgggtgtttggttccccaaacatggttgctttggctcaggagaaggtgatacagtccctcctttctctccatgaagaaaagcagttagaaattcatctgagagggagggatctacctcctgatttaatgaagcaaatgattaagaattttgggccagatctccatggattgaaagagagggtacctggggtagatcttacactgaacatacgtcgccacataatcattcttcatggtagcaaggagttgaaaccgagagtagaggaaatagtttttgagattgctcgttcaagccatcatttggttgagagatttggcaatggacccagttgcccaatttgcttgtgcgaggttgaggatggataccggcttgaaggctgtggccatttgttctgccggatgtgtttggttgagcaatttgaatctgctattaaaaaccaaggcactttcccggtatgttgtactcacagggactgtggagatcccatcctgcttacagatttgagatctcttttatttggtgataagttggaggatcttttcagggcttctttgggagcttttgtggcaacaagtgggggaacttacaggttttgcccttctcctgactgcccctcaatttatcgagttgcagatcctgggtctgctggcgagccatttgtttgtagggcttgttattcagagacttgtaccaggtgccacttagagtatcatccttacctttcatgtgagagatacaaagaattcaaggaagatccggattcatctctgatagaatggtgcagagggaaagaacaagttaagtgctgctcggcatgtggatatgtaattgagaaggtagatgggtgcaaccacgttgaatgcaagtgcggaaagcatgtctgctgggtttgtttagagttctttagtactagtaatgactgttatgaccatttaagaactatacacttaaccatataataa

SEQ ID NO: 650 - DNA, 977 bp, Glycine max
cactcatgaagagacttagcagctcagattcttccagtgccctcatgacaatttgtccatcaacagaggaacatagtccgaggaacagccaacacatgtatggtagggagttccaatcgatgttggacggactcgacgaggaagggtgtgttgaagaaccggggtatcaatctgagaagaagcgtcgtctaagtgtggatcaagtgaaggctttggagaagaactttgaggttgaaaacaagcttgaacctgagaggaaggtgaagcttgcccaagaacttgggttgcaacctagacaggtagccgtatggttccaaaaccgtcgagccagatggaaaaccaaacaattggagagagattatggtgtactcaaagccaattatgatgctcttaagcttaactttgacaccctcgatcaggacaacgaagccttacgaaagcaggttaaggaattgaaatcgaggctgctgcaagaagagaacacaggaggaagcggtgtttcggtgaaggaagagataataacgaggcctgcagactcagaagacaaaacgatggaacaaagtaagagtgacccatcttctgaaacctcaaatattaatcctagttcggagtcggaggaggatcacttgaactacgagtgtttcaacaacaacgacgactgcgtcggaggaaccgccgcatcgcttttgcaagtggacttcaaagacggttcttccgacagcgacggatcaagcgcgattttgaacgaagacaacatgtactctcccttgaaattcaacaattgctccatatcaacctcgccgtcatcgtcttcgatgatgaactgttttcagttccagaaaccgtatcatcaccacgcgcagtacgtgaagatggaggagcacaatttcctcagcgcggatgaggcctgcaatttcttctcggatgaacaagcaccgacccttcaatggtactgtccagaacagtggagctgataa

SEQ ID NO: 651 - DNA, 630 bp, Glycine max
aaaggatccaagccactcaccgatagagaagccgccgccaccttcaccagtcaccgtcgccgccgccgccttcaccagtcaccgtcgcattcctctttcagcaaaaccccttcttctcactcacactctcacacccatattctcaaacacaacacagcaccaacctcggtgataacaattcaaagaaacacagaaatacacagacacgaacaatggctggtcgattccgtgagctgatgaagaaatatggaaaagtcgcactcggcgttcacttgagcgtctccaccgcctccatcacgggtctctacgtggccatcagaaacaacgttgacgtggaatccatcctcgagaagttccacatgggcacagtctccgagggacaaaaccctaaccctaatcactcagacggcgccgccgcgccacccaagaaccggacggctcagctcgccgcctccgccggcggcgccttcacgctggcgatcctctgcaacaaggcgctgttccccgtgcgcgttcccataaccgtcgccctcactccccccatcgcgaggttcctcgcgaggaggaagatcatcaagagcggcgtatgaattggattcggtgacgagaatcgtgagatttagggtacct

SEQ ID NO: 652 - DNA, 1229 bp, Glycine max
aaagtcgacgttcagctcaatctgggatacgaagcttgcaatagctgcagcatctgaataggaatggattatatctgtctttttgtcaccttcactgcgattgcgctcttagggtttgtctttgtagtgttttttgaagcatataaaagaagaaacaaccatcagcatatcgaagttccggctatttttgaagatcctagctcattgaaacaggttccttgcccacatattgttgatccagccacaaagtatatttctttgattatccctgcattcaatgaggagcataggcttccaggagctcttgaggaaactatgaattatcttcatcaacgtactttaaaggattcttcatttacatatgaggttgtaattattgatgatggaagtgctgatgagacaaaaagagtagcttttgaatttgtgaggaaatacacagtagacaaggtaagggtcatccttctaggaagaaatcatggcaaaggagaagcaatcagaaaaggaatgatgcattcacgtggtgaactacttcttatgcttgatgctgatggagcaactaaagtcactgacctagaaaagcttgaaaatcagattcaagctgttgccaaaagggaatatcaccatggagattcaagtgatagtgatcctagatttagaatatctgatgtcccagctgctgtgtttggctcaagagctcatctagaggagaaagctttagctacaaggaagtggtaccgcaattttttgatgaagggcttccatcttgtggttctcttggctgctggtcctggaattcgtgatacacagtgtggtttcaagatgtttactagggcagcagccaggaagcttttttcaaatgtacgcttaaaaaggtggtgctttgatgttgagttagtctttctatgcaagtggtttagaatcccagtttcagaaatttctgtgaattggtctgaaattccaggatccaaggtgaatcttctgagtatacctaacatgctttgggagcttgtgctcatgtctgtggggtacaggactggtatgtggagaatttctaattctacctgagcgagcgtggatgatcaacttaactgggaagagaagtggcattttcctatctaaacaagagtcacctcttacaagagaacatatactctcatgccgggcttaagggacaatcatgcaatatttaaagtttgtaggactaaccataactttccgggaggcctttt

SEQ ID NO: 653 - DNA, 2439 bp, Glycine max
aaaggatccgtcgagggactcagcttcttcttcttcttcttcttcttcttcttcttcttcttcctcttctcgttcttctctcatccattccatggagcttcagaggcgtccagatcagtgcctcccggtgaggaaagggctgaagaggaagctagaggaggagttcgatgacgacccacagatctccgctcctcccaccggtgacgctcgcgacgccctcctctctgacgttaaggaacaggtttccctcctcgattccaatttctcctggaacgaacacgatcgtgccgccgccaagcgcgccacgcacgccctcgccgatctcgccaaaaacgaggaagtcgtgaacgtgattgttgaaggaggcgccattccggcgttggttaagcatctccaagcgcctcctctggctgaaagcgaccgtttgccgaggccaatgccgttcgagcacgaggtcgagaaagggagtgctttcgcgcttggacttctcgctgtcaagccagagcatcaacaactcattgttgacagtggtgccttaaaacatcttgttgatcttttgaagaggcataagaatggcttaacatctcgtgccattaatagtctcattcgtagggctgcagatgccatcactaatcttgctcatgagaacagcagcattaaaactcgtgtcaggaaggaaggcgggattccaccgcttgttcatttgcttgaatttgcggatacaaaggtgcaaagagcagctgctggtgcattgcgaacccttgcttttaaaaatgatgaaaataaaaatcagattgttgaatgcaatgcccttccaactcttattctaatgcttcgctcagaagatgctgctattcattatgaagcggttggtgtcattggaaatctggtccactcttcccctgatataaagaaagaagttcttcttgctggagccttgcaacctgttattggactacttagctcctgttgctctgaaagccagagggaagcagcattgttacttggacagtttgcagcaactgattcagactgcaaggttcacattgttcagagaggtgctgtccgacctctgatagagatgcttcagtcctctgatgttcagctaaaagaaatgtctgcctttgcattggggagattagcccaggacacacataaccaagctggtattgtgcacaatggtggtttgatgccattactgaagcttcttgactccaaaaatggctctttgcaacataatgctgcatttgctctttatggccttgcagataatgaggataatgtgtccgattttattagggtaggtggaattcagagactgcaggatggagagtttattgttcaagcaactaaagattgtgttgcaaagacattgaaaagattagaagagaagattcatggccgagttctgaaccatttgttatatctcatgcgagtttcagaaaaggcttttcaaaggcgagttgctttaactcttgctcacctttgctctgcagatgatcaaagaaaaatatttattgattataacggtttggagttgcttatgggacttcttggctcttataaccccaagcaacaacttgatggagctgtggctttatgcaagttggccaataaagctatgactctgtctcctgtagatgccgcacccccatctccaacaccccaggtgtatttgggagagcagtatgtaaacaatgctaccttgtctgacgttacatttttggttgaaggcaaacgattttatgctcacagaatctgcctgcttgcatcttcagatgcatttcgtgcaatgtttgatggtggttatagggagaaggaggcacgggacatagagattccaaacattagatgggaggtttttgagctgatgatgagatttatatacactggatcagtagatatcactcttgatattgcccaagatctcctccgagcagctgatcaatatcttttagaaggacttaaaagactatgcgagtacacaattgcacaggatatatcactggagaatgtgtcaagtatgtatgaactttcagaggcctttaacgctatatcattgaggcacacatgcatcctttttatattggagcactatgataaattgggtggaaagccaggacactctcaactgattcagcatataatacccgagatccagaattactttgttaaagccattacaaaggccaattccaatatccagccgtaatgtgctgttctactattgacatctaacccgttgcaatgtacataatgtggttgatgttctttttgttgaacctgcgaaggaagtctcctggatcaagtacagcatggcttaaaaaaaatatctaacatcacgtcatgtacgttcatttctgatgcagtgtaagtcccttctagctgtaacgtcattgtcttagatatagcaaatatgaccttcacgaacaggtacct

SEQ ID NO: 654 - DNA, 1293 bp, Glycine max
aaaggatccagcgactttgtgggaagagtgaaagaagaagcgcagttaatgaaggtataagactgcagaaactgagagagaaagagatctggaagagatgagtgaagcgcagaagcaggtttggaaaggggccattcctctccagattcacctccacgaatccgaagtcaccactctccctcctcctccacccgctctcgtgttggcacctcggatagggtacttacctttgctgatttcgctcttgaagcctcagttcagcaccacgcttccccctggagtcgacaccatttggtttgagtacaaaggcctccctctcaagtggtatatacctactggagttctttttgatcttttgtgcgtggagccagagaggccgtggaatttaactgtacactttagaggatatcctagtattgtattgcttccctgtgaaggtgaagacagtgtaaagtggagctttattaactcactgaaagaggctgcatatgtaataaatgggaatagcaaaaatgtgatgaacatgtctcaaactgatcaggtggagctctggggctctgttttaaatggtaactttgaaacttatcgacgggtggcatctaagcttaagcttggaacttttgaagatgaatatatggaaaatgttagttcagtcttggttaaatcttcacaaagtacaggggatactgatgttactggacaattgaaaactggtaggattcctgttcgtttatatctgtggactgtcaatgaggagtttgatgattttgaagatgctccacaaattgataattgggacaaagtctcatatatcaatcgacctgttgagatttataaggaagatggtaaatattttagcttaaatgatgcggttaaaagaatattgcccgagtttttcctggaaaattcctttgtaactgatggagatgcaaacattaaccaaagtggagaagagggagaaagttcatctgatccagggtcatgttgcaacacacttgagattgctgaaatcaaacttgtacgcattcaaggaatagaaccaattttagacatacctttctcttgggtggttaacaacttgatgaatcccgagtattttcttcatatgtgtgtttgcttaaaagtttcaaaggccaatgctgtacaatagggataaatttagttatcttggacatacattttactagaaaaatcagaaggtgcaattcttttgtacatatatgtacagaacgatttcatatcatatattcatttcatgattcgattgctatttcccacttccaaggtaccttt

SEQ ID NO: 655 - DNA, 583 bp, Glycine max
tactgggtggacagaacagaacaggatagttatctgaatggatcttcatcttagtgtgcggcttcctgtttcacttccctgcttctctcactctcagaatgtgaagttacaattgcaaagaaggagattatccaccgtttcctctgccctggctgagactgcagcgtcaatggcagtagctgtaactgtcgttggtgcagcagctacccttcttgtaaagagatccaaaacttctgagtcatcacagattcaattcaaagcatgtgaagattgtggaggttctggtatatgttctgaatgcaaaggtgaaggattcgttcttaggaaacgttccgatgaaagtgctgagaaggcaagagtgcaagctaagaacatggcaacccgattcacagcgggacttccaaagaaatggagctattgcacaaagtgctcttctggtcgatcctgttcaacctgtggtggcagtggaaagctaagttactagtttagcattacatgttgtctacccagttcaaaagacagttagttcctcagcatttcacatgttcttgtttaaatcacggttcagaatattgaggcaaca

SEQ ID NO: 656 - DNA, 2354 bp, Glycine max
aaagtcgacctctctcgtggttgtctttcaccgcattatagccaccgccgttgctgtttgccactcttttttctttttattcgtctcttcactcttcatttttttattattcacaacactttctcctccttccaattccatcgtcactaagttacttaagtttggtagcatagttctgcttctgatttagattccgcataaagttgttgcttacacgtgcccttcttctcttatatcttaaccattgccctctattgccttagcctatgcttattcttttcaccttctaaatattcattgcccagaaccaaatcactttctttttttcattctctgtccttaaagttcgttgctttacattacagggtgtccaaccaaagctaccctcaaatctcaatgctttctaccaacaacaacacaacaagtgcaatgattctggagggttgcaggaggataaaaagtttctgatatttttatttttttgggtattgatttggatgatcctctcctttgagttgctgcttcaaggagagagagaattatttgggatgaaagatgctagtgttgatctgggtttttgctggaaggaagaaaagaaggttctgaattctgatatatagtaatcaagagtcaaaactgaggattcgttaggttggtgttgaatccagttccaatggacacaccaaatgcacagccgcaagctgcatcagcaagcacgccaaggaaaaaaatgacaaagcaattgacaggtaaaagggatgatacacctttgcactctgcagcaagagcagggaatatgactgttctgaaagacacggttggtggcactgaagagggtgaactacgtgtgttgctgacaaagcagaaccatgccggagaaacggttctttatgttgctgctgaatatggttatgttgatatggttagagagctgattcaatattatgatcttgctggggcgggaattaaggccaggaatgggtttgatgcactccacattgctgccaaacaaggggatttagatattgtgaagatcttaatggaggctcatcctgaattgtcaatgactgtggatccatccaacaccacagcagtgcacaccgctgcattacaagggcatactgagatagtgaagcttctattggaagcaggtagtaatctggcaaccatttctagaagtaatgggaaaacagctttgcattctgctgcgagaaatggacatttggaggttgtgaaagcgcttctggggaaggagccttcagttgcaacacggactgataagaagggacaaacagcaattcacatggcagtgaagggacagagtcttgaggtggtggaggagttgataaaagctgatccctcaacaataaacatggttgataataagggtaacacagcattgcatatagcaaccaggaagggcagggctcggattgttaagttgcttcttgggcagacagaaaccgatgccttggtagttaacagatccggcgaaactgcactagacacagctgagaaaactggtaactctgaagttaaagacattctcctggaacatggtgtccgaagagccaaagccataaaggctcaaccaggaacagccacagcccgagagttgaaacagactgtgagtgacataaagcatgaagtccactaccagttggaacacacgcgccaaactcgaagaggtgttcaaggcattgccaaacgcatcaacaaaatgcatactgaaggactcaacaatgcaataaactccacaactgtggttgcagtcctcattgccacagttgcctttgcagcaatcttcacagtccccggccaatttgctgatgaaccaaaagacatccctgcaggttcaggaatgaccattggtgaagcaaacatagccccacaagctgcatttctcattttcttcgtctttgattccatcgccctcttcatttctctggccgtggtggtggtgcaaacctcggttgtgatcatagaaagcaaagcaaagaagcagatgatggccatcattaacaagctaatgtggttggcttgtgtgcttatttctgtggccttcttggcactgtcatttgtagtggtggggaaggatcagaagtggcttgcaattggagtcactatcatagggacaactataatggccacaactttgggcaccatgagttactgggtcattaggcatcgcattgaggcctcaaacttaaggagcattcggaaatcttcaatgggaagcaggtcaaggtctttttcagtatcagttatgtcagattctgagctactaaacaatgaccgcaagatattgtatgccatatagaatcactaataaagccttgttgcccgatatcttt

SEQ ID NO: 657 - DNA, 1373 bp, Glycine max
tcaacatgaacccaaatgatgctaactctcctaagccgttggagattctgcagatgaaccctgttcctccgtttttgtccaagaccttcgacctcgtcgacgacccgactctcgaccccattatctcatggggctccaccggttttagcttcgtcgtgtgggaccctctcgagttcgcgagaatcgtccttcctcggcatttcaagcacaacaacttctccagtttcgttcgtcagctcaatacttatggattccgcaagattgacacggacaagtgggagtttttcaacgaagctttccagcgagggaagaagcacttgctgaagaacatccaaaggcgcaggtcatctcaatcccagcaggttggtagctatattggaatcgaatgttctactgaggcaggaaggtctgatgttgagattgagatagaaaggcttaggaaagaaaggactatgttgatggaagaggttgttgatttgaaacaagagcagcgaagaatggctcaccgcgcaggagaagtgaatcaaaggctccaatccacagaacaaaggcagaaacaaatggtttctttcctggtcaagttaatccagaaccccgcctttttagcccgccttaggcatgaggagcaaaaagaaatagattctccaagagtggtaaggaagtttgtcaagcagcaccaacatgaaactggaacagcagaaactctccaagaagggcagatagtgaggtaccaacatgattggagaaatataggcatgtcttccgaaactccaaaactaagtccagtttccattgaacagtctcctcactacctttcacagggtttggcaggagaagtgagtgtaggcgcagaagatcttactgctcaaatagagaatattgtatcaaatgacttggctgcagtgcacgggatcacagtgtctcaggaaattatgattggagaaggattatctagctttggagctgaagacccccttttcaaagggaaaagtgtcatgagtccaattctagaagttcctccagagtattttgcttccttcccagagggtttgaccaaggggaaagactttcaagatttttctgctcttggaactgaaggcatgataaagctagaagatatatgggactctggccttaatgttagtggtgctgcttcaggtagtgggaatgagctgtggagcaatcatgtcaactatgaagagtttccagaatttggagtcacaagtggtatgtctgactcagacatctgggatattggcttaggaagtttgggaattgataagtggccaactgatgaaccttctcttggtgaaacaaatggtcaagctggtcaaccaaaagaagataggcctaagaattttggtccatagtaa

SEQ ID NO: 658 - DNA, 3247 bp, Glycine max
aaaggatccaaagcatccatccctaacttccgatccttcatccttacttaggcttccattccaattcaagcattactaatctgcaagataaagcaaaaagtactacagaggcaagagaaggcaaattaagaggaatttcaaaaaagttgttttgttttttttgggtattgggtttatttgaaagagtgtaggttgatgttacttgggtatataattcaattgatcaaaaagtttggataataataataatatatccaaatggaggatcaagttttctggttggccacagtgttatccgtagccttcactcacaaattttctgagcaagagtgtatataatgaagaggttctctgcctgctgcttcacaagcagaatctccaagtttcactcccactggaagcacaaccattctcagtctcagatcatggcaggaaacatttctggtccaagtgggagcaagggtgctaatattttacttaatcatgacttctctagtgggctgacctcttggcatctcaatagctgcactggctatgtaatttcatccaaatcaggtactcaaggaggaatcccaatggatttggatgctaattatgctgttatcaccgaccgaaaagaatgctggcaaggtcttgagcaagacatcaccaacaaaatttccattggttccacttacacggtttcggcttgtgtgggagtttccggggtttctcagggatctagtgatgttctagctactctgaaactagaacatcatgattcagctactcgttacttattcattggaagaacttctgttaataatgatagctgggaaaagttggaagggacattctcattgtcaactatgcctgatcgggttataatttatttggaaggacctgctcctggagttgacctgcttatacgatcggtagtgatcaactgttccactcctaatgataataccacaagcacaggatgtgtttcagctggagatgacaacatcatagtcaacccccaatttgatgatggcctgaaaaactggtctggaagaagctgcaagattatgttgcatgattccatgaatgatgggaaaattgttccaaagtccgggaaattcttcgcatctgcaacagaacgcacacaaagctggaatggaattcagcaagagatcactggacgcgtgcagcgcaagctggcctatgaggtcactgctttagttagaatatttggaaacaatgtctctaccgctgatgtacgggctactttgtgggtccaaacgccagatcttcgagagcagtatataggcattgcaaatgtgcaggcaacagataaagattggataacaatgcagggaaaattccttctgaatggttctccatcgaaagtggtcctttatttagagggtccccctccaggcactgacattcttctcaataatttggtcttaaagcatgcggctaaaacacctccttcaaccccaccagatgtaaagaatgttgcttttggggttaatataattgagaacagcaatctggctgatagcacaaatggatggtttccccttggcaattgtactttaagtgttaaaactggttcaccacatataattccaccaatggcacgagattctcttggtcctcatgagctcctaagcgggcgctacatccttgtaactaatcgaatgcaaacatggatgggtcctgctcagaccatcactgataaagtgaaactctttgtgacttatcaagtgtctgcttgggtccggattggctcagcaggatcatcagggcctcagaatgtgaatgttgcccttggtgttgacaatcagtgggtcaatggaggacaaactcaggtttcggatgacatgtggcatgaaattggagggtcctttagaattgaaaagcagccatcaaaggttatggtttatgtgcaaggtcctgcttctggtgtggacttaatggttgctggacttcaaatttttcctgtggatagacacacaagatttagatatttaaagatccaaactgataagattcgtaaacgtgatgttatcctgaaattctctggactggactctggcagctatgctaacacctcggtaaaagttatacaaacacataatgatttcccaattggaacatgcatcagcagaacgaacattgacaacgaggactttgttaacttcattgtgaagcattttaactgggctgtgtttggaaatgagttgaagtggtattggacggagccacagcaaggcaatttcaattacaaggatgctgatgatatgttaagcttgtgtcagaagcacaagatacaaactcgcggccattgtatcttctgggaagtggacgaaaccgttcagcagtggatcaagtcactgaacaaaaacgatctgatgacggctgtccaaaaccgcctaaacggcctgctgactcgctacaagggcaagttcagtcactatgatgtcaacaacgaaatgctgcacggttcattttaccaagataggctaggcaaggatataagggcaaacatgttcaagactgcaagccaactagacccttctgccacactctttgtgaatgattatcatgttgaagatggatgcgacaccagatcatgtccagataagtacatccatcacattcttgatttgcaagagcaaggtgctccggttgggggaattggaattcaaggccacatagactgtccaatagggcctattgttagttcttccctggacaagttgggtattcttggcctacctatatggttcaccgagcttgacgtgtcttccgtcaacgaatacgttagagcagacgatctcgaagttatgctacgcgaagccatggctcatcctacggtggaaggcttaatgctgtggggattttgggagctgtttatgagtagggaccattcacatttggtcaatgcagaaggtgacatcaatgaggctgggaaaaggttcttagctctaaaacaagagtggctctctcacagccgtggccatgttgatgaacaaggccaatacaacttcagaggctttcatggaacatacaatgtgcaagttgtgacaccgtcaaagaaaatttcaaagacatttgtgcttgacaaaggtgactctccactagtggtatccattgatttataagcataatgcttcaccccaagaattaatatcatgtctcttttatattggtggtgttatgttatcttaaaatagttgggatttgagttgtctgggcaactgcacaaggtaccttt

SEQ ID NO: 659 - DNA, 1519 bp, Glycine max
aaactcgagagtgtggaggatcgtcttcttcatcccacccacacagagttcagttcagttaggatatctattttttaatggctaatagaccggatccggatattgatgatgattttcgtgagctttataaggagtacactggccccctggggactgctactacaaacatgcaagagagggcaaaatcaaataagaggtctaatgcagggtctgacgaggaggaggaagcccgggaccctaatgctgttccaactgatttcaccagccgagaagctaaggtttgggaggctaagtcaaaggctacggaaaggaattggaagaaaaggaaagaggaggaaatgatctgcaagctttgtggagaatcagggcatttcactcagggctgtccatctactctcggagcaaatcgaaagtctcaagatttctttgaaaggatacctgccagagacaaaaatgtacgggcacttttcacagagaaagttttaagcaagattgaaaaggatgttggctgcaaaattaagatggatgagaagtttattattgtcagtggtaaggatagattaattttggccaaaggtgttgatgctgtgcacaagattcgagaggagggtgatcaaaggggatcatctagttctcaaatgacccaatcaagatcacctgaaagaagtcctgttagtgctcggtttcaacgctctgagccccaaaggtctcattctggaccacgaaatacatctcagtttcaacaaaggtttggtaggcaagagagggctgttgaagaccgtatcagggatgatgttcaaaagttttctagaggttctccacaagcttatggaaatagtggagctagaggtcgttcaagccagtcaagatctccaaggcatgccccttatacaggaaactcatataattcatttgatgatcgtaatcaaaacatgggtgcttataggaatgaaggatgggattctcatagaagagaatctggtatccagcctggtcatcagtttgattacaacgcctccccacagactttagaagaattagagttggagtataagaacgaggcaacagagctaatgaaaattcgtgacagagaagaagatgaagaaaatttcaagcatcgtgaggctattagagatttgagggagaagtacatgagcaaagtttccttggtaagggtcacacatgcaaaacagttggaagaatttcttcagcttgatgcgcagaggcgtcgacagcaagtgagtcaacagatgtcttctggttatcggggttttaaacagcagagttttcctgaatatgatgggtccactgccaatcctcctacttatgctggttctaatataccattggaatcgaggaacaggttctcaggcaacatggaaacttatcctaataggcctcatgataattttggtgaatttcataggcgtggagattttgcaaaagcttacaacagatattaaaattctgtatatcaatcaagtgggtccagattgatcgagtaggcagtgaattcttt

SEQ ID NO: 660 - DNA, 449 bp, Solanum lycopersicum
agaagatgccgatgcgaccaacagggggattgaaacaagattgggatccaatcgtgctgcagaagccaaagatgaaggcccaagacctgaaggatccaaaaattgtgaatcaggcattgcgagctggagcacaagttcaaacggtgaagaaaatcgacgctggtttgaataagaaggcggcgacgttggcagttaatgtaagaaagctagatgaggcggcggaaccagcggcacttgagaaattgccggtgggtgtaaggcaagcaatacagaaagcgcggattgagaagaagatgagccaagctgatctagcgaagaagatcaatgaaaggacgcaggttgttgccgagtatgagaatggtaaggcagtgcctaatcaactagtgttggggaaaatggagaacgttcttggtgttaaacttagaggtaaaattcacaagtcatgataa

SEQ ID NO: 661 - DNA, 1023 bp, Solanum lycopersicum
aaagaattccaagaaccttgtgaagtagaaaatatgtatagatttagcaacacagtaataggtttcttgaatctattcacacttttagcatccattccgatcataggtgctggattatggatggcaaggagtagtacaacatgtgagaaatttcttcaaacaccacttttgttcataggtttcataatccttatagtttcattggctggtttcattggtgcttgtttccatgttgcatgggcactttggctctacttatttgtcatgttgttcctcataggggcattaatggggctaactgtttttggttttgtggtaacaagccaaggtggtggacttgatgtgcctggtaaagtatataaagagtatcatcttcaaaattactcaccatggttgagaaagaggattaaggatcctcaatattggctcactgttagagcttgtattttgggttccaagacttgtgctaatgttattacttggactccctatgattatcttacgaaagatttgactcctattcagtcaggatgttgcaagccaccaacagcatgcaactatggattgacaacaatgacacaagaggcagattgttaccaatggaacaatgatccaaatttgctatgctatgagtgtgattcatgcaaagctggagttcttgaagatgtgagaagggattggcaaaagatatcagttcttaacattgtcatgcttgtcttactcattggaatttactccattggttgttgtgcttttcaaaacaccaaaagggctgtatctgattatccacatggtgaaaaccgtatgtataaagtcagaccgagatgggatttctactggtggagatggtggcatgacaggagacatcagctttattagaccaaaacatggcacttcgtttggtccaaaagcaacatatcatcaaaagtgatgctaattagtattctctttgttttccaacaaatattaattcctagcagggttttttccacacctccttttctgtacaaatagggtaccttt

SEQ ID NO: 662 - DNA, 520 bp, Solanum lycopersicum
aaaggatccaaaacatatggggaaagcacgtataataggaattggaatggattattcagcaacaagcaaaatagctctaaaatgggcaattgataatttaattgaagaaggtgacacaattattattattcatgttgtttcttctaaagttgaaccaactagtaaacaactctttgaagatactggatcacctttgatacctttggatgaatttaaacagattaatgtgtctaagtactatggattaaatcctgacaaagaggttattgatatgcttgagcctgttgccaaactcaaaaaggtgacagtggtgtcaaaggtgtattggggagatgcaagagagaaactgtgtgatgctgctgaaagtctcaaacttgattcacttgtaattggaggcagaggcttaggagttcttaaaagggtgttacttggaagtgtcagtaactatgtggtgcaaaatgcaacatgtcctgttactgttgtgaaaaccagtcctcaaaagtgaaaataaggtaccttt

SEQ ID NO: 663 - DNA, 705 bp, Solanum lycopersicum
aaaggatccaagtgggttgacatgtggtagcaaatacagtgacagatcaacatcgcactacttttccttcttcttcatcaaaaaaaatccattttgaacccaattgctctctctatcactatattggtttttcaagaaactgtttaaccaagcaaaaatcttggagttgtaggtatggaaggaggtggtagatttgttggggtagcagtcgatttctcagcttgcagcaacaaagctctgaaatgggccattgataatattcttcgtaaaggggatcatcttattctcgtcactgttcgtcctgaaggacactatgaagaaggagagatgcagctctgggaggccactggttctcctttaatacctttatcagagatatgtgatggccacacaatgaagaggtatggggttaaccctgaccctgaaacattgcaaatgataacccttgcagctaggcagatggagatcacagtagtcatgaaaattttctggggagatgctcgagagaagttatgtgaagcaattgataaaactcccttgagctgtctggtcatagggaacagagggcttggaaagatcaagagggttattatgggcagtgtaagcaactatgtggtgaataatgctacgtgccctgttactgttgtgaagaatgcagaagactaattttacaatgtgcggaactccttaacttagggtaccttt

SEQ ID NO: 664 - DNA, 566 bp, Solanum lycopersicum
aaaaggcctcattcaaatttgtgtgcaatggctacgatgggaatgacgggaagtattgggggttatggagcagcttcagcgtctctgtttcgattgaggaactcagcgaagaagaagactagaaacggtaaaaatggatttagggtttcatgtgtttgttcatcttctgctgttgccgatccgtataagaccttgaagattcaacccggtgcatctgaatctgaagttaggaaggcgtttagacagcttgctcttaagtatcacccagacgtatgcagaggaaacaattgtggtgttcaatttcaccaaatcaacgaagcttacgatgtggtgatgagtaatttgagaggtgaaacaagagcagagctggagatgattgaggaatatgatgatagtaatgatgaatcaatgagaggaatgcatgaaccagattgggatttatgggaagagtggatgggatgggaaggtgctggcattcgtgactatacatcacatgttaatccttacatatgaatgttaaattaatgacttggggatgaaaacccaagaatgtaagagagctcttt

SEQ ID NO: 665 - DNA, 1801 bp, Solanum lycopersicum
aaaggatcctcctggccttatcttcatgttggtctctaaatgtccgctgaatcatatcctttttgaaccaagaatcagtagaggcggattcagatggaaagcaagtgcctccaatgaagttcctgttgagaagtggaagcaagatagcattttcattgatagacgcggcagatttagacaatttgatcacaaaaaagtttcacggaaaagatgtggttctttaaggggcagaggatggaaatatggatctggttttgttgatggtatattcccagttctaagcccaattgctcagcaaattctaacttttataaagacggaaaaagatccagagaggatttggtcttccttggatactctacgtcccaccaataacacttgggatgatctaatcaatgtagcagttcaacttcgactcaacaagcaatgggatctgatcatactgatgtgtgaatggatactgtgcaggagttcctttcaggcagatgtgatttgctacaatttgctcatagaagcttatgggcagagttcacttgttaagaaggcagaatctacttacctggcacttgttgatgctcgatgtgtcccgactgaagatacttatgcacttctcctgaaatcttattcgaaatgtaggatgatagaaaaggctgaagctgtcttctctgagatgcggaagaatggccttccttcaagtgctcttgtatataatgcttatattgatgggttaatgaagggaagaaattcgcaaaaagcattggcaatctttgataggatgaagcgtgaaagctgccaaccatctactgatacttatacaatgctgatcaacttatatgggaaggaaaataagtcctacatggcgctaaagatgttcaatgagatgaaagctcagaaatgtaaacctaatatctgtacctacacagctcttgtaaatgcatttgcgagaagtggcctatgtgaaaaggctgaagaagtctttgaagagctacaagaagctgggtttgagcctgatgtttacacctataatgccttgatggaagcttacagtcgtgcaggctaccctcagggtgctgcagagatcttttctctcatgcagcatatgggctgtgaaccagacacagcttcatacaatatcatggtggatgcctatggaagagctggtcttcatgaagatgcacaaactgtgtttgatgagatgacgcggctggggatagctcctacgatgaaatcctacatgttactcatatcagcctactctagaaacagtaacgtgtcaaaatgtgaagaaatcgtgaatcagatgcagaaatcaggagtgaaactagatacctttcttcttaacagcatgctcaacttgtatggtcgtcttggccagtttgctaaaatggaagaactcttgactgtcatagaagctggaccatacgtagccgatatcagcacctacaatatcttgatcaatgcatatggacgttcaggatttatcgtaaaaatggaagaagttttccaatcacttccttctaagaacctgcagccagatgtggttacatggacttcccgtcttggagcatactccaaaaagaaacagtaccaaagatgcttagaaatcttcgaggaaatgatcgatgaaggttgctatccagatggcggaacagccaaagtgctcctttcgtcttgttcaagtgaagatcagattgaacaagttacaacagtcattagatcaatgcacaagaatgtgaagacagtagagttagtttgacatggcttgtacagctttcatgacattcccatatagggtaccttt

SEQ ID NO: 666 - DNA, 736 bp, Solanum lycopersicum
gattcgataatgacaccaatgcccgccgatgacgtggaccaccgttctcattcaaatacttctacatagcttctgcgattccggtaccggcagaagctcgcagggagacggagaaatcgggcaaatggcgattaagctgtatacgagatctattgttttgattgttgttattgctttcttatcggttttgccagctacgctttgcatcgaagataaatgttctgcttgttccgccattgctgaggagctcgagcatggactattgaaagaaaagccaagaaaccatttagacatgagacatcgcctggattctaaaggtcagcgtgaagggaaacttattgattacagaggcagcgagttacgagtcgttgaacttttagatgacctttgtgaaaagatgcaagattatacactggagaaggtggattcaagcaccaacacttggatcaaagtaagcaattgggaccttctcaagactaataagcaagaagctcgagcacattcaaaagcgttgtcatccttttgtggaaggttactcgagcaaactgaagatgagttggcagagttgataaagaaaggatctgtccaagttggagatgtgaccaaggtattatgtgaagatctcagcaactattgcaaggggacaagcagctccaataaggcagtagatgatgaactttgacctgataaatcattttgtttccgtggctggttgatgaggtaaagaaagaggggt

SEQ ID NO: 667 - DNA, 1371 bp, Solanum lycopersicum
aaaggatccaacactctttcttgaatcttgaaactcaaaaaatggcttcactagttcaattccttcctctcttccctttctttttcttggtttcattctgtgtttctcatggaccctttttaccaaaagccattattctccctgtaaacaaagatccatctacttttcaatatgttactcaactctacatgggtgctactcatcgtgctcccatcaaattagttgtagatcttgaaggttcatttctatgggctgattgtgggttgacttctgattcttcaagtcaaaaacttgtaccttgtaattcactcaaatgttccatggctaagcctaatggttgtactaatgacaacaagatctgtggtttgaaatcagaaaacccctttacaagattagctgcaacaggggaattagcagaggatatgtttgctgtggagtttattgatgagttgaaaacgggctcagttgcttcaattcatcagttcttgttttcttgtacatcatctactctgttacaaggacttgctagaggtgctaaaggtatgttggggctaggaaattcaagaattgcattgccatctcagttgtctgatacatttggttttcaaaggaaatttgctatttgtttgtcttcttcaaatggtgctataatttctggtgaaagtccttatttgtcacttttgagccatgatgtttcaagatccatgctttatacacctttgatttcatctagaaatggggtttcagaagagtattacataaatgttaaatccctcaaaattaatggaaagaaactatctttgaacacaactttgcttaccatggatggggaaggtcaaggagggacaagaattagtaccatttccccttttacaactatgaagacctcaatttacaagacatttgttgaagcttatgaaagatttggtttttccatgggattgactaaagtagaacctatagcaccatttgggctttgctttagcacaaaactagaggagggactaaatgtgccaagtgttgatcttgtgttgcaaagtgagatggttaagtggaggatttatgagagtaattcaatggtgaaagtgagtgatgaagtgatgtgtttgggattcttggatggaggggctaaccaaaaggcatcaattgttatagggggtcaccaattggaggataatcttttggagtttaatttgggaacttctatgcttggatttacttcttcattgtcaatggtggaaactagctgttctgacttcatgttctcaaaggattcttcaccttttgattcttgacatgaatccttaaccaaagattgacaattcccttttgtatagttgtgttaagaacatgtattggctcggtaccttt

SEQ ID NO: 668 - DNA, 672 bp, Solanum lycopersicum
aaaggatccattccataatctctctctttctttgccttaattctttatatttacacccacccccactattttgtgagcttcatttcaaagttttgaatggagaatttgttgggtcttatgagagttcgtattcacagaggtattaatttggctattagagatgttactaccagcgatccttacgttgttgttaggatgggcaaacagaaattgaagactcgagtggtgaagaagaatctcaacccagaatggaatgaagaattaacactatctattaccgagccaattctcccaatcaaactgcatgtttatgacaaggatatattttctcttgacgataagatgggtgatgcagaagttgacatacagccatttatagatgcggcgagaaagcggtacaagaacatccctagtggaaccataatcacaaaaataaagccaagcaggcaaaattgtttctctgaagagagctccattgtgtgggaaaatgatcaggttgtacaaaatgtgtttattagattgcgaaatgttgagcgtggtgaaatagaactacaattgcagtggattgacattcctggttccaagggtgtgtagctaactactactatccatcaaatcatgtacagtcactatcctttattcatgttgtattctggtctgtagggtaccttt

SEQ ID NO: 669 - DNA, 1249 bp, Solanum lycopersicum
aaaggatccacgtttgaaacaaacaccaccaaatttggtgacgccccccatcttctttccaattttcacctaactatatattttcactctcacattataaaccctcaaaaaaatcaaaataaacacattttttctttccacaaatatggcttctttcttctgttcaaccaagttccttctactcctattttttctatctgcaattccaatcgcctttatcatccatctagaaacttcttctccgacgactcacgtttaccattatcacagtaccggctggttacgcgagtgttctaaatgggacgatgctaaccgccggttcattgtcagtttcttcgaaggtggtttgggtgtgattccggttgaggccgattattctcccggcgacgtactacaggaaatgccggtagtgaaagacgctgatttgaccggtaatgcgtcgctcggttttactatagaccgggaaaggaaccgggttttagtcgccgtcgcagatgttttggggaatcggtatagcgctttggctgcctatgatttgacattgtggaaccgggtttttctcaccaaacttagcggtccagaggatgaaaaagcatttgcggatgatgtggtggttgatacagaagggaatgcatatataacagatgcaaaagcagacaagatatggaaggtaggcgcgaatggtgaacttaaatatacaatcaagaactcaatatttactcctaaagagtggtacaataaactggttgggctaaacggaatagtgtatcatccaaacggatacttactggtggctcatacattctctggcaatttgttcaagattgaaatcgccaaaggtgatgaagttaaactagtaaagattgactatggatcgttgaaatttggcgatggcatggagttactatctccaaccaagcttgttgtggctggaaatccgacaagactagttgagagctctgatgattgggagagtggcactattgtggggaaggccaaaggcgctattcatcgtttaagtacagcagcaactgtgaaggaagggactgtttatcttaatcatatgattggtttgggatatcctaggaagaaacatgttcttgttgaagctgttttttctgcttaattattgttccatccatcccttttcatttgtgtgtaagagtcaattttatacttgattaccacactactaatttatgttcctcacataaagaacagttgtatcgcatcgtatcgtggtaccttt

SEQ ID NO: 670 - DNA, 1100 bp, Solanum lycopersicum
tttggatccttttcatggagcttattcccactcttccttatgatatcggactcgaatgtctaattcgagttccttataataatttctcgtcacttacttccgtcagtagaaactggaagcttcagattgagcttcccgagttttggaggcgaagaaaagctactggttcaacccgtcaggtgattttaatggcgcaagctcgaattgacccgagattaaaactcgggtcatttaagtactctgctttttcgttttacaagcttacgctttacgaaccggagtcgggtaattgggcggaattaccaccggttcctggaatttccgatgggctgccaatgttttgtcagctcgtcggagtgggattaaatctggtggtgatgggcgggtggaaccctctttcttgggaaccttcgaacgccgtttttgtttttagctttgtgtccgccacgtggcgacgtggagccgacatgcctggttgccggagatcatttttcggttgtgcgtcggattctgaacggacggtgtacgtcgccggaggtcacgacgaggagaaaaacgcactcaaatcggcgatggcgtatgacgtggcaagggatatgtgggtcccggtgcctgacatgacaagtgaaagagatgaatgtaaatgctccttttttgaaggtaaattccacgtcatcggtggatatgacacgagcatgcaaggccagttcggtacgagcgctgagtcattcgatccttccacgtggcagtgggaccaagtcaacgaacatttctttgaatctgccacgtgtccaagaacctgcgttgagggtggggacggcaaattgtacttgtgccgggacggtgatgtgctggcactcggtaagtctacgtggcaagctgtggcggcaattccgacggagctccggagcgtagcttttgtgacagcatggaggggtaaaattctgatgaccggttctatgggatttaatgaaccccacaatacatatgttcttgatttaaagagttataaatggaccaaaatggatactccggtgtacttttccggccacgttcaatccggctgctgcctggagatgtaaaaagagtaaggtaccaaa

SEQ ID NO: 671 - DNA, 726 bp, Solanum lycopersicum
aaagtcgacatttaagactgcagcaacggacagaaatgtcatttcacattccacagtccattttcaactacttttcttttcttctccatttttgccccaatcagtattcagtatcttctccgaccaatgagcaaagaaggaagtagaagaggagtaaaatggagctggacctccgccttcgtcggtgccgccgctgccgcagcaacggtgatgacactctcttcgaagccacgggatcctgattttcatctcatctccatcgatctcacttccttcaagctcaatttccccgtcgtagacgcggaactcatcctcaccgttcacgtgactaaccctaacgttacttcaatcaactactcctcaacagaaatgtcgattttctactccggcgatcacctcggttcagctcgtgtgaaagccggatctcagccgccgcgttcctgtcaggtactccgtcttccggcgaggttaagcggacttcaacttgcacatcacgggaaggaattcgtcgccgatgtagcgaagagggagatgttgctggatgctacggtggatatagaaggttttgcgaaggtgatgtggtgggaccataaattccgggtgcacgtggatagtcacgtgaccgtagacccggtttttcttgacgttattgatcaggaaaataaatcggctttagaggtctttgtgaaataacggttcagtccggttcagtgttagaggcctttt

SEQ ID NO: 672 - DNA, 1624 bp, Solanum lycopersicum
aaagtcgaccgtcggcagaagaagtaactctcttacgcggcctctgtaaggcatgccgggtccaacaatggaatcagaatttccagtggagccacaatcgctgaagaagctaagcttcaagtcccttaaacgatctcttgacttattttcacctatccatggccatttccctcttcctgaccctgaaagcaagaaagttcgaacgagctataagctaaatgtcgagtatggaggtataaaaggctcagcggctgaacctaacgccaaagcgggtgtgcagcatcaggctcaaccagcttctgcaccttccaatacccttgctcttccaggtcctgaaaatacaagagacgagaaaaccggaaatgaactggctcttggtccatccataccagggaatggcccgactgatgttaggttctcagggaaaagcaatgctgttgttccttctcacggttcatctgaaagaaatttgtcaactgctgcaatcatggaaagaattccaagcagatggcctcgtccaatatggcgtgctccatggaaaaattacagggttatcagtggccatttgggatgggtgaggtctgtcgcagtggatcctagtaatacttggttttgtacaggatcagcagatcgcactatcaagatatgggatttagcaagtggaagactgaagctcactttaacagggcacattgaacaagtccgaggccttgctgttagtaataaacacacatacatgttctctgctggtgatgataagctagttaaatgctgggacctggaacaaaataaggtgatccgctcctatcatggccacctcagcggtgtttattgcttggctcttcatccaaccattgacatcttgttcaccgggggtcgtgattctgtctgccgggtttgggatattcgtagcaaaatgcaaattcatgctctatctggacatgacaatactgtttgttctgtttttaccaggccgatggatccacaggttataactggctctcatgacagtaccattaagttctgggaccttagatatggtaagacaatggcaactctcacacatcacaagaaatctgttcgagctatggctcagcatcctacagaggattgttttgcttctgcatcagcagacaacataaaaaagttcagtcttccaaaaggagaatttatgcacaacatgctttcccaacagaaaaccatagtcaacgcgatggcaattaataatgacggtgtaatggtcactggaggtgacaatggaagcatgtggttttgggattggaaaagcggtcacaatttccagcaatctcaaactattgttcaacctgggtcactggacagtgaggctggcatttatgccctcacctacgatgtaaccggctcaaggctgatcagctgtgaagctgataagaccatcaagatgtggaaagaagacgaaactgctaccccagaaactcatcctcttcactttaagcctccaaaagacattaggcgtttctagttgtaatcgtaattcagaaagcaaccctttgtaatacatacaaatcgaacttcttctgtgcgtcgtttcggagtaagactgacccgataaaagcaccatgtccagagtagttcagatatcttt

SEQ ID NO: 673 - DNA, 2213 bp, Solanum lycopersicum
caataatggagctgcgttgcttgcagacactcaatatccctgcaactgctttagcagagaagccatttttgtgtggacacccaattacattgattcaaactagcactaaaaggggcccaaattccaaaaaccttaagacccttcgtttcagaactcaaatttcagcaaaaattagctcattggaacctcaaggaactgcaaaagatgtcaaatcaaaagatgcaaatcttgtttttgttgctggtgcaaccggtagggttggttctcggactgtaagggagcttctgaaattaggctttaaagttcgagctggagttcgaagtgctcaaagagctcaacctcttgtcaaaagtgttgagcagataaaacttgagaatgctacggatggaggagcaaaagctatagagaagcttgaaattgtggaatgcgatttggagaaaagttatcagattaggcctgcactgggcgatgcatcaattgttatatgttgcattggtgccagtgaaaaggagatctttgatgttactggaccatatcgaattgattacctggctactaagaaccttattgatgcagcaaccgtcgcaaaagttgaccactttatcttgctcacatctttgggaacaaacaaggtcggttttcctgcagcaattctcaatttgttttggggagtcctcctttggaaaaggaaagcagaagaggcactgcttgccagtgggcttccttatactattgtgagacctggaggaatggaacgtcccactgattcttttaaagaaactcacaatattactctttcggaggaagatactttatttggtggtctcgtgtcaaaccttcaggtggcagaactaatggcggttatggccaaaaaccggagcctttcatactgtaaagtggttgaagttgttgcagaaacaacagcaccgttgacccccatggaggaccttcttgcaaaaattcccccccaacgtgttgaggtttccccacccaaggaaactggtgatttacagaaatctgcaactccaaccagtattacgtctgagatccctgatgccttgctcgagaaaaaaccttctgaaacaaagttgaaagcagcagcacctctctctccatatactgcttatgcagagcttaaaccgcctacatctcctagtccgattcctcctggtggtcatcaagcaggtgcaagtggagcagaagatagcaaacccactaaaaaagcctcttctgttgttgattatgcttttgacaaagcagaattgctgactacaagaccttcgtctccatatgctgcttatgaagatttaaagccacctacatctcctagtccaaatcctcccggaggtcgtcaagaaggttcaagtggagcagaagatggtgaacctactaaagcagtttcttctgttgttgattctacttttgacaaagtagaattgctgactacaaggcctttgtctccatacactgcttatgaagatttaaagccacctacatctcctagtccaattcctcccggtggtcgtcaagaaggtgcaactggagcagaagacagcgaacacactaaggcagcctcttctgttgttgattctacttttgacaaagcagaattgctgactacaaggcctttgtctccatacactgcttatgaagatttaaagccacctacatctcctattccaattcctcccggtggtcgtcaagaaggtgcaagtggagcagaggatagcgaacacactaaggcagcctcttctgttgttgattctacttttgacaaagcagaattgctgactacaagttatgaagatctaaaaccacctacatcccctagtacaaatcctcctggaggtcgtcaagaaggtgcaagtggagcagagaataccaaacccactaaggaagcctcttctgtttatttatttacttttgacaaagcagagttggtgactacaaggcctttgtctccatacactgcttatgaagatttaaagccacctagatctccaagtccaagaccgagtggtttgaaatcctcagcaactgcggaagtaacatcagcagttactggaggcaacgatgtggcaatcgatagtgctaacaatttctccaaggaggattcatcaaaaagttcagctttctgtcattctccttaccctgcgtatgaggacttcaagcctccaagctctccaacgccatctttcaataaaatgtgatga

SEQ ID NO: 674 - DNA, 1876 bp, Solanum lycopersicum
aaagtcgacttccgctctatgcactaaaaccaatctcacatggctactcctctcaaaaataccaatagactctctcttgcaatggaaagaactggccaatgggtattttcacaagaaattccaactgatgttattgttgaagtaggtgaagcaaactttaatcttcacaagttcatgctagtagcaaagagcaattacataaggaaacttatacttgatactaaagaaagtgatgtaagtcgtataaacttgtctgatattcctggagggccagagatgtttgagaaggcagccaagttctgctatggagttaactttgaaatcacagtacataacgttgctgctcttcgttgtgctgctgaatatcttcaaatgactgataaatactgtgacaacaatctcgcaagcagaacagaggattttctagctcaagttgccttgactagcctttctggtgcacttgttgtgttaaagtcatgtgaaaatcttcttcctcttgcacatgatctcaatatcattcaaagatgtgttgacatcgccggtgctaaggcgtgtgtggaggcgaattttcctagcagatcaccaccaaattggtggacggaagagttaactatcttagatgtagcttttttcgagagaattattgttgcaatgaaaactcgtggggcaaaagcgttaaccatagcaagtgccataatcacatatacagagagatctcttcgtgatcttgtacgtgaccactcaggaaacaacacgagattaatggtaccagaggattcggatatgagaatgcatcaacgggaacttctagagtcgattgtgactctgttgcccgcggagagagcagcttttccaatcaatttcttgtgttgtctcctgcgtacagctattttcttaagagcagccagtagctgcaagaatgaattggagaaaaggatatcagcaatactagaacacgtgacagtcgatgatctgttagtcttgtctttttcttacgacggagaaagactattcgatcttgagagcgtgaggagaatcatttccggatttatggagaaagagaagagtgtagctgtgtttaaaggtggtgattttggagacgtttgtaccaccgctatgcagagagttgcaaagactgtcgatgcttatcttggtgaaatcgctacatttggagatctcagtatatcaaaattcaatggaattgctattttggttcctaagggcgcgagaaaggctgatgatgatctttatcgagctgttgatatctacttgaaggcacatccacatttggatgaaattgaaagagaaaaagtgtgtagtgtgatggatcctttgaaactatcacatgaagcaagagtccatgcttctcaaaacaaacgtttgccggtgcaaatagtccttcatgctctctatttcgatcaactaaagataaggagcggagcagcagatgatagtaataacaacatgcccgaagccatggcaacaaggaatcaattacaagctgatgtttccctcgtaaaggaaaatgaagttttgagaacggagttgctaaagatgaagatgtacatagcagatatacagaaaacaacaaattctagtcaaggaacatcaaaagggagtctgaagaagacaacattcttctcttctgtctccaaaacattaggcaaattcaatccctttaaacatggatcaaaggacacttctagtattgttgatgatgctgctctagatcttactaagcctaggagaagaagattttccatatcttaagctatttacattatttggtttaattttagttttatgttgtgtgaaaaaactatgattgattttgtactgtaaaggattgattgattatgttgtttgagaattcttt

SEQ ID NO: 675 - DNA, 2487 bp, Solanum lycopersicum
aaaggatccaactcaatccgctgccttattcattattggactttttgaatctggttgatgaggagcgttcggatggactcaattggtcccccaactaaaaggttggtggaactcaaccgtcatagcatacaggatggtcagaatggtgtaagggatgggattactggtgatggacaggggctttcagaagaagatgagtcaaggattaatgaggatgtcgaaggtgggaatgaaacacagagggatttgttacaagtgcaggctgttttacagacacagcagcaacagcccccagggcctttggttaggtgggagcgttttcttcctcttagatccctcaaggttctgctggtagaaaatgatgattcaactcgtcatgttgtcagtgcattgctgcgaaactgcagttatgaagttatagctgtgggatatgcccttgaagcatggaggattttagaagatctaactaaccatgttgatcttgttctgacggaggtggccatgccatttttgtctggtgttggtcttttgtcaaagattatgaaccacaaaactctcaagaatgtcccagtgattatgatgtctgctaatgactctatgggtatagtctttaagtgtttgtcaaagggcgcagttgactttttagtgaagcctattcgaaagaatgagcttaaaaatctgtggcagcatgtttggaggaaatgccatagttcaagcggaagtggaagtgaaagtggtatacaaactcaaaagtcgacgaaatctaaaagtgttgaaatgtcgggaaacaacactgatagcaatgatgaagctgagaatggaagctttgatctggacgacagggacggaagtgacaatggaagtggcactcagagttcgtggtctaaaagggccattgaagtcgacagcccccaacccatgtcaccatggaatgaattggcagatccccctgatagcacttgtgcccaggttatccattcaagaccagaagcacttagtgctacctgggtgcctgcaaatgccacaagaagatgtctcaatgagaaggatgaactgggaaatgttagaacggttaaagatttgaacatgggcgttgctaatgttccagagctcgaaggcctatcaggtaaagttatggatggtttagcagcttctatgaaggacaaacatttggagttagatcctaaagataatgagaatatgggtagaaacctaaagctgaacaaggaaacacgggaagatgacctgaaggacaaggatgttggttatatgggtgacataaccaacacatgtacgcctcaagtagaaagtactgccaatgaagttccaaatgatccttccaagatcacaaacatcaaagaaattgccacctatgacagtaaagacatgccttcacttgaacttagtttgaagcaacttcgagatgttggagagaatgggactggtgtgcaagagcgaaatatactcaggcattcagatctgtcagcgttctctaggtataatgctgcttcaactgctaatcaggctccaactggaaacgtgggcagctgttcaccagttaataatagttcagaagttgcaaaagcagaatcaattcacaacttgcaatccaagtcgagcagtacccctaatcagcgctcaaatggaagtagtaacaacaatgacatgggctcgtcgacaaataatttcttcatcaaaccagacacattaattgacaaaccaataaacaaacctgcagtcaatgcccattcctgttctgcatttcaaccagtgcaacatggacatacttcttctcttcaagcaatggttccaggaacacaagatactgcaaaggcagccgtgggccaagcaagagcaatgcaccagaagttccaagttcagcaccaccatcatcactaccatcaccatcaccaccatgtgcttagcttgcagcagcgacaacagctgcttaatgctgatgcttcgtctttgcgaaatgctgttgaaactgctcccgattgtggaacatctgacatggtaggtactcctgttgaaggaaatgctgctaattatggaagtgcatcaggaagtaacaatggaagcaatgggcaaaatggaagcagtggccaaaatgggagcagcactgctgtagttgctgaaggaaccaatttggttgctgaaaatgaaactggtgaaaaatgtgaaattggaagtgggagtggaagtgcaactagaagtggtgatcactcggctcaacgagaggctgctctgattaaattccggcaaaagaggaaggagagatgctttgagaagaaggtccggtaccagagtagaaagagacttgcagaacaaaggccacgcatgcgagggcaatttgtgcgtcaagatgcagacaaaagtaaaagcaacaatacaaattcctgacccctaccgtttgaattggatggttgatgtcaaatgagttcaagaagctttaactttgatcgcctaggtagggaggaattcttt

SEQ ID NO: 676 - DNA, 1183 bp, Solanum lycopersicum
aaagtcgacaagctagccgcagtgatatgattcaaaaccccaaacaattgatattatccacattccacatacatacaacagtgccaaagaagaagtggaatcccttttccatggctatctctacatccttttgccgccccatttcctctttcaatgctctcagttcaccgtctctctgttacttcaaacccttgtacaaccacttgaaacttgatccttctttgcccctagtcaagtgttgctcctctcacattggacaatctccagaacacatcaacggcaggcaacctgatttatctcctatagcttcttttggtgtcacaatgacaaataatggaacatctaaaccatcatatagatggcgtagggtactgcttaaagttagtggtgaggcactagcaggagatcaagcacaaaacattgatccaaagatcacaatggccattgcgagggaagtggcagctgtcactcgacttggcatcgaggttgcaatagttgttggtggaggtaatatttttcgtggatcctcctgggcaggaagtagtggactagatcgttcctctgctgattatattgggatgttggcaactgtaatgaatgcaatattcttacaagctacaatggagagcattggaatccccacaagagtccagactgcatttagaatgtcggaagttgctgaaccatatatccgtagaagggctgttaggcatctcgagaaagggagagtagtaatttttgcagcaggaactggaaatcccttcttcacgacagacactgctgcagcactgcgttgtgcagagattaatgctgaggtggtgttgaaggcaacaaatgttgatggagtctatgatgataaccctaagcataatcctaatgctcgtcttcaggataacctgacttaccatgatgttatttcaaaagagctctcagtgatggaccttactgcgattactttgtgccaagagaataacattccagttgtcgtttttaatctcaataaaacaggtaacattgccaaagccattaaaggagagagagttggcacattgattggtgacacatggaatacagaagcagtagtatcttaagagtacaaaatagttggtttcagcagatggaagttggatcactgttcgtagcatttcaacacactcagatagctcatttggcagaattcttt

SEQ ID NO: 677 - DNA, 744 bp, Solanum lycopersicum
gcacaaccattcatgtatttggataagactactactacactactagtcatttacaaagtaacacaaactcattaagcaaaattaattagctcatatggaaactctcatatgtattcaaatcccaaatctcttcattacaaactcatttccattgagtcaaaaactcccaatccattttcataaaagaataaacaggattccgaacctccaacgaaccacatggaaattgaatgccgaagcaaaaggcttcggcaatggaaaacctgaaatttcaaaaaagggaaacagaaggaataacaacaacaatgacgatagcgacgagaaaattccgacggagatatgggaaaggattatcggaaggattctgttttacgtcggagctccgttgatcggcggtgtgattttgctgcagattttcgatttaataaagcagcagaaactgttggatctgccaatttggttgccgtttttgacgacgtttatcacatttggggcttcagcacttggagctgcttatgggactttgtcagccagttgggatccggagaaacagggctcgtttattgggctagaagaagctcagaagaattgggttgatatgtgggctgaagatggtgctgatgaagaagaagaaaataggtggattaattaagaaatgtaaactaatgattattattctttaattgaataggtataattaaatccagattttttttgatcggtggttgtttattcgataagtgg

SEQ ID NO: 678 - DNA, 602 bp, Solanum lycopersicum
taacaatggcttccacaggtagccttttgtgcaaatgtagagtttcttctttgatgagtatctcttcttttcctttgatgcaacccataaccagaccagaaataacttactcccagagacatgtcagagtcggaacttcctctgtcctaaggaatgtatcccacaacatgagcatgaagaaagttccacgtatgatcaccagagctagctcagaaccgagtggcagtagcgatggagctcttggacagaataagacaccatttggatatacgagaaaggatgttatattgattggagttggagttacacttctaggggttggcttaaagagtggattggagttcttgggatttgaccctttacaagctggaaatgtcgttcaattagtcctggttttgggtctaacagttggatggatctcaacatacatcttccgggtttcaaacaaggaaatgacatatgctcaacaactacgagactacgaaagcaaagtcatggagaaacggttagagagcttaacagaagcggaattacaagtattgcttgagcaggttgaagaagagaagacccgcctgactagtggtgaagaggtcaaatagtaa

SEQ ID NO: 679 - DNA, 1731 bp, Solanum lycopersicum
aaaggatccgtggaaatcacacttcatccaggttttgcactcgttaatctgtttgaatttgttgtttttaggcttaaatctactgtttttagcttctgtgagaacttcacttgctgttatagatcttgaaagtttaagaaatcttaaagaaaaaaatggatatgaaggttttgaaatggcaatttattcatgggtcgttggtgaaacgtttgattgtgaaagggttcttgtttgttactgttatgattgttgtgtcatttgttcaaatgacacatatgattcagaaatctgagcctataatgttgaattttggtgtatgccctttgaactttgggtctaatgagtatatgaatgtgaccgggttcgttaaacctgtttctggattggggatttcgctgtttggagcttctttgatgaagcgggacgacgaaaaattgaccaaggatgtgtttaaggagctaatggaaaaggatttcttggatttgaatgctaatgcattgtgtgttggaaagaaatcgtcgtttgcagctttggtgctgcgagaattgggactcttgagtgctgttggtgttgatgcacacccgtatttctctcttgtatggagaagatttatgtacgagctcgatcatgagaacaattctttcgattttgtgttctcgagggatctggataaggtcactgtaccagctcttatggtgcttgagattgagcgtgtcttacgtccagggggcaccggtgttatgctcgtgggttctagtagtttctacgcgggtaacttggtaaaaggcaacttgataaggtctgccaccccagtttcgtcgttcttgaagagttctgatgttgtgcacgtatgtggggttggcacgtatactctagtgatgttcaagaaacgatcagagattgttcaatctctcgtgcactctgtgctgcctgctaattgtccttccaatgtgaacaacaagccgtacttgaagcaccttgagccactcgtggaaaagaagcttggacagtttgagacacaaatctcatacttgcccaagttcatgaacatctcatctaggaacaaactggtgtatatcaacgttggtgcaggggaattcgtagaatcaactcttgcaagaacattcaagcctcattatccaatccctcaccacttgttcaatgttttcgtcattgatcataacacctccacactgtccttatatgtgaagaatcctggtattaactttgtgtaccatcctggacttgctgtcgccggagagactactttgtcatctgttgacactgacgaatatttgggtgcaccactagatcatgaaggattcgacttcattcattggtttagtgaaacagttaaagacggagactatgtcatcctcatgatgaatgctagagcaccagagctaaacattctagcagaactattccaaactggatcaatatgccacgtcgatgagctgttccttcgctgctcggctgcagattgcagaaatgctctttgtggagactgcatgagccttttcaaaactctaaggagaagtggtgtgtttgctcatcaatggtggggagactagagtgttgtcaagagttttaagtgcattttatgttgtcttgtgttcaacttttgctttagtgtctgttgggaataaattgaggggaggttgtaggttgaaagttgatacagtaatcttactttctcccttgtggaactgcacttgatgtggtaccttt

SEQ ID NO: 680 - DNA, 794 bp, Solanum lycopersicum
gaggaatggcgtcgttgtctggccttagcgaggagcttggggaaatcgaaggacagatttcggatatttttcgagctctttcaaatgggtttcagaaattggagaagattaaggattcgaataggcagagcaggcagttggaggagctaacaggaaagatgcgagaatgtaagaggcttatcaaggaatttgacagagaagtaaaggatttggaatataaaagtgacgcagataccaccaagatgctgagtgagaaaaaacaatcaatgatcaaagagttgaactcttatgttgctctgaaaaaacaatacgcaagcaatattgagaacaagcgagtagatctttttgagggtcccggtgaagggtttgctgaagagaatggcttgctagcttcaaatatgagcaatcaacagctgatggatcaaggaaataggatgatggatgagacagatgaagccattgagaggtcaaaaaaggtggttcatgaaactgtaaatgttggaaccgagactgctgcagcactgaaggctcagactgaacaaatgagtcggatagtcaatgagctagactcaatccatttttcaataaagaaggctacacaattggtcaaggaactcggtaggcaggttgccactgatcgttgtattatggccttgctctttctgattgtgattggggtcatagcaatcattattgtgaagattgtaaacccacataacaaagacatccgggacatccctggattagcccctccagcacccagtcgacggttacttgcttatccttactgatga

SEQ ID NO: 681 - DNA, 1197 bp, Solanum lycopersicum
aaaggatccgcaacttcacttgctctctcctacttctttcttagcaactttcccccttcataaatccatttatatgctcacacacacacatatttcacaaaattaattaccaattttgtcatcattgaagtttcacaaaatggagaaagttaaaagtatggagaaaaagaaattgattaatgagttaacacaagggaaggaatttgtaaaccaattgaaaaatcagataattggtccattagcttctcctgaggaatgtgatttactaattgggaaaatattgtctacacttgaaaaatcattatcaattctcaatttgaaggctcttcttcttgaaggtggaattaataatattaacaattctacatcttcatgttcatcgatttcatttcttggtagtagtaataataatattagtcccaagagtgaagtttttgattcttcaagggaaaaattggacaaaaatatggtctccaagaaaagaaagaaaacacaacaatggattaatcaaacaagcatttctgtaaatgggcttgaaggtccatgtgaagatggatttagttggagaaaatatggccaaaaagatattttaggggctagtcatccaagggcttattataggtgtactcataggaacacacaggggtgtttggctacaaaacaagtccaaaaatcagatgcaaattcaacaatttttgaagtgacatataaaggaaggcacagttgcaaagttgcacaatctgaaatattttcacttaataaccaaaaacgccagaaatgcaacaaaaaacaacaagaagaaatggtaatattcaactctgcaacaccaaaccataacgctgaaaactttaacattataacagcaaaagatgaagaggttttcacggcgttcccattccctcctgcaccactacacatcgaaaatattatcgaagaaaataaattctttccagattcgtcagagttaccattatacttggcgtccccaaatgatgaatttggaatggaacacatgattctacagagctcagattcagatcttactgaattgatatcaactccgacttcgatttcaaattcctcatttggtggagaaggggtggattatgaacctgaaatcacatttgacattgaagaattcttcatttaatttgaaatttagagaattcattgcaagtttgtaatagcggtaccttt

SEQ ID NO: 682 - DNA, 866 bp, Solanum lycopersicum
aaaatatgggatctgggcatatatttttcgacccgtcgtcgtgtcacggcaacatgctgttccttgggagcggagatcctgttttccgaggaccaagatcgacgatgatgaagatggaggactcctcgaagaggcgacccttctttagctcgccggaggatctatatgacgaggaatactacgacgagcagtcaccggagaagaagcgccgtctcactcctgagcaggtgcacttgttggagaagagctttgagacagaaaacaagctggagcccgagcgcaaaacccagctggccaaaaagctggggctgcagcccagacaggtggctgtatggttccaaaaccgccgtgcccggtggaagaccaagcagctcgagagggattatgatcagctcaaatcctcttatgactcccttctctctgattttgactccgttcgcaaagataacgataagctcaaatctgaggttgtttcattgatggaaaagttacaggggaaagtggttggaggagcagggggaaatgaaaaatctgacatcttggaggtggatgctatgacgatccttcaagtgaaggtgaaggctgaggaccggttgagcagtggcagtggtgggagcgcggtggtagatgagcatagtccacagctggtggacagtggggactcatattttcacactgatcatgaggagtatccagggcctggaggatgcaatgttcctccacccatggatggtttacaatcggaggaagatgatggtagtgatgatcatggcagttgccatggctacttctctaacgtctttgtggcagaagagcagcaccatgaacaaggagaagagcctattggatggttctggtcttaataa

SEQ ID NO: 683 - DNA, 1619 bp, Solanum lycopersicum
aggaaatggattctgcagccatgactagcgtttgtggcaaatctgctctttgctctactcccggtttatttttggggagaacgaacggtattaggagctcgcagtgtagctttatagctggaaataggataaactttccaaggcagacagctcaagcacacagagttcgtactaattctcgcaagggtcatggtgctcttactgtgacatgccgcgccgagaaaattctggtggcaaatagaggagagattgctgttcgcgtgatccgaactgcccatgagatgggaattccttgtgttgcggtttattcgaccattgataaagatgccttacatgtgaagctagctgatgaatctgtttgcattggagaagcaccaagtaatcagtcgtatttagtgatcccaaatgtcttgtctgctgctatcagtcgcggatgtacaatgttgcatcctggatatggtttcctttctgagaatgcaagttttgttgagatgtgcagagaacatggaatcaactttattgggccaaatccagacagcataagagtcatgggtgacaaagccactgctagagatacaatgaagaatgctggtgttccaactgtaccaggaagtgacggactattgcagagtactgaagaaggtgtaaagcttgccgaggagattggttaccccgtgatgattaaggcaacagctggtggtggtggacgtggaatgcgtcttgctaaagaacctaatgagttcgtaaaattattgcagcaagctaagagtgaagcagcagctgcatttggaaatgatggcgtttatctggagaagtacatcgtaaatcccaggcacattgaatttcaggttttggcggacaagtatggtaatgttgtacactttggagagcgtgattgcagtattcagagaagaaaccaaaagttgctggaggaagcaccatccccggcattgacaccagagctgaggaaagccatgggtgatgcagctgtggcagcagcagcatctataggttacattggtgttggaaccatagagttcctattggatgagagaggctccttttacttcatggaaatgaacactcgtattcaggtagagcatccggtgacagaaatgatatcctctgttgatctgatagaggaacagatccgtgtcgctatgggagaaaagctccgatacaaacaggaggatattgtgcttagaggacattcaattgaatgccgtataaacgcagaagatgctttcaaaaacttcagacccggcccagggagaatcacttcatatttaccagctggaggtccatttacgcgtatggatagccatgtttatcctgactatgtggttccacctagctacgattccctgctaggaaagctcatcgtatgggctccaacacgcgagagggctattgagcgcatgaaaagagcacttgatgacaccgttatcactggagttcctaccacaatagaatatcataaactcatccttgatatcgaggactttaagaacgggaaagttgatactgctttcattccaaagcatgaggaagagttagctccgcctcagcaaattgttccagcagcaagcaaggagctgatcaatgccaatgcttaataa

SEQ ID NO: 684 - DNA, 884 bp, Solanum lycopersicum
ttaatatgatgacttcaagggttatttttactattccttatttctcttttccatccatttccaataaatccccataccctaaactaattcctgatacatctgctcccatttgttatgctatttgttgctcaacttcaactcctggattaccagttacaacagaaatacttaggaatgatactcctttgactggtggagcatttgattttgaaaatgccactacttctctaactaaaagagtgttagcttcaccgaagaaagttactattgtacgccatgggctcagctcttggaatgaagaaagtagagttcagggaagctcaaacttatctatactctctgaaaaaggaacaatgcaagcagaaagatgcaagatggccttgtccgatatacactttgaccaatgtttctctagtccgatatcacgcgccaagacgaccgctgaaatcatatggaaagggaaggaagagcctctggtttttcttgattccctgaaggaagcccatctattttttcttgaaggcatgaaaaatgaggatgctaagcgcatatatccaaaggagtatacaacttggagagaagatccatctaagttttgtgtagatggtgtatatcctcttcaaaaactgtggggaagagcacatgaagcatgggaagaaattttattgacaccgggagagcactttttggttgtgacacacaaatctattttacgagcattgatctgcacagctcttggactaggaccagaacggtttcgttcagtggatataaataatggaggattatgtgtattcaaattcaacaaagaaggagaagccatgcttcaatccctgaacatgacagcacatatgtatactgatcacgtctaccactattaataa

SEQ ID NO: 685 - DNA, 1310 bp, Solanum lycopersicum
aaaggatcctgcacttgtgaccttgcaatagtagtgctttcaaagaggttgagctttgttgaaagtacacaatggaggcagtacgtgaactctacaacagagccaaaccctttcttgcagtcatttttctccaatttgggctagcaggcatggatattctcaccaaagtggccttgaatgaaggaatgagtaactatgtatttgttgtgtaccgccatgcagttgccactttggttattgctccttttgcaataattctagacaagaaagtaagaccaaagatgaccccctcaatatttgctaagttggtacttcttagcttactggagcctgtcatcgaccagaatctctactctattggcctgaaatacacaacagcaacgtttgcagctgcaatgtgcaacattcttcctgccattacttttataatggcctggatattcaggcttgagaaggtgaagcttacaagcatccgcagccaagccaaaatagttgggactgttgccacagtggcaggagccatgatcatgacactggtacgaggtccaatagttgaactattttggacaacaggaaatgccggtcataactctcaaagtggtgggttaaatctaagccatgctatcaaaggttccatcatgataacaattgggtgcttcagttgggctgcattcatgattttgcaggcaatcacactgcggacttatcccgctgagctctcgctcactgcttggatatgcttgttgggaacaactgagggagccatagtagcaatggtaatggagagaggaaaacctgcagtgtgggccataaactgggactctaagtttcttgcagctgtatacagtggaatattctgttcaggactcgcgtattatattcaaggagtcataatgaaagacaggggccctgtttttgtcacagctttcaatccattaagcatggttattgtagctgtattgagtacaattattctacgtgaacaactgaacctgggaagggtactcggtgctgttgtgattgttgttggactttacattgtcctatggggtaaaagtaaggatcacaaatctccatcaatcgatgaacaagcaataccaacacatgaaaccaaaattgacaaggaaccttttagtcagacagttacccacatcaattcatcgaaaggaacaactgctaccgaagatgaaggcatataatgattttctatttgaggctttgtcttccaaattccaaaaggaggtctggctatagagcagcctcttcatctaagaaatgagctcctcttcagctgcatcttgggtaccttt

SEQ ID NO: 686 - DNA, 1300 bp, Solanum lycopersicum
atttcaccgctgctcctcaccgggaaaatgaacactccggcactttctctccgtcacaaccatttcctcaatggcagctccgctctggtatccggcattcgtctaccacgctcctcctcttcccctttccgtgtccgtatgtctctccaggaaaacggtccatccgtcgccgtcgtcggtgttactggcgccgtcggtcaagagtttctatccgttctatctgaccgtaacttcccgtaccgttctcttaaactccttgctagcaaaagatcagctggaaaatcgatgaagtttgaggaacgagattatactgttgaagagctcactgaggatagttttgatggtatagatattgcattgtttagtgctggtggttcaattagtaagaaatttggacccttggctgctcaaaagggaacaattgtagtggataatagctccgcttttcggatggatgagaatgtgcctcttgtgattccagaagtgaatcctgaagctatggcacatgtcaagcttggttctggaaagggagctcttattgcgaatccgaattgctctactattatttgcttgatggctgttactcctctccatcgtcgtgctaaagtcaaacgcatggttgttagtacatatcaggcagctagtggtgctggtgctgctgcaatggaagagctagtgcagcagactcgtgaggtcctggagggaaaagaaccaacctgcaatatctttaaccagcagtatgcttttaatcttttctcacataatgcacctgttcaacccaatggatataatgaagaggaaatgaagctggtcaaagaaacaagaaaaatatggagtgacaaggatgtcaaggttactgcaacatgtatacgtgttcctgttatgcgtgcacatgctgaaagcgtgaatcttcaatttgagaatcccctcgatgagaatactgcaagggatattcttaaaaatgcaccaggtatagttgtagtcgatgaccgtgcaagtaatagattcccaaccccacttgaagtttccaataaagacgatgttgcagttgggagagtacgtcgtgatgtttctcaagatggagattatgggctggacatctttgtttgtggtgatcaaatacgcaaaggagccgcccttaatgctatccagattgcagaaatgttgttgtagatttgcgatatagcacccttaaaggttctaattttggctccaaatgtgagagacagagaatcttaaaggtagtattcctttagcattacattttgctcagcaaaacttgggaatcctcatttacgtt

SEQ ID NO: 687 - DNA, 1106 bp, Solanum lycopersicum
aaaggatcctgccttttatacactctgcactctctcttaaattctcttccatcaatactactactttctatctttcattcttatggcatcctctccacctgatcaagaacaacaaccacctcaatttcctccacttcactacaggacatgggttttgaaagtttccatccattgtccaggctgcaagagaaaagtcaagaaagtcttgcaaagcattgaaggtgtttatactacggatattgatccacaacaacagaaagttatagtgactggaaatgttgaagctgaaactttgataaaaaaactgataaggaatggaagaagtgctgagttatggccagagccgaagcctatattaaaagagaaaaaaccaaagaaaaatgaaaacagcgaagacgacgatgatgatcatgaagatgatgaacataataataataataataatgaaaaaccagctgaacatggtcctccaagacatggtgtgaggtttggcggggttgagacttttacgatggatgtcaaagaagtaaggccagatgaaaggccgccggaaaatatcgccgtcgttgagaggttcccggcgccggagcaaaaggccggcggcggtggaggagctaagaaaaagaagaaaaagaaaaagaagaagagtagtagtgggaataacaatgcaaatccaaatgcgagtgcagggtctaatggtgcaccgccaggtagcgaatcagatgctgcgaaaatgggtcccaatcagatgatggatcaagcgaatcaaggccattcaaatcagcatccttatcctaacccgtgtgatcagcatccacacgctagttattatgttcctcagcagcatcagagttatattgtgagttacaacgcggcacatcctatggtaagcagtgcgccggcatattactatgttccatcatcaccgtacatgcaatctgatatttattctaagcaacaatgtacaccgttagattcttttgagatcttgagtgatgaaaaccctcatgcttgctatatcatgtgatcaaagttgatgtggaattttgtatattaagacaaaatagtattcgaattttggcaggaaattagagttcggtaccttt

SEQ ID NO: 688 - DNA, 3412 bp, Solanum lycopersicum
tgtaaagacaccacctattcttggcaatttccaaataaaaatggcgaaaaagcaaaatgattcttcaagattttcaacaaatcttactccatctccccaaaaagacaaacccatttcatcttcatcagaattagctctgttttaccctcaaaatgaagaaccagttccattgatagtgttttatccatcatcagtcaggagaagatcttctagattcactaccaacaaattcagtactagtgctactgaattcatgacgaaaaatcgggacaccatttcccctgaaaaaactgtttttcttcttccatcaccacctacattggccggaaaaaaaactccggcggaagttacgaggaggtcgccgagattggtatcactgtcagctaggacaacgacggcgaaggagaagggcaaaaaagtaaattcaaggaaatcggagggtggaataaaacaagtggaactatcgaggaagcggaaaccggcaagttgtaaaatggatgaagaaacccgaaaatctccgaggttcaattccgattcctcaaatggagttcaactagcactgccggagatgagcgcgtgcggtgcactctccgccggcggaagaaccggcacgaagagggaactgctggctctgatgacgacgacgccggcgaacagcagcgcgtcgaggaaacgcgctgccagggggagtgattcagtaaatgtagggaacaattcacgaggatcccggaggaaagatccagtttttgctgaatcgccgggaacatcggtaaaaataacggctgagagcaattcagcgggagagaagaatttaagatcgagaaaagcacaagggagtgttaattataatgagagtaaaggatcggaaacgaaacggataaaaagttcagcagagaaaagtgtgaggaagcagaagagtaatgcatgttttatcggtgagccgatagatacagaggaagctcaacagcaatggcaatggcgatacgaattgaagaatcgaaaaacgcagcgccaagggtggaaattaaattccggcgaagaagatgaaatcatattaaatgtggaatgccattatgctcaagctaaggttgctggtttcattttcaatattggagattgtgcatttgtaaagggtgaaggcaagaaaaaacatattggcaggatcttggagtttttcaagacgacagagggggaagattattttagggtacaatggttcttcagagctgaagatacggtgttgcaaggtgcggcttctttccatgacccaaagcgcgtattctattctactttggagaatgataatttactagactgcatagtttccaaagttaacgtggtagaattaccaaccaggcatgatttgaataaaaaggatgttccacctgctcacttttattacgacatggaatactgtgttgattattccacattccgtacgttgcataatgtcaaaagctctgtctccccttcgctagttgatgtgtcatataagcctatcactacatatcctctggaggtatcaccaagttgtgaacctatgaaagtggagttgtcattattggatctatatgctggttgtggcggcatgtcaatgggattgtgccttggcacaaaactctctggtcttaatcttgtgacgaaatgggcagttgattttaataaagctgcctgtgatagcctgaaactgaatcatcctcagacacatgttaggaatgaaggtgttgagaattttctggagctactgaaaagatgggagaagctaattaagtcgtacggctgtagtgatatcaaaacaagctctaatattgagctagacgacagagatgaaggcgaaaacaatgatgattctcagtctggttccaatgcatcttctggagaatatgaggtattaagattcgttgacatatgttacggggatcccaacaatgacggaaaatctggacttcattttaaggtgcgatggaaaggttatggtccgagtgaagatacttgggagccaattgagaacttgaaaaattgcggagacagtataaaagattttgttcgaagggggcaacagttgaaaattctgcctctaccaggtgacgttgatatgatatgtgggggtcctccttgccagggcatcagtggatataatcgccacagaaatactgatgacccattgtctgatgaaaaaaatcgtcaaattattatatttatggatgttgtggaattcctacggcctaaatatgtgttgatggaaaatgttgctgacatattgaggttcgataaagcatctcttggaagatatgctttaagccgtttggtacatatgagataccaagcaagacttggaactatggcagctggttgttatggtcttccacaattccgattgcgagttttcttttggggtgcacttccaagtgagaggttgcccccatttccacttccttcgcatgacgtgattgttaaatattggccctcacctgaatttgagcgtaatactgttgcttatgaggaaggacaaccacgtgaccttgaggaagctcttgttcttcgtgatgcgatatctgatatgccagctgtcacatggcatgaaactcgtgaagaaaggccatatgagatgccccctgaaacagagttccagaaatacataagattatctaaacatgagatactgagttgtacatcaactggagtcaaggaaacaaaagaacctgttttgtctgatcatcggccttgccaactaaacgaggacgattacttgcgagtttgtctagtcccacgtagaaagggagcaaatttcagggacctccctggtgtaattgtaggaggtgataatgtggctcgtcgtgatactaaagatccaaaggttctaccaaacggaaagcccatggttcctgactgtgccttcaactttgagcatggaaagtctaagaggccatttgcaaggttgtggtgggatgaaacagtagcaacattagtgacgtttcctaatcatcgcgcccaggctatcttacacccagagcaagatcgagtactgaccatacgagagtatgcaagattgcaaggttttccagatttctataggtttactggtactctcaaggaaagatattgccaagttgggaatgctgtagcagttcctgttggtcgcgcacttgggtacgcgcttggacttgcctatcagaggctagctggaaatgagcctcttattaaattgccatcaaatttctcattcttaacacctccaattgatgacattgttgtcttgcaaacataagctcatattcatcatttttttcctcaattggcgatttcggagctactgctgatacttagcagattactccatttttctagtatgaacttctatttaacagaacagatactagactggggcagccaagttgattaatttattgat

SEQ ID NO: 689 - DNA, 1022 bp, Solanum lycopersicum
attccatggaaaccaaagttatttctagcggaatccaccactctactcttcctcaaagttacatccgacccgaatccgacagaccacgtctatcggaagtagtcgattgtgaaaatgttccaataattgacttaggttgcggagatcaagctcaaataattcgtcaaattggagaagcttgtcaaacttatggtttcttccaggtaattaatcatggtgtaccaaaggaagttgtagagaaaatgctaggggtagctggggaattcttcaatttgccagtagaagagaaactaaaattatattcagatgatccttcaaagaccatgagactatcaacaagttttaatgttaaaaaggagacagttcataattggagagattatctcagacttcattgttatcctctagagaagtatgctcctgaatggccttctaatccatcatctttcagggaaatcgtgagcagatattgcatggaaattcgacaactcggatttagattagaagaagccatagcagaaagccttggcttagagaaggagtgtataaaagatgtattgggtgaacaaggacaacatatggctatcaatttttatcctccttgtccacaaccagaacttacttatgggcttccggcccatactgacccaaattcacttacaattcttcttcaagacttgcaagttgctggtcttcaagttcttaaagatggtaaatggttagctgtaaaacctcaacctgacgcctttgtcattaatcttggtgatcaattgcaggccgtaagtaacggtaagtacaaaagtgtatggcatcgagctattgtgaattcagatcaagctaggatgtcagtggcttcgtttctatgtccgtgtgatagcgcgaaaatcagtgcaccaaaacttctgacagaagatggatctccagctatttatcaagactttacgtatgctgagtattacaacaagttctggagcaggaatttggaccagcaacattgtttggaacttttcaagaactaataa

SEQ ID NO: 690 - DNA, 7051 bp, Solanum lycopersicum
catcttgaacaacggatctgagaccttcttgagtttttaagaatcttggttcctgtataacgttttgtttttgttgatattcgataaagatctcgactttaatattatatatatacaaaaatctatcttaaaaactggtaaagatttgaacttgggtgtttttgaatatgtcgattgcttcgagttctgtacttcagtccaagaacaatggcgttgttatgtcatcgccggttaagagtctcgtggggcatcaattgaatgctatgcctttgggtagggttggtgttggtctcgggagaactagggtgacgaggagctcggtagtgaagaggactaccggtttcgagaaaaagttttatggagccaagcttcgggcttccgggccggaaaggctgcacctttggcaatctgacgggccgggtcgggctccgaagctaagggtcgtggtgcgttctgcattgtctcaggtgccggagaagcctcttggactctacgatccatcatttgataaggactcttgtggcgttgggtttgttgctgaactttccggtgaaagtagccggaaaacggttgctgatgctattgagatgttagtgcggatgtctcatagaggcgcgtgtggttgtgagactaatactggagatggagccggtattcttgttggtttgcctcatgacttctacaaggaggtaactagtgaggcgggatttgagataccaccacctggacaatatgcagttggtatgttcttcctgcctacctctgacagtagaagggagcaaagcaagattgtatttactaaggtggctgagtcacttggtcatacagttcttggatggcgtccagtccctacagataattcaggactgggcaagtctgcattgcagactgagcctatcattgagcaagtgtttctgacaccaactcctaggtcaaaggtcgactttgaacgtcagatgtatattttgaggagggtggcaatggtagctatacgagctgctttaaacctccaacatggtggcgtgaaagatttctatgtatgctctctttcttcaaggactgttgtttacaaaggtcagttgaagcctaatcagttgaaggaatactacttcgcagatttgggcaatgaaaggtttacgagctacatggccctggtgcattctaggttctctacaaatacctttcctagttgggatcgtgctcagcctatgcgtgtcttgggtcataatggtgaaattaacacacttcgaggcaatgtgaactggatgagggctcgtgagggtcttcttaaatgcaaagagcttggcctttcaaagacagaaatgaaaaaacttttgcccattgttgatgccagttcatctgactcaggagcttttgatggtgtgcttgagctactgcttagagctggtagaagcctcccagaagctgtaatgatgatgattcctgaagcctggcaaaatgacaaaaacatggatcctagccggaaggcattgtatgaatatttttcagccctcatggaaccatgggatggacctgctcttatgtcatttactgatgggcgctatcttggagctacgttagatcggaatggtctgcgtccaggtcgcttttatgttacatacagtggtagggttattatggcaagtgaagttggagtagttgatattccacctgaagatgtatccaggaaaggtagactaaaccctggaatgatgcttctggtggactttgagaaccatgttgttgtagatgacgatgctttgaagaagcagtactctcttgcaagaccttatggacagtggctgaaaaagcagaagatagagctgaaagacattgttgagtcagtaaattattcctatagggtacctccacccattgcaggagttttgcctgcggtaagtgatgaggacagtatggaaaatatgggacttcacggtttattggctccattaaaggccttcggttacactacagaggccttagaaatgctgctactcccaatggcaaaagatggtgttgaggctcttggttcaatggggaatgatgctccattagcagtgatgtctaatagagagaaacttacatttgagtatttcaagcagatgtttgctcaagtcacaaaccctcctattgaccctatcagggaaaaaattgttacgtctatgcaatgtatggttggtcctgaaggagatcttactgaaaccacggaagaacagtgtcaccggctctcactcaaaggacctcttttgtccattgaagaaatggaagctgtaaagaagatgaactacagagggtggcgcagtaaggttcttgatattacctactccagagaccgtggtacaaaaggtctagaggagaccctagacaggatttgctctgaagcgcatgatgcaattcaggagggttatacagcaatcgtactttctgacagaggcttctcgccgaagcgtgttgctgtgagctctttattagctattggtgctgtccatcatcatttagttaaaaagcttgagcgaactcgagtcgcattgattgttgaatctgccgagccacgagaagtgcaccatttctgtacattggtaggatttggtgctgatgctatctgcccttatttagccgtagaagctatatggagactacaggttgatggaaaaatcccacccaagtcaaccggtgagtttcattccaaggatgagcttgtcaagaaatacttcaaagcaagtcactatggcatgatgaaggttcttgcaaaaatgggcatatcaacattggcatcgtacaagggtgctcagatatttgaggctgttggtctttcgtcagaagtgatggagcgatgtttcaatggaactcctagcagagtggagggtgcaacttttgaggcacttgccaaagatgcactcaatctgcatggacttgcatttccatcacgggccttggctccaggaagtgcagaagctgtggcactccctaatcctggtgattatcattggagaaagggtggtgagattcaccttaacgatccatttgccattgcaaaattgcaggaggctgcgcaatctaatagtgtagctgcctacaaagaatattctaagcgtgtacaggaattaaatagacaatgcaatttgaggggacttttgaaattcaaagagggagaggttaaagttcctctagaagaagttgaaccggcaagtgagattgtaaaacgtttttgtactggagccatgagttatggatcaatctccttggaggcacacgctactcttgcaatagcaatgaacaagattggaggcaaatctaacacaggcgagggtggtgagcaaccttctcggatggaacctcttcccaatggtacaaagaacccaaaaagaagtgcaattaagcaggttgcaagtggtagatttggagtctcaagttattaccttacaaatgctgacgagctacagataaagatggctcagggagctaagcctggagaagggggtgaacttcctggacacaaggtcattggcgacattgctgtcactaggaactccacagctggagttggactaattagccctcctcctcatcatgatatctactcaattgaggatcttgcacagttgattcatgatcttaagaatgcaaaccctggggcacgtgttagtgtcaagttggtttctgaagctggtgttggggttatagccagcggcgttgtcaagggacatgctgatcatgtcttgatctccggtcatgatggagggactggtgcctcaagatggactggcatcaagagtgctgggcttccatgggaacttggtcttgcagagacgcatcaaactttagtggctaacgacctccgtggtcgaacagtgctgcaaacagatggtcaattgaaaactggaagagatgtagccattgctgctcttcttggtgcagaggagtttggtttcagcactgctcccctcataacacttggctgcataatgatgagaaaatgccacaaaaacacttgccctgtggggattgccactcaagatccaattcttcgggagaagtttgctggagaaccagaacatgtcataaatttctttttcatgctggcagaggaagtgagagaaattatgtctcaacttggtttcagagcacttactgaaatggttggccgttcagacatgcttgaaatggacaatgatttagtcaagaacaatgacaaattgaagaatattgatctgtccctactgcttcgacctgctgctgatatccggcctgaagctgcccaatattgtatacagaaacaggatcatggtttggacatggctttagataacaatttaatagccctttccaaggctgctttagagagaagtcttcctgtgtatattgaaactccaatctgcaatgtaaaccgggctgttggaactatgctaagccatgaagtgaccaagcgttatcacctcgcaggtcttcctacagacaccattcatatcaagcttagtggaagtgcaggacagagtcttggggcttttctttgccctggcatcacattagagcttgaaggagacagcaatgattatgttggtaaaggtttatcgggtggcaaaatcgttgtttatcccccaaaaggaagcaagtttgaccccaaagaaaatattgtgattggaaatgtagctctttatggggcaacaagtggggaggcatattttaatgggatggcagcagaaagattttgtgtccgtaactcaggggccaaagctgttgtagaaggagttggtgatcatggctgtgagtacatgactggtggtacagttgttgtgcttgggaagactggaagaaacttcgcggctggtatgagtggtggtgttgcttatgtacttgacttgcattccacgttccactctcattgcaatccagagctggttgatctcgataaagttgaagaagaagaagatatcatgactttgaagatgatgatacagcaacaccagcgtaacacaaacagccaactggcgaaagaagttcttgctgattttgataatcttttgcctagatttattaaggtcttccctagagattataaacgggttcttgcaagcatgaaaaaggaggaagcttacgaagcagcaaaagaacgtgccatcaaggaagcggaggagcaagaagaagaagagttgaaggaaaaagatgcctttgaagagctgaagaagttagcagctgcatctaaggatgaatccagtcaggttgaagaggagcagacattgaagaggcccatccaagttgctgaggcagtcaagcatcgaggttttgttgcttatgagcgacagggtgtgtcctacagggatccaaatgttcggatggaggactggaaagaggttatggaggaatcaaaacccggtccgctccttacgacacaatctgcacgctgcatggactgtggaactcctttttgtcatcaggagaactctggatgtcctcttggaaacaaaataccagaattcaatgagttagtgtatcagaatagatggcgtgaagcactggataggcttcttgagacaaacaacttccctgagttcactggtcgagtgtgccctgcaccatgtgaaggatcttgtgtgcttggtatcattgagaatcccgtttctatcaaaagcattgaatgtgccattattgacaaagcttttgaggaggggtggatggtgccacgacctccttctgagagaaccgggagaagagttgcaattgttggaagtggaccctcaggcctggctgctgctgatcagttaaatagattgggtcatactgtcaccgtgtttgaacgtgctgataggattggtggtctgatgatgtatggtgtgcccaacatgaagaccgacaaaattgatgtcgtccagaggcgggttgaccttatggagaaggaaggggtgaaatttgtagtcaatgcaaatattggaaatgatcctgcgtactccttggatagtcttcgtgaagatcatgatgcaattattttggctgttggagccacaaagccgagggaccttcctgttcctggacgagaattatccggagtccatttcgccatggaattccttcacgcaaacacaaaaagtttgcttgacagcaatctgcaggatggaaaatacatttcagccaagggaaagaaggtggttgttattggtggaggtgacactgggacagactgcataggaacatcaattcgccatggctgcaccagcgtagtgaatctagagcttcttcctcagccaccaaacactagggctcctggaaatccttggccacagtggcctcgtatcttccgtgtagattatgggcatcaggaagctgctgtaaagtttggtaaggatccgagatcctatgaggttttgaccaagcgtttcattggagacgaaaatggaaatgtgaaaggactggaggtgatacgtgtacagtgggagaaagatgccagtggaagattccaattcaaggaagtagaaggctctgaagaaattatcggggctgatctggttatgctagccatggggttccttggtcctgaatcgacaatagcagacaaactaggattagaaaaggacaacaggtccaacttcaaggctgattatggacgcttctcaactagtgtggagggggtgtttgctgcaggagactgtcgtaggggacagtctttggtggtttgggccatctctgaaggacgacaagcagctgctcaagttgacaagtttctcatgaaggatgacgaggactcgtctgctgatgcagctagccaacaagaatctgtcaaaaagcagccaacagtcgtgacataagacacttgcttttggcggaggctggttttagtaatcttccttcaaacaacttccaagaaaagaaatacataatagtaaatcaagatcagctcagctggaacataggataggggggactagttgagaatttctgattctttttttggggagagtttgagggtagggaatagtattttttttgttttttggttgctgcatcttgggtgttcataactatattatgtccgtgccagtttgcttggagggtagct

SEQ ID NO: 691 - DNA, 2544 bp, Solanum lycopersicum
aaagtcgaccccaagtatttcttgaagtttacagctttaattcctcaaaaagataagcaaaaaaattgcatttgtcatgggaattgcaaaaacagggcagggttcatgttggcttcttgtatacatggtgtttcttctgtttaatttatcagatgagttcttagaaccttcacaatctgaagccatagtgaaaattaagcagcttttgaacttccctcaagatttgagtagttggagtgacaatacagatttttgtaacagtgagccaaacactgccttaacactaatgtgttatgaagataacataacacagcttcatatttctggctataactggttccctaatttgcctcaggggttttctacagatacccttttctctaatcttgctcttttgcctaatttaaaggtgctttctttggtttctttaggtttgagaggaactttacctaaaaagattggatttttatcttctttggagattgttaatatcagttcaaacttcttttatggtgagattccaggacagatttcatatttgaagagtcttcagacacttatattggataataatgagtttacaggccaagttcctgaaggggtaggcttacttcattcgttgtctgttttgagtatcaagaacaattcattttctggttcattgcctaattctttgtcaaatttacaaaccctaagaatcctttctatttctggtaataatttttctggggttgttccaaaccttcataatctgtcaaatcttcaagttcttgatttggaaagtaacaatcttggacctaatttccctaatattccaaccaagttggtatctttggtacttaggaagaataagttcagtttaggggtaccaaaagaactgagttcatgttatcagttaaagaaactggacatttcttctaatgagtttgttggacccttttcaccaacaattttatcattgccatcactcagctatttcgatatttctggaaataaactaactgggaagcttctaaagaatgtgacatgtagtcaagacctttcatttgtgaatttatcatcaaattacttgacaggggagttgcctgattgcttgcaccctagttctggttccaagattgtattgttttctggaaattgtctgtcgaataaagagcaatggcagcatccttattcattttgccataatgaagctttggctgttagtattgagcctcataagagaaaggttaaagggggaaatggtaaagctgttcttgcatcaagtatggtaggaggttttgttggagtagtagcgattgtcggtttggctttcgtggttgttagaagggagtatgtcaagcagaaagctagcaaagcccctcaaacaagattgatacttgaaaaggtctctcctgctcacacacttaagctgcttaatgatgcaaggtatctttctgaaacgaggaagttgggtttgcttggggcccctccttatcgaacgtttgtcttggatgagcttcgagaggctactaataacttcgatatatcaaatctaattggtgcaagctccagtgggcagatttacaaagggcgtctcacagatggcactgtggttgctataagaagcataaaaatgaagaggaggcatactgtccagtcctacactcaccaactagggcgtatttcaaagatcagatacagccacttagttagtactattggacactgctttgagtgctaccaagatgactcaagtgttagccgaatatgtttagtctttgaattcgtgccaaatgtgacgctgcggggggtcatatcagaagcaaattcagctcaaaagtttacttggacgcaacggatgtcagctgcaatagggatagcgaagggaattcagttccttcatactggaatagtaccagggatattctccaatcaattgaagattacagatgtattactggatcagaatttccacgttaagattagcaaatacaacctgcctttgttaattgaaaataagaaaatggatgctggaccgtcttctagtggatcaaagggaaatgatggacaaaggttaaaatacgaggagaaagatgatgtgtatgactttggagtaatcttacttgaaatcatatcgggaaggacaatcgatacaaaaaatgatatagatgtttctaaagacattctaatagttagcttaacagctgacgagatagcacggaggaacatcattgatccagctgttcggaaggaatgctcagatagttctcttagaacattaatggaactatgcataaaatgtctttcagatgaaccatcgcagcgtccttctgtagaagacttgatatggaacttgcagtttgcagctcaggtccaagacccttggaatagagacacttatggcaaccaagagtcccctggtcatgtgtaagaacttatgcaaatatccaatgatcaatggaccttttcttgtacaaaatgtaactttataccactaggatagtagtaattagtttcaattatttagtagcctctattgcagcacttttggctggatccttt

SEQ ID NO: 692 - DNA, 1579 bp, Solanum lycopersicum
tagcaaattagccaccaacaaaaagaaatttccaatttttttttcttgataaactttgaggttttttttttttttaattaagaaaaaaatggggttaatttcaaagatagccacaaatgatggacatggagaaaattcagcttattttgatggttggaaagcttatgaaaatgatccatttcatccaacacaaaatcctaatggtgttattcaaatgggtttggctgaaaatcagctttgttttgatttaattcaagaatggatagtcaacaacccaaaagcctcaatttgtacatatgaaggagttcaagattttcaagatactgctatttttcaagactatcatggcttgccagaatttagaaaggcagttgcaagattcatggagaaagtgagaggagatagagtgagatttgatccagaaagaatagttatgagtggaggagcaacaggagctcatgaaagtttggcattttgtttggctgatcctggtgatgcatttctagttcctacaccatattatccaggatttgatagagatttgagatggagaacaggagtacaactttttcctgttgtttgtgagagttctaacaatttcaaggtaacaaaagaagccttagaagaagcatatagtaaagctcaagaatcaaatatcaaagtaaaaggattacttataaacaatccatcaaatccattaggtacaattttggacaaggaaacattaaaagacatattaagattcatcaatgacaaaaacatacatctagtatgtgatgaaatctatgcagcaaccgcgtttagtcaaccttcattcatcagtatctcagaagtcaagagtgaagttgttggatgcaacgatgatttagtacacattgtgtatagtctatcgaaagatctagggtttcctggatttagggttgggattatttactcgtacaatgatgccgttgtcaatattgcacgtaagatgtcaagttttggacttgtttcaacacaaacacaaagattgattgcttcaatgttattagacactatctttgttgaagatttcatcgcgaagagctcgatgagattgttacaaagacatggtttgtttactaaaggattgggtcaagttggaattacaacattgaagagtaatgctggtttgtttatttggatggatttaagaaggtttcttgagaattcaacatttgatgatgaattgaaactttggcatataattattgataaagtgaagcttaatgtttcacctggttgttcatttcattgctcagagccaggttggtttagggtttgttttgctaatatggatgatgctacaatgaagattgcattgagaagaattagacattttgtctatttacaaccaaataagggagttgaagttgcaacaaagaaacaatactgtagaacaaggagcaaacttgaaattagtttgtcatttaggagattggatgattttatgaactctcctcattcacctatgtcttctcctatggtccaagcaaggaattaatcgtacgtatgtggtgttctgatcagcttctacacacatcgttcaattatggactag

SEQ ID NO: 693 - DNA, 215 bp, Phaseolus vulgaris
atgtgatggctggacttttaggatttaggagccttccacccaaggcaaagaatttggtagttgctgggagtttgacagcttttgtctttggtgcctacttctacaccatgagggctgttggaggcactgatgaactgcaggtagcaattgataagtttgaatctcacaagaccaagaatgagggtgaatccaacatgtcatcaaaggtctaataa

SEQ ID NO: 694 - DNA, 468 bp, Phaseolus vulgaris
taggcagcaaagtgacctccctgtctctggcttcggtgtctttgtattttgaggtaattaacaacacaatgtcgctgagacgtttctttggcttttctgatggtgaggtcatgaggtctgatgcaaaaccttgttctcggctaatgaggcacacggctggaatctatagtgttgggggagcattaggtttttggatcctttgtcgactgcattatggtcctcgaattacaaatcctaggagccttcgttgggcagcatgtggagctgtaactgtaagctcaagcacggctttactggttcgtttatttagtcctgaatgtgagccccaaaatatagctgcttacgacaataaaaagtaacactgatattgtcacccttttccttttccgccattaattaatataaaaaagggaaaaaagtaggagtttttgagaaccttttctccccaggacatgggcatattgaaat

SEQ ID NO: 695 - DNA, 857 bp, Phaseolus vulgaris
agaggatggcatgtagggggtgctgggagtgccttttgaagcttttgaacttcatattgaacctcactggtctggcaatagtgggctatggaatctatcttcttgttgaattctctaaagcttcagatgatgacactccggatatttctcctgtcagtgatgattctgctctgattcaacttggccggcccatactcatggctgtgtcattatctaacagcttttttgataacttgcctagggcttggtttatttacttatttattggtattggagtagttctctttcttatttcttgttttggttgtattggagctgcaacacggaatggatgctgcctgagctgttattcaactttggtggtattattgatcttgatagagctgggatgcgcaggctttatattctttgacaaaaactggaaagaagaaattcccacagacaaaactggagactttgatgcgatatatgaatttctgagtgagaattggaatattgtgaaatgggttgctcttggaattgttatctttgaggctcttcttttcctgttagcccttattgtcagggctgcaaataggccagcagaatatgacagtgacgaggagttcattaatccaaggcagcaagttcgtcagccattgctcaatagaccggcagcaggcccatcagcagggctacctgcttctggcacaactgaccaacgttcaagcagaaatgatgcttggagtacaaggatgagggagaagtatgggcttgatacttcggaatttacatacaatccatctgagtcgagcaggttccagcaagtaaactcccagatagctgaagaaaagagccgctgcactataatgtgatga

SEQ ID NO: 696 - DNA, 1454 bp, Glycine max
aagcaatgcctgtgatcgcggcaaagcccaacaaaaacccctccttatacgtccccaagctcttcctcctctgcaccctcttctccattctctccctcgccctcttcctcttcctcatcttccccaccgccacaacaacaaccaccctccacccttctctctctccattctcctcttccacaatcaacgtctacgtcgccgacctccctcgatccctcaactacgccctcctccacacctactggtcctctttctccgattcccgtctccccaccgatgccgatcacaccactcccccttcctccctccatcagacggctaagattcccccttaccccgagaacccactcatcaaacagtacagcgccgagtactggatcacgggcgacctcatgacccctccccaacaccgcgccacctccttcgcgaagcgcgtcctcgacccgcttctcgccgacgtcgttttcgtccccttcttcgccacgctcagcgccgaaatgcagctcggcgccaacaaaggcgccttcagaaagaagcacgacaacgacgattacaagcggcagaggcaggtcatggacgccgttaaaaacacccatgcctggaaccgctccggcggacgtgaccacgtgtttgtgctaaccgacccggtggcgatgtggcatgtcaaggacgagattgcccctgctgttctgcttgttgtggattttggcggttggtaccggcttgactcccgaggtggttcaaactgtagcgagagtgatgtgattccgcacacgcaagtttctgtgattaaagatgtgattgtgccgtacacacatctgctgcccaggttggacttgtcggataacaaggagcggcaccagcttctgtattttaaaggagctaaacataggcaccggggaggtataatcagagagaagttatgggatctattggttagtgaacctggtgttataatggaggaaggtttccctaatgcaactgggcgagaacaatcaataaaagggatgcaaacatcagagttttgcctgcatccagctggggatacacccacttcatgccgactttttgatgcaattcaaagtctttgtatacctgtcattgtcagcgacaacattgagcttccatttgaaggtatggtggattatgcagaattttctgtcttcgcagcagttagtgatgccctgaaaccaagctggctagtcagtcatcttcaaagcttttcaaaagagcagaaagacagattccgccaaaatatggctcgggtacagcccatctttgtctatgataatggccatccaggtggtattggaccaatacctgcggatggtgcagtgaatcatatatggaagaaagttcaccaaaaactgccaatgataaaagaagccataattcgagagagaagaaaaccacctggtgtttcagttccacggcgttgtcattgtacttgataa

SEQ ID NO: 697 - DNA, 60 bp, Zea mays
aaaggatcctggttcgctaggtttactctcccctcctcttccacggccgcgcctgcgaca

SEQ ID NO: 698 - DNA, 60 bp, Zea mays
cagtggccaagtacactcacccgctcgcgcgcgtgagcgatgaaagctctcgcctcgccc

SEQ ID NO: 699 - DNA, 60 bp, Zea mays
aaagtcgacagacttccagctaacagtgaccacggcgacgatcgccggctcgccgccatg

SEQ ID NO: 700 - DNA, 60 bp, Sorghum bicolor
acacagagaatcaaacgctccgcagcgaattcaattttgaaagccccagagagcttccat

SEQ ID NO: 701 - DNA, 60 bp, Sorghum bicolor
gtgcctggtgcttctcatccccacctcactcgtgctccgcgcccgtttcaccgcctgaac

SEQ ID NO: 702 - DNA, 60 bp, Sorghum bicolor
aggtgctggatccgtggcagcggcggccatggacaagagcatgctcggcgacctggacgg

SEQ ID NO: 703 - DNA, 60 bp, Zea mays
atcacatggagagcgcgatggagaaggtgtgggagtcggggcggcggatgagccggagca

SEQ ID NO: 704 - DNA, 1223 bp, Gossypium hirsutum
gactttgaagctgtttatattcaattagaatgtcttcttcaccattattttctatgagcacgatgaaaagggattcgtttgttatgaaaacgataacttcgaacaaagagttcaagtttaatgtttcgaattccttcgataagctacctgttacgagtcctacattgttgttaaccggtgagaactcgttgaaatggggacaaaacgagagtcttttaaggaatcgaatgcaatgctgtgcagtggaagtcaagaacatgcctgggtatccaatggggaagaagtttgaactcgatgatgtgattgaagctcaacaattcgatagggaaactttaaatgctatatttgaagttgcgaaagagatggagaatatcaaaaagaactcacccggaagtcaaattctcaaaggttacctgatggccacccttttttatgaaccttcaactagaactaggctttcattcgagtcggccatgaaacgattgggtggtgaagttttaacaactgaaaatgctcgagaattttcttcggcagccaaaggggagacccttgaagatactattagaactgttgaagggtattctgatataattgtgatgcgacactttgaaagcggtgctgctaaacgagcggcagctaccgcaggcattcccatcattaatgctggtgatggtccgggtcaacatcctacccaggcccttttagatgtctacaccatagaaagagagatcggaaaactagatggcatcagagttgggcttgtcggagatcttgccaatgggagaaccgtccgttctcttgcctacttacttgcagagtaccaagatgtgaagatatactttgtttcccccgacgtcgttaaaatgaaggacgacattaaaaagtatctaacacggaggggtgtcgagtgggaagaaagtggtgatttaatggaagtggcgtctaagtgcgatgtggtataccaaactcgtattcaacgagaacggtttggagaaaggatcgatctttatgaagaagctcgtggtaagtatatagtggatgagaatgtgttgaaggtaatgcagagtcatgctgtggtaatgcatcctctcccgaggcttgatgagattaccgtcgatgttgatgccgatccgagagctgcttattttagacaagcaaagaatggtctttatataaggatggctcttttaaaattgttgcttgttggatggtgaggagaataa

SEQ ID NO: 705 - DNA, 491 bp, Arabidopsis thaliana
taaccatgtctgcgaagaagattgtgttgaagagttccgatggtgaatctttcgaggttgaggaggcggtggctctcgagtcacaaaccatagcgcatatggttgaagacgactgcgtcgacaacggagtccctcttcctaacgtcacgagcaagatcctcgccaaggtgatcgagtattgcaagaggcacgtcgaggctgctgcctctaaggccgaggccgtcgagggtgctgctacctccgatgacgatcttaaggcctgggacgctgattttatgaagatcgatcaagctactctctttgaactcattctggctgctaattacctgaatatcaagaacttgcttgatctaacatgtcagacagttgcggatatgatcaaaggaaagactccagaagagatccgcacaacgttcaacattaagaacgacttcacaccagaggaagaggaagaggttcgcagagagaaccaatgggcttttgaatgatga

SEQ ID NO: 706 - DNA, 937 bp, Glycine max
caagagagatggccatcagccatgaaacttgggctttcattttcggtcttctaggcaacgtgatctcctttatggtgttccttgctccattaccaactttttaccaaatctacaagaaaaaatcatccgaagggtttcaatcactaccttatgttgttgcactgttcagttcaatgctctggatctattacgcacttgtgaaaaaggatgctagcctccttctaattactattaactcctttgggtgtgtgatagagacaatttaccttgcaatcttccttgtttacgccccaagcaaaaccaggctttggaccatcaagcttcttctcatgttgaatgtttttgggtttggagggatgcttctttcaacactataccttacgacgggttccaaacgtctttctgtgataggatggatttgccttgttttcaacataagcgtttttgctgctccactttgcatcatgaaacgtgtcataaagacgaggagtgtggaattcatgcctttcagtttgtccttgtctttgaccataaatgctgttatgtggttcttctatggccttctcctcaaggactactacatcgcactcccaaatactcttgggtttctatttggcataatccagatggtgctgtatttggtttatagaaacgccaagccacaaacattggaggagccaacgaaggttcaggaactaaatggtcatattattgacgttgtgaagccaaatcatgcaacaaaaaatggtcatgtgcctgtgattgagatagctagcagtgtgtgaaaatgaagcaataatgaatcgagtccaaagagaaagaaaaaaaatgaggccccaaaatatttaagctaaaagtacgattattacttaattactttgccaagtggggcctcatcttaacgcaagaacagtacgtgaagtttggtgtttagggt

SEQ ID NO: 707 - DNA, 683 bp, Medicago truncatula
cagccatggttttctgggtttttggttatggttcactggtatggaacccaggttttgattatgacgaaaaaatgcttgggttcattaaggactacagacgcgtctttgatttagcgtgtattgatcacagaggaacacctgaaaaccctgcaagaacttgcactttggaggagaaagaaggggaaatttgctggggagttgcttattgcgttcgaggaggccctgaaaaggaaaaactggctatgcagtatttggagcggcgagaatgtgagtatgatcaaaagactcttgtaaacttctacaaggaaggagattctctgcatcccgctcttactggagttattgttttcacgtctacgccagacaaagaaaacaacatatactatctgggacctgctccactggaggatatggctaggcaaatagcaaccgccaatggcccatgcggtaacaacagggactatctttttcttctagaaaaggctatgcataatcttggtcatgaggacgacttggtaatagaacttgctaatgaagtgaggaaagtccttggagtggtgaatgtagtgctgaacgagaaaaaattggttggaccgacgcaacttccacatcagccgcatgtacccattccatcccttcagttgcacccactgccagaacctattgctttggatagttaataa

SEQ ID NO: 708 - DNA, 1854 bp, Sorghum bicolor
gatctctggctgtcgactctgcaggcgtcgcgcctacctataaagccctaacctgcgacgacttcaccatgtgtcatcggagcgagctcctctccctcgtgctgtaccaaccagccatggtcgacaccgtcgccggcgccaccgactaccgcggccagccggcctctcgtgccgccaccggcggctggaaaccgtcggttttcgtcatggcgatggagatcgcggagcggttcgcgtacaagggcgtggccgcgaacctgatcacgtacctgacggggccactggggcagccgatggcgcgcgccgccgcgtccatcgacgcgtggaagggcgtctcccagatgctgccgctgccgctcgcgtgcgtcgccgacgcctggctcggccggtaccgggccatcgtcctcgcctccctcatcttcgtcgtgagcatgggctccctgtcgctgtcggcggcgttgccggccttgcgcggcggccacgtggccatcttctacgtggcgctgtacctggtggctctcggcgagggcgcgcacaagccgtgcgcgcaggcgttcgcggcggaccagtacgacgagaaggaccccaaggagagcgtggcgcggagctcgttcttcaactggtggtacttcggcatgtgcgccggcactgctgtcaccaccatggtctccagttacgtgcaggacaacgtcggctggggcctcggcttcggcatcccctgcatcgtcatcgtcgcctcgctcgccctgttcttgctcgggaccaggtcgtaccggttctataccaccacggaggccagccccttctctcgcgtcgggaacgcgttgctggcgttgatccacagctgggcgcccaagcatcgcaccagaaaattaggcgatggcgacgaggacaacgccgtcgccgtcgaggaagtgaagagcgtgctccgcctgctgcccatatgggcgtcgtgcataatctacgcgatcatcttctcccagacgtcgacgttcttcacgaagcaggccgcgacgctggaccgccggatcggcgcgaggttcaaggtgccgccggcggcgctgcagacgttcatcagcgtgagcatcgtcgtcttcatccctgtgtacgacaggctcttcgtgcccctggcgcgacgctacacgggaaggccgacggggatcaccatgctgcagagggtcggcgccggcctggcgctctccctcgtcgccgtggccctgtccgcgctcgtcgagatgaaacgactccgtgtcgcgacggaagccggcctggtgaacaccccgaaggcgcagcttcctatgacgctctggtggatggtcccgcagtacatcctcatcggcgtcgccgacgtgttcgccatgatcgggctgcaggagttcttctacgaccaggtccccgacgcggtgcggagccttgggctggccctgttcctgagcatcttcggggtcggccacctcctcagcagcttgctcatctccgtcattgacaagacgacagcgaggagcgggacgagctggttctctaacaacctcaaccgcgcccacctcgactacttttactggctgctcactggcctctgcgccgtggagctcgtcgcctttgtgctcttctctcgagtgtatgcttacaagagaaagagtggcaatgatggtggcagtggtgatctcgtgtgatacatatgcagtttgagccgtactgatcactttgaggggtgcctgtagctgtagttgtttgtagagagccagccctctacggagtacggagttgctacgggattctggtgttaacacactacttttccccttatctcttgatttatgattccaaaatgggctagggaagaggacacttggt

SEQ ID NO: 709 - DNA, 1604 bp, Panicum virgatum
cggccatgtccatggaccccgccgaccgcatgctggcggatcccctcctcctccccctcccagcggcggccaagcaggtgctcgccggcgtcaccgactaccgcggccgccccgtcacccgcggggcctctgggggatggcgatccgcgctcttcgtagtggccgtggagatcgccggcagcttcgcctacttcggcatctccgccaacctcatcacctacctgacggggcccctgggccagtccaacgcctccgccgccgccgccgtcaacgcctggtcggggacggcaagcctcatgcccctgctcggcgcattcctcgcggacgcatacctgggccgatacagatcaatcatcctcgcatgctcactctacgtcctggggtttggcatgctgactctgtcgtccacggtgcctccgctgcgccctgctgcctcctcgcacttgcccagcggcagcagccggccaccgcctcaggccctgcaggtggccttcttctacgtctccctctacctcatcgccctcgcccagggcgccgacaagccctgcggcctcgccttcgccgccgaccagttcgacgccaaccaccccgccgagcgcgcctcccgggcctccctcttcaactggtggttcttctgcatggccatcggcatctccgtcgccgtctccgtcgtcggatacatccaggacaacgtcggctggggcgtcggcttcggagtcccctgcgccatcgtgctcgctgcattcgccgtcttcctcatgggcacccccacctaccgcctctaccaacacaagaagaagcagccaccaaaggaggaggaggaggaggagcagcagcagcagcagaacaaggccatggccagcagcgcgctccgccggcttctccccatctgggccaccagcctcgcctacggcgtcgtgtacgcgcagatcatgaccctcttcaacaagcagggccgcaccctggaccgccgcatcgtgggagccatccagctcccgcccgccgcgctgcagacgctcggccccgccagcatcctgctcttcgtccccgtctacgactgcgccatcgtgccggcgctccgctgggccaccggcaacccctccggactgaccatgctgcagcgcgttggcgccggcatggccacgtccctggccgcggtgtccgtcgccgcgctcgtggaggcgcgccgcctcgccacggcgcgggagcacggcctggtggaccagccgggggtcaccgtgcccatgacctgggcatggatggtgccgcagtacgccatgatgggggtggccgacgtgctcgccgtcgtcggcctgcaggagctcttctacgaccagatgcccgacggcctccgcagcctggggctggcgctctacctcagcgtcatgggcatagggggattcatcagcagcctgctcatctccatcatcgacggcatcacatccaggggcggccgggacagctggttcgcggacaacctcaaccgcgcgcacctcgactacttctactggctgctcgcggggatcagcgccctggagctcgtgctctacctaggcttcgcaagatcctacgtttacaaccaccaacacctagctacctagtag

SEQ ID NO: 710 - protein, 16 aa, Zea mays
MEVVVAAKQKAKKHIH

SEQ ID NO: 711 - protein, 16 aa, Zea mays
MDLLRHPFKGVVTDIK

SEQ ID NO: 712 - protein, 16 aa, Solanum lycopersicum
MFKLLFLLAILLLSSD

SEQ ID NO: 713 - protein, 395 aa, Arabidopsis thaliana
MAVSTIYSTQALNSTHFLTSSSSSKQVFLYRRQPQTNRRFNTLITCAQETIVIGLAADSGCGKSTFMRRLTSVFGGAAKPPKGGNPDSNTLISDTTTVICLDDYHSLDRYGRKEQKVTALDPRANDFDLMYEQVKALKNGIAVEKPIYNHVTGLLDPPELIQPPKILVIEGLHPMFDERVRDLLDFSIYLDISNEVKFAWKIQRDMAERGHSLESIKASIEARKPDFDAFIDPQKQYADAVIEVLPTTLIPDDNEGKVLRVRLIMKEGVKYFSPVYLFDEGSTISWIPCGRKLTCSYPGIKFNYEPDSYFDHEVSVLEMDGQFDRLDELIYVESHLSNLSTKFYGEVTQQMLKHADFPGSNNGTGLFQTIVGLKIRDLYEQLIANKATARAEAKA

SEQ ID NO: 714 - protein, 772 aa, Arabidopsis thaliana
MAFTFLSPHPVFLSLTGTTSSFSYKPVLLPFSRNSRTLTVAAGPARRNSYPNPADDDPPEAPEDSMHGVSKFQQIQRQAARARKLEEEDFEKNRNTYLSAIADVEDAAETGRDDEESGGDLFSDIDRAISMKRSEFVKQGLLKPNPPKTASLKKIGEEGNEEEGDVTDDVDELDEEEVVDLDEIDKLTGLTEISDEEDWVDEEGNTRINKKKEFGSDHQFEFDLDDFGESKARIVEPKFKMCLAELLDESKVVPISVYGDLDVEITGIQHDSRGVSAGDLFVCCLGSENFLSEADKRGAVAVVASKEIDIEDTLGCRALVIVEDTNAVLAALASSFYRHPSKNMSVIGVTGTDGKTTTTYLIKSLYEAMGVRTGMFSTVSCYIHGDNKLDTPNATMNPDAVLVQSLMAKMLHNGTESLVMEASPQELALGKCDEVDFDIAVFTNLTRENTDFRGTDEEYRDAEAKLFSRMVDPERHRKVVNIDDPNAAFFVQQGNPNVPVVTFAMENTKADVHPLKFELSLFETQVLVNTPQGILEISSGLLGRHNIYNILAAVAVGIAVGAPLEDIVRGVEEVDAVPGRCELIDEEQAFGVIVDHANTPDGLSRLLDSIRELKPRRIITVIGCEGENERGKRPLMTKIATEKSDVTMLTSDNPRNEDPLDILDDMLSGIGWTMQEYLKHGEHDYYPPLANGHRLFLHDIRRVAVRCAVAMGEEGDMVVVAGKGHEAYQLEGEKKEFYDDREECREALQYVDELHQAGIDTSEFPWRLPESH

SEQ ID NO: 715 - protein, 236 aa, Arabidopsis thaliana [sequence omitted]

SEQ ID NO: 716 - protein, 188 aa, Arabidopsis thaliana
MTNYGAIPTSSHASPLVDVESLSRAKHRIKAGLATRRAWRVMFDFHSMGLPHGVSDAFTRIKTNLAYFRMNYAIVVLIVIFFSLIWHPTSLIVFTVLVVVWIFLYFLRDEPIKLFRFQIDDRTVLIVLSVLTVVLLLLTNATFNIVGALVTGAVLVLIHSVVRKTEDLFLDEEAATTETSGLTSYPST

SEQ ID NO: 717 - protein, 426 aa, Arabidopsis thaliana
MASMSFALNRFSGLSSKTTLSADFDPSSRRSFLPPTRVGLKISSAAESEPDLSVTVNGLKMPNPFVIGSGPPGTNYTVMKRAFDEGWGAVIAKTVSLDASKVINVTPRYARLRTGSNGSAKTDVIGWQNIELISDRPLETMLKEFERLKKEYPDRILIASVMEEYNKTAWEELIDRVEQTGVDALEINFSCPHGMPERRMGAAVGQDCALLDEVCGWINAKATVPVWAKMTPNITDITEPARVSLKSGCEGIAAINTIMSVMGIDMKTLRPEPCVEGYSTPGGYSYKAVRPIALAKVMNIAKMMKSEFSEDRSLSGIGGVETGYDAAEFILLGSNTVQVCTGVMMHGYGHVKTLCAELKDFMKQHNFSTIEEFRGHSLQYFTTHTDLVKRQKEAVEQRKAEKRGLKSDKDWTGDGFVKETESMVSN

SEQ ID NO: 718 - protein, 390 aa, Arabidopsis thaliana
MSIASSLTSATLCGASVFPKALACSSEFPINLPSPFESSKICLTSFPASRDLKKNATLNLTRNVGPVRCHAMQAGTRELKKFELSDVIEGKQFDREMLSAIFDVAREMEKIEKSSSQSEILKGYLMATLFYEPSTRTRLSFESAMKRLGGEVLTTENAREFSSAAKGETLEDTIRTVEGYSDIIVMRHFESGAARKAAATANIPVINAGDGPGEHPTQALLDVYTIQSEIGKLDGISVALVGDLANGRTVRSLAYLLAKFKDVKIYFVSPEIVKMKDDIKDYLTSSGVEWEESSDLMEVASKCDVVYQTRIQRERFGERLDLYEAARGKYIVDKDLLGVMQKKAIIMHPLPRLDEITADVDADPRAAYFRQAKNGLFIRMALLKLLLVGW

SEQ ID NO: 719 - protein, 565 aa, Arabidopsis thaliana
MASTPKLTSTISSSSPSLQFLCKKLPIAIHLPSSSSSSFLSLPKTLTSLYSLRPRIALLSNHRYYHSRRFSVCASTDNGAESDRHYDFDLFTIGAGSGGVRASRFATSFGASAAVCELPFSTISSDTAGGVGGTCVLRGCVPKKLLVYASKYSHEFEDSHGFGWKYETEPSHDWTTLIANKNAELQRLTGIYKNILSKANVKLIEGRGKVIDPHTVDVDGKIYTTRNILIAVGGRPFIPDIPGKEFAIDSDAALDLPSKPKKIAIVGGGYIALEFAGIFNGLNCEVHVFIRQKKVLRGFDEDVRDFVGEQMSLRGIEFHTEESPEAIIKAGDGSFSLKTSKGTVEGFSHVMFATGRKPNTKNLGLENVGVKMAKNGAIEVDEYSQTSVPSIWAVGDVTDRINLTPVALMEGGALAKTLFQNEPTKPDYRAVPCAVFSQPPIGTVGLTEEQAIEQYGDVDVYTSNFRPLKATLSGLPDRVFMKLIVCANTNKVLGVHMCGEDSPEIIQGFGVAVKAGLTKADFDATVGVHPTAAEEFVTMRAPTRKFRKDSSEGKASPEAKTAAGV

SEQ ID NO: 720 - protein, 524 aa, Arabidopsis thaliana
MECVGARNFAAMAVSTFPSWSCRRKFPVVKRYSYRNIRFGLCSVRASGGGSSGSESCVAVREDFADEEDFVKAGGSEILFVQMQQNKDMDEQSKLVDKLPPISIGDGALDLVVIGCGPAGLALAAESAKLGLKVGLIGPDLPFTNNYGVWEDEFNDLGLQKCIEHVWRETIVYLDDDKPITIGRAYGRVSRRLLHEELLRRCVESGVSYLSSKVDSITEASDGLRLVACDDNNVIPCRLATVASGAASGKLLQYEVGGPRVCVQTAYGVEVEVENSPYDPDQMVFMDYRDYTNEKVRSLEAEYPTFLYAMPMTKSRLFFEETCLASKDVMPFDLLKTKLMLRLDTLGIRILKTYEEEWSYIPVGGSLPNTEQKNLAFGAAASMVHPATGYSVVRSLSEAPKYASVIAEILREETTKQINSNISRQAWDTLWPPERKRQRAFFLFGLALIVQFDTEGIRSFFRTFFRLPKWMWQGFLGSTLTSGDLVLFALYMFVISPNNLRKGLINHLISDPTGATMIKTYLKV

SEQ ID NO: 721 - protein, 366 aa, Brassica juncea
MATALNAAVSLTSSKSSSLPATSCAIAPERIRFGKGAFYYKSNNVVTSRRVVSVRAEVTTDTPPVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREETNDKGEKMYIQTRMAQYAPELWELLKKDNTFVYMCGLKGMEKGIDDIMVSLAANDGIDWFDYKKQLKKAEQWNVEVY

SEQ ID NO: 722 - protein, 741 aa, Hordeum vulgare
MASRLLRLHHQLRRRRHHGTSPVPCRLLSSSSATEPPPPPQTVEKALVANRGEIACRVMRTARRLGIATVAVYSDADRAALHVRAADEAVRLGPPPARESYLNAAAIVDAALRTGAKAIHPGYGFLSESADFAQLCESEGLTFIGPPPSAIRDMGDKSASKRIMGAAGVPLVPGYHGADQDIELLKLEADKIGYPVLIKPTHGGGGKGMRIVQGPDDFVDSVRSAQREAAASFGIDTLLIEKYITQPRHIEVQVFGDKHGNAIHLYERDCSLQRRHQKIIEEAPAPNVTTEFRTHIGEAAVSAAKAVGYYSAGTVEFIVDTLSGEFYFMEMNTRLQVEHPVTEMVVGQDLAEWQIRVANGERLPLSQEQVPLNGHAFEARIYAENVPRGFLPATGTLHHYQPVLSSPTVRVETGVEEGDAVSMHYDPMIAKLVVWGESRNAALVKLKNCLSNFQIAGLPTNVAFLQELAGHNAFERGLVDTHFIERYKDDFQSTSAKASGEAHDAAKLGAILAAACICKKDHITSEESLRDKTLSVWYTRPPFRMHHSAKRLMEFELDEELEELSDELLKLLVTYKSDGGYFIETEDGSSPGFDVKVDGRSENDFRVEVGGVQTDVTLAFYSKDNSKHIHIWHGKHHHHYRQTMRAEHLLDDSSQPRQASEGRSHPKGSVLAPMAGLVVKVLLKDGVHVEDGQPVMVIEAMKMEHVVKAPRAGYIEGLKATAGQQVFDSSVLFTVKDKSTN

SEQ ID NO: 723 - protein, 440 aa, Hordeum vulgare
MLASRVCSRSASQSSTASPRALTSAAASAARSLLLRSGMQATPGLSERPCPGIGEAGVRKADAPPPCSSSGDSREEHACRRQTNQRHPVSNRAKSVGGNRHVLYASYLSQNQQNYRCFSASSDQERIEAANRIIHDLPRCVKIVEVGPRDGLQNEKNTVPTPVKIELIKRLATSGLSVVEATSFVSPKWVPQLADAKDVMEVVRNITGVNFPVLTPNLKGFEAAAAAGAKEVAIFASASEAFSKSNINCSIKQSLVRYNDVALAAKKQEIPVRGYVSCVVGCPVEGSVPPSNVAYVAKELYDMGCYEVSLGDTIGVGTPGTVIPMLEAVMSVVPVEKLAVHFHDTYGQSLSNILVSLQMGVSVVDSSVAGLGGCPYAKGASGNVATEDVVYMLNGLGIKTGVDLGKVMAAGEFICKHLGRQSGSKAATALSKVTASASKL

SEQ ID NO: 724 - protein, 550 aa, Hordeum vulgare
MATTAALPFSCAATLQTLTRTLSPRRSILIHRHRLRSLAASPRLPDRPRARLCRPVSASAAPNGSSSAGEYDYDLFTIGAGSGGVRASRFASTLYGARAAICEMPFSTISADDLGGLGGTCVLRGCVPKKLLVYASKFSHEFEESHGFGWTYDTDPKHDWSTLIANKNTELQRLVGIYKNILKNAGVDLIEGRGKVVDAHTVSVDGKLYTAKNILIAVGGRPSMPDLPGIEHVIDSDAALDLPSKPEKIAIVGGGYIALEFAGIFNGLKSDVHVFIRQPKVLRGFDEEVRDFIAEQMSLRGVTFHTEHSPQAITKSNDGLLSLKTNKETIGGFSHVMFATGRKPNTKNLGLEEVGVKMDKKGAIVVDEYSRTSVDSIWAVGDVTDRINLTPVALMEGGAFAKTVFGDEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDATVGVHPTSAEEFVTMRSPTRKVRRKTAAEAESKDEVVAQK

SEQ ID NO: 725 - protein, 534 aa, Lactuca sativa
MECFGARNMTATMAVFTCPRFTDCNIRHKFSLLKQRRFTNLSASSSLRQIKCSAKSDRCVVDKQGISVADEEDYVKAGGSELFFVQMQRTKSMESQSKLSEKLAQIPIGNCILDLVVIGCGPAGLALAAESAKLGLNVGLIGPDLPFTNNYGVWQDEFIGLGLEGCIEHSWKDTLVYLDDDADPIRIGRAYGRVHRDLLHEELLRRCVESGVSYLSSKVERITEAPNGYSLIECEGNITIPCRLATVASGAASGKFLEYELGGPRVCVQTAYGIEVEVENNPYDPDLMVFMDYRDFSKHKPESLEAKYPTFLYVMAMSPTKIFFEETCLASREAMPFNLLKSKLMSRLKAMGIRITRTYEEEWSYIPVGGSLPNTEQKNLAFGAAASMVHPATGYSVVRSLSEAPNYAAVIAKILRQDQSKEMISLGKYTNISKQAWETLWPLERKRQRAFFLFGLSHIVLMDLEGTRTFFRTFFRLPKWMWWGFLGSSLSSTDLIIFALYMFVIAPHSLRMELVRHLLSDPTGATMVKAYLTI

SEQ ID NO: 726 - protein, 290 aa, Zea mays
MPSPAAAAAAPFHRIACARQHLPQTRLFFLPSRALLKSDRLTVPAPLRVHALRLPPTVPRAASHDAATGVRSPTSGGQMLVFVPPHPLIKHWVSVLRNEQTPCVIFKSAMAELGRLLIYEASRDWLPTITGEIETPVAVASVEFIDPREPVLVIPILRAGLALAELASSVLPATKTYHLGFRRDEETLQPSIYLNNLPDKIPEGTRVLVVDPMLATGGTMVAAIDLLIECGVTSKQIKVISAIASPPALQKLNNKFPGLHVYTGMIDPEVNEKGFIVPGLGDAGDRSFAT

SEQ ID NO: 727 - protein, 537 aa, Zea mays
MGLSGATISAPLGCCVLRCGAVGGGKALKADAERWRRAGWSRRVGGPKVRCVATEKHDETAAVGAAVGVDFADEEDYRKGGGGELLYVQMQSTKPMESQSKIASKLSPISDENTVLDLVIIGCGPAGLSLASESAKKGLTVGLIGPDLPFTNNYGVWEDEFKDLGLESCIEHVWKDTIVYLDNNKPILIGRSYGRVHRDLLHEELLKRCYEAGVTYLNSKVDKIIESPDGHRVVCCDKGREIICRLAIVASGAASGRLLEYEVGGPRVCVQTAYGVEVEVENNPYDPSLMVFMDYRDCFKEEFSHTEQENPTFLYAMPMSPTRVFFEETCLASKDAMSFDLLKKRLMYRLNAMGIRILKVYEEEWSYIPVGGSLPNTDQKNLAFGAAASMVHPATGYSVVRSLSEAPRYASVISDILGNRVPAEYMLGNSQNYSPSMLAWRTLWPQERKRQRSFFLFGLALIIQLNNEGIQTFFEAFFRVPRWMWRGFLGSTLSSVDLILFSFYMFAIAPNQLRMNLVRHLLSDPTGSSMIKTYLTL

SEQ ID NO: 728 - protein, 431 aa, Solanum lycopersicum
MAGQTVIVSGLNPAAILQSTIGGAPVAAAAENGHTRKVVPLSKDALQDFMVSIITQKLQDDKQPFYVLDLGEVVSLMEQWNSALPNIRPFYAVKCNPEPSFLSMLSAMGSNFDCASRAEIEYVLSHGISPDRIVFANPCKPESDIIFAEKIGVNLTTYDSEDEVYKIRKHHPKCELLLRIKPMTDGNARCPMGPKYGALPEEIEPLLRTAQAARLTVSGVSFHIGSGDADSNAYLGAIAAAKQVFETAAQLGMPKMTVLDIGGGFTSGHQFTTAAPAVKSALETHFHDFPELTIIAEPGRFFAETAFTLATTIIGKRVRGELKEYWINDGLYGSMNCVLYDHATVTATPLACMSNRNNLNCGGSKTFPSTVFGPTCDALDTVLRDYQLPELQVNDWLIFPNMGAYTKAAGSNFNGFNTSAIVTHLAYAYPN

SEQ ID NO: 729 - protein, 265 aa, Solanum lycopersicum
MASMIESAWAFLLANFSDFQLTSLGGFIVHESAFFLSGIPFILFEKAGWFGKYKIQKKTNTPEAQQKCITRLLIFHFCVNLPILIVTYPLFKFMGMRSTLPLPSWKVVSTQVLFYFILEDFVFYWGHRVLHTKWLYKHVHSVHHEYATPFGLTSEYAHPAEILFLGFATVIGPAITGPHLITLYLWISLRILETVEAHSGYHFPWSPSNFLPLYGGSDFHDYHHRLLYTKSGNYSSTFVYMDWLFGTDKGYRKLKMLKEQEGKAM

SEQ ID NO: 730 - protein, 527 aa, Solanum lycopersicum
MECVGAQNVGAMAVFTRPRLKPLVGRRVMPRKKQSFWRMSSMKVKCNSSSGSDSCVVDKEDFADEEDYIKAGGSQLVFVQMQQKKDMDQQSKLSDELRQISAGQTVLDLVVIGCGPAGLALAAESAKLGLNVGLVGPDLPFTNNYGVWEDEFKDLGLQACIEHVWRDTIVYLDDDEPILIGRAYGRVSRHFLHEELLKRCVEAGVLYLNSKVDRIVEATNGQSLVECEGDVVIPCRFVTVASGAASGKFLQYELGGPRVSVQTAYGVEVEVDNNPFDPSLMVFMDYRDYVRHDAQSLEAKYPTFLYAMPMSPTRVFFEETCLASKDAMPFDLLKKKLMLRLNTLGVRIKEIYEEEWSYIPVGGSLPNTEQKTLAFGAAASMVHPATGYSVVRSLSEAPKCASVLANILRQNYSKNMLTSSSIPSISTQAWNTLWPQERKRQRSFFLFGLALILQLDIEGIRSFFRAFFRVPKWMWQGFLGSSLSSADLMLFAFYMFIIAPNDMRKGLIRHLLSDPTGATLIRTYLTF

SEQ ID NO: 731 - protein, 319 aa, Arabidopsis thaliana
MDGVTYQRFPTVKIRELKDDYAKFELRETDVSMANALRRVMISEVPTMAIHLVKIEVNSSVLNDEFIAQRLSLIPLTSERAMSMRFCQDCEDCNGDEHCEFCSVEFPLSAKCVTDQTLDVTSRDLYSADPTVTPVDFTSNSSTSDSSEHKGIIIAKLRRGQELKLKALARKGIGKDHAKWSPAATVTYMYEPDIIINEEMMNTLTDEEKIDLIESSPTKVFGIDPVTGQVVVVDPEAYTYDEEVIKKAEAMGKPGLIEIHPKHDSFVFTVESTGALKASQLVLNAIDILKQKLDAIRLSDNTVEADDQFGELGAHMREG

SEQ ID NO: 732 - protein, 319 aa, Arabidopsis thaliana
MDGATYQRFPKIKIRELKDDYAKFELRETDVSMANALRRVMISEVPTVAIDLVEIEVNSSVLNDEFIAHRLGLIPLTSERAMSMRFSRDCDACDGDGQCEFCSVEFRLSSKCVTDQTLDVTSRDLYSADPTVTPVDFTIDSSVSDSSEHKGIIIVKLRRGQELKLRAIARKGIGKDHAKWSPAATVTFMYEPDIIINEDMMDTLSDEEKIDLIESSPTKVFGMDPVTRQVVVVDPEAYTYDEEVIKKAEAMGKPGLIEISPKDDSFIFTVESTGAVKASQLVLNAIDLLKQKLDAVRLSDDTVEADDQFGELGAHMRGG

SEQ ID NO: 733 - protein, 320 aa, Helianthus annuus
MDGASYQRFPKVKIRELKDDYAKFELRETDASMANALRRVMIAEVPTIAIDLVEIEVNSSVLNDEFIAHRLGLIPLTSERAMSMRFSRDCDACDGDGQCEFCSVEFHLRAKCINDQTLDVTSKDLYSSDHTVVPVDFSDATSGFENPEDQRGITIVKLRKGQELRLRAIARKGIGKDHAKWSPAATVTFMYEPEIHINEEMMETLSLEEKTSVIESSPTKVFALNPHTQQVEVVDPEAYTYDDEVLKKVEAMGKPGLIEIYAKEDSFIFTVESTGAVKASQLVINAIDVLKQKLDAVRLLEDTVEADDQFGELGAHMRGG

SEQ ID NO: 734 - protein, 319 aa, Solanum lycopersicum
MEGVSYQRFPKIKVREVKDDFMKFELRDTDASIANALRRIMIAEVPTIAIDLVEIEVNSSVLNDEFISHRLGLVPLTSERAMSMRFSRDCDACDGDGQCEYCSVEFYLRVKCLSDQTLDVTSKDLLSSDHTVVPVDYSDASSSFDNTPNKGIIIVKLRRGQELRLRAIARKGIGKDHAKWSPAATVTFMYEPEIYINEDMMESLTLEEKTELVESSPTKVFGIDPENKQVIVVDPEAYTYDDEVLKKAEAMGKPGVVEIHAKEDSFIFTVETTGAVKASQLVLNAIEVLKQKLDAVRLSDDTVEADDQFGELGAHMRGG

SEQ ID NO: 735 - protein, 286 aa, Brassica napus
MGANISGVTPEFDRSSEPRLSDLPENCVALIMMRLDPPEICRLARLSRVFRRASSADFVWESKLPPSYRAIARKVFDEITLRKLLIKKDLYAKLCRPNLFEGGTKELWIDKNTGRLCVSVSSKALRITGIDDRRYWSHIPTDESRFHSVAYVQQIWWFEVGGEFEIQFPSGTYSLFFRIQLGKTSKRLGRRICNSDHIHGWDIKPVRFQLATSDNQQAVSLRYLNNNPGHWSHYHVGDFKVVNPDVSTGVKFSMTQIDCTHTKGGLCIDSVLIVPKENARKVVESE

SEQ ID NO: 736 - protein, 593 aa, Arabidopsis thaliana
MVLLPSMTSLLLVFLFLYGVSPVISDGSDHRYKVGDDVPLYANKVGPFHNPSETYRYFDLPFCSSAPVKEKKEALGEVLNGDRLVSAPYKLEFLGEKNSEVACRKRLSREDVAKFRDVIAKDYYFQMYYDDLPIWGFLGKVVKEGKTDPSEYKYYLFNHLQFEIFYNKDRVIEIIVRTDQNFLVDLTEDKEVQVDFTYTVRWKETEIPFEKRMEKYSLASSMPHHLEIHWFSIINSCVTVLLLTGFLATILMRVLKNDFVKYAHDEEAVDDQEETGWKLIHGDVFRFPKHKSLLAAALGSGTQLFTLAVFIFMLALVGVFYPYNRGALFTALVVIYALTSGIAGYTAASFYCQLEGTNWVRNVILTGSLFCGPLLITFSFLNTVAIAYQATAALPFGTIVVIFLIWALVTSPLLILGGIAGKNRKSEFQAPCRTTKYPREIPPMRWYRRTLPQMAMAGFLPFSAIYIELYYIFASVWGHRIYTIYSILSIVFLILVIVTAFITVALTYFQLAAEDHEWWWRSLLCGGSTGLFIYAYCLYYYYARSDMSGFMQTSFFFGYMACICYGFFLMLGTIGFCASLLFVRHIYRSIKCE

SEQ ID NO: 737 - protein, 131 aa, Unknown
  Sequence found in Organisms: Brassica juncea, Brassica rapa
MAAASLSANQGLLGTSFYGGWGSSISGEDYHTMLAKTTAPRQNFAKLSRKPIRVQPMMKNVNEGKGLFAPLVVVTRNIVGKKRFNQLRGKAIALHSQVITEFCKSIGADAKQRQGLIRLAKKNGERLGFLA

SEQ ID NO: 738 - protein, 915 aa, Arabidopsis thaliana
MERPRAPPSPLNDAESLSERRSLEIFNPSSGKETHGSTSSSSKPPLDGNNKGSSSKWMEFQDSAKITERTAEWGLSAVKPDSGDDGISFKLSSEVERSKNMSRRSSEESTSSESGAFPRVSQELKTALSTLQQTFVVSDATQPHCPIVYASSGFFTMTGYSSKEIVGRNCRFLQGPDTDKNEVAKIRDCVKNGKSYCGRLLNYKKDGTPFWNLLTVTPIKDDQGNTIKFIGMQVEVSKYTEGVNDKALRPNGLSKSLIRYDARQKEKALDSITEVVQTIRHRKSQVQESVSNDTMVKPDSSTTPTPGRQTRQSDEASKSFRTPGRVSTPTGSKLKSSNNRHEDLLRMEPEELMLSTEVIGQRDSWDLSDRERDIRQGIDLATTLERIEKNFVISDPRLPDNPIIFASDSFLELTEYSREEILGRNCRFLQGPETDQATVQKIRDAIRDQREITVQLINYTKSGKKFWNLFHLQPMRDQKGELQYFIGVQLDGSDHVEPLQNRLSERTEMQSSKLVKATATNVDEAVRELPDANTRPEDLWAAHSKPVYPLPHNKESTSWKAIKKIQASGETVGLHHFKPIKPLGSGDTGSVHLVELKGTGELYAMKAMEKTMMLNRNKAHRACIEREIISLLDHPFLPTLYASFQTSTHVCLITDFCPGGELFALLDRQPMKILTEDSARFYAAEVVIGLEYLHCLGIVYRDLKPENILLKKDGHIVLADFDLSFMTTCTPQLIIPAAPSKRRRSKSQPLPTFVAEPSTQSNSFVGTEEYIAPEIITGAGHTSAIDWWALGILLYEMLYGRTPFRGKNRQKTFANILHKDLTFPSSIPVSLVGRQLINTLLNRDPSSRLGSKGGANEIKQHAFFRGINWPLIRGMSPPPLDAPLSIIEKDPNAKDIKWEDDGVLVNSTDLDIDLF

SEQ ID NO: 739 - protein, 259 aa, Unknown
  Sequence found in Organisms: Gossypium hirsutum, Gossypium raimondii
MLLRPVSSLCVQAKQGDNLICSLKGSPVTSSSSSALSFLPRKHGRALGVYASIGTNNHALTGVVFQPFEEVKKEELDIPIAPHLSLARQKYADACEAAINEQINVEYNVSYVYHSLYAYFDRDNVALKGFAKFFKESSEEEREHAEKLMEYQNKRGGRVKLHSILMPPSEFDHAEKGDALYGMELALSLEKLTNEKLLCLHNVAVQNNDAQMADFIESEYLAEQVEAIKKISEYVSQLRRVGKGHGVWHFDQMLLHEGA

SEQ ID NO: 740 - protein, 741 aa, Brassica napus
MDDHESPLLSKESSSSSSSSSVVASSFKWILKVLMSVIFVAWVVFLFVYPGKLGDGILTNWRAVSSHTLFGTTGSMFLIFSGPILVISVLASLYLIISGEENVFTKKKISKFPRFRLWTFPVLVDGPFGVVSAAEFLGIMIFSVFFLWAIYAYTMRDLDLLDLFHVLPEDRSMLLLEITGLRFGMIGLLCMVFLFLPISRGSILLRLVDIPFEHATKYHVWLGHITMAFFSFHGLCYVVAWTVQGRLLELLFEWKAIGIAVLPGVISLVAGLLMWVTSLQYVRKHYFELFFYTHQLYIVFVVFLALHVGDYLFSIVAGGIFLFILDRFLRFCQSRRTVDVISAKSFPCGTLELVLSKPPNMRYNALSFVFLQVRELSWLQWHPFSVSSSPLDGKHHVAVLIKVLGGWTAKLRDKLSKLYEAENPDQLLSPLSYPKITTCVEGPYGHESPYHLAYENLVLVAGGIGISPFFAILSDILQRKRDGKACLPKKVLVIWAIKNSDELSLLSSIDIPSLCPSFSQKINLEINIYVTRQSEPLLEDGMVHKMVNPSVKPRSNGCPMSVLVGTGDNIWAGLYLVSSTIGFVLMITLLDIFYINKFNITAWWYKGLLFVVCMVASVLIFGGLVVVFWNLWGEKAGDVEPNGHDKVTTNGGELHNPSAELKGLNTEDDIQSFITTRYGTRPDFKEIFESLNEKWGSVDVGVIVCGPASLQSTVAKEIRSHSIWRSTNHPLFHFNSHSFDL

SEQ ID NO: 741 - protein, 548 aa, Brassica napus
MELTLNSSSSLIKRKDAKSSRTQENSSNMSFAKTKPPTYQFQAKSSVKEMKFTHEKTYKPESETTERWEKLHVLSYPHPKNDSSVPVFVMLPLDTVTMSGHLNKPRAMNASLMALKGAGVEGVMVDAWWGLVEKDGPMKYNWEGYAELIQMVQKHGLKLQVVMSFHQCGGNVGDSCSIPLPPWVLEEISKNPDLVYTDKSGRRNPEYISLGCDSVPVLRGRTPIQVYSDFMRSFRERFDNYIGGVIAEIQVGMGPCGELRYPSYPESNGTWRFPGIGEFQCYDKYMKSSLQAYAESIGKTNWGTSGPHDAGKYKNLPEDTEFFRRDGTWNSEYGKFFMEWYSGKLLEHGDQLLSSAKAIFQGSGAKLSGKVAGIHWHYNTRSHAAELTAGYYNTRNHDGYLPIAKMFNKHGVVLNFTCMEMKDGEQPEHANCSPEGLVKQVQNATRQAGTELAGENALERYDSSAFGQVVATNRSDSGNGLTAFTYLRMNKRLFEGQNWQQLVEFVKNMKEGGHGRRLSEEDTTGSDLYVGGFVGSKISETVEEAVLV

SEQ ID NO: 742 - protein, 237 aa, Unknown
  Sequence found in Organisms: Zea mays, Sorghum bicolor
MFLTRTEYDRGVNTFSPEGRLFQVEYAIEAIKLGSTAIGLKTKDGVVLAVEKRVTSPLLEPSSVEKIMEIDEHIGCAMSGLIADARTLVEHARVETQNHRFSYGEPMTVESSTQAICDLALRFGEGDEESMSRPFGVSLLIAGHDENGPSLYYTDPSGTFWQCNAKAIGSGSEGADSSLQEQYNKELTLQEAETIALSILKQVMEEKVTPNNVDIAKVAPKYHLYTPAEVEAVIARL

SEQ ID NO: 743 - protein, 386 aa, Arabidopsis thaliana
MAALQYLESLKNTHPELGEWYNSLADLYQKKLWHQLTLKLEQFIALAVFQAGDALIQFYHNFITDFETKINLLKLAHFAVVVSRQYSEKEAAVSYLESVIEKLRATKEPRITEPIIYIETQKALFKLEQGDQKECKKILDDGKSSLDSMTDIDPSVYANFYWVSSQYHKCRQEFSDFYKSALLYLAYTSVEDLSESFKLDLAFDLSLSALLGENIYNFGELLAHPILKSLLGTNVEWLYHILQAFNHGDLVQYQELCRVHNASLIAQPALVENEKKLLEKINILCLIEIIFSRPAEDRTIPLSIIAERTKLSIEDVEHLLMKSLSVHLIEGIIDQVNGTIYVSWAQPRVLGIPQIKALRDQLDSWVDKVHTTLLSVEAETPDLVAA

SEQ ID NO: 744 - protein, 274 aa, Unknown
  Sequence found in Organisms: Brassica napus, Raphanus sativus
MKLDTSGFETSMPTIGFGSSNDMLDGFSTVPSFDLPRTTDFDGFQKEAVQMVKPAKGTTTLAFIFKEGVMVAADSRASMGGYISSQSVKKIIEINPYMLGTMAGGAADCQFWHRNLGIKCRLHELANKRRISVSGASKLLANMLYSYRGMGLSVGTMIAGWDETGPGLYYVDNEGGRLKGDRFSVGSGSPYAYGVLDSGYKFDMSVEEASELARRSIYHATFRDGASGGVASVYHVGPNGWTKLSGDDVGELHYHYYPVPPAIAEQVMEEAAAE

SEQ ID NO: 745 - protein, 260 aa, Unknown
  Sequence found in Organisms: Gossypium hirsutum, Gossypium raimondii
MLLKAAPAFSSLNPQLENQGALFSPFSSSINHQLSSLRNGPGSLVVCAAKGANHKPLSGVVFQPFVEVKKELDLVPSVPQLSLARQKFTDDCEASINEQINVEYNVSYVYHAMFAYFDRDNVALKGLAKFFKESSLEEREHAEKFMEYQNKRGGKVKLQSIVMPLSEFDHAEKGDALYAMELALSLEKLTSEKLFNLRNVAVRNHDVQLTDFIEGEFLAEQVEAIKKISEYVAQLRRVGKGHGVWHFDQMLLREGEEAIA

SEQ ID NO: 746 - protein, 486 aa, Arabidopsis thaliana
MASMSLSFSSSLCSSRIPEGKRRFRHRDVGIVRCVLAASKSSPGSVTKKRLWKDGEFPGITEPVNQRRTPIKNVKKKLDRRSKANGWVNTVTETLSDLIAKKQWLQALEVFDMLREQTFYQPKEGTYMKLLVLLGKSGQPNRAQKLFDEMLEEGLEPTVELYTALLAAYTRSNLIDDAFSILDKMKSFPQCQPDVFTYSTLLKACVDASQFDLVDSLYKEMDERLITPNTVTQNIVLSGYGRVGRFDQMEKVLSDMLVSTACKPDVWTMNIILSVFGNMGKIDMMESWYEKFRNFGIEPETRTFNILIGSYGKKRMYDKMSSVMEYMRKLEFPWTTSTYNNIIEAFADVGDAKNMELTFDQMRSEGMKADTKTFCCLINGYANAGLFHKVISSVQLAAKFEIPENTAFYNAVISACAKADDLIEMERVYIRMKERQCVCDSRTFEIMVEAYEKEGMNDKIYYLEQERQKLMDRTVATKEMENLPAG

SEQ ID NO: 747 - protein, 490 aa, Cajanus cajan
MVSISFSFSSSIVPTPFPLDKSTKTRAQNPIFRVTRFAISAPPSNSVVKKRHWKQGEFPGTSETSLPHSTRRTPIKNIKKKLEKKNEAKAWVNTVTESLSERIDKKQWLQALQVFDMLREQTFYQPKEGTYMKLIVLLGKSGQPHRAHQLFTTMIEEGLDPTPALYTALLSAYCRSNLIDEAFLVLNEMKKLPLCQPDVFTYSTLIKVCVDAFKFDLVELLYEEMAERSIMPNTVTQNIVLSGYGKAGKFDLMEKVLSSMLESTTCKPDVWTMNTIISVFGNMGQIDMMEKWYEKFRNFGIEPETRTFNILIGAYGKKRMYDKMSSVMEYMRKLQFPWTTSTYNNVIEAFAEAGDAKHMECTFDQMRAEGMKADTKTFCCLINGYAGAGLFHKVISSVRLAGKFEIPENIEFYNAVLSACAKAEDLMEMERVFKRMKDSQCQPDDTTYSIMIEAYRKEGMNDKIYYLELDKKTMMTDDKQVSQFENEIFS

SEQ ID NO: 748 - protein, 508 aa, Sesamum indicum
MAAALQLSLSSSFLASPLPSSTLRPTASRPLRRLLISSATAPSSSSSTTLNLPKKKHWKVGEYPGVSEASITHFSSNNKNRTPIKNIKKKLDKKNNAKAWANTVTEALSDAIDKKQWLRALQVFEMLKAQPFYQPKEGTYMKLLVLLGRCGQPGQACQLFDEMLEEGLEPTAELYTALVAACCRSNLIDKAFAILEQMKSLPLCQPDVYTYSILIKACVDASRFELVDSLYDEMAERLITPNTVTQNIVLSGYGKAGKYEEMEKVLSRMLESTTSKPDVWTMNTIISLFGNEGQIEMMERWYEKFRNYGIEPETRTFNILIGAYGKKRMYDKMSSVMEYMRRLSFPWTTSTYNNVIEAFSDAGDAKHMEYTFDQMRAEGMKADTKTFCCLIRGYANAGLFHKVISSVQLAGRLEIPENTSFFNAVIYACSRAEDIMEMERVFKRMKDKLCQPDCTTYSMMMDAYRKEGMSDKVYDLEQEMQMMTGKTCKEYHDVETDAAPDGEKVLLI

SEQ ID NO: 749 - protein, 514 aa, Cephalotaxus harringtonia
MSIGAFIGVGAGKQVLRSSFLPTEFADKSISFPDQGALRFTTSVWKHVVLAKKGSNSRTQSRSVKQIQRKTLKAFREDVDGFSISSANEASSTSSAVIDKNYRLEPEVERSLEALFLLQKSMLEKQWYLSLDPTKFRESDSLNSHKRTEVFRSGKVSARQRRQHARTGSSTHNFVEVELTDQTAYKSNQEHVAVQVGSVRDTMTDSMKGMPNQKLLTHEEVLCLSKKIQNGLTLRKHKSRLKAKLKYEPSNAQWAASMNMSVTELNRNLMESSIAGQKLSMCNIRLVVSIARKYENMGVDLGDLIQEGLMGLRHGIEKFDSSRGFKLSTYVYWWIRQGIIKALIDYRRTVKIPNHVHERLSLIRKAKLSLMESGVVPSLKTVAATINMSEKKVKNATQAIKRTRSLDKEYSGYENSSGRTFHSSLADRNDENHSWFTAERDTLKEDVDKLINVTLKDREKVIIRLYFGLDAHSRTWEDVSKSLGLSRERVRQIGRISLEKLRRATRRHKLEPLF

SEQ ID NO: 750 - protein, 520 aa, Oryza sativa
MTATPAVIGLSAGNRLLSASFGPTDLMPDKVSLGVGGGGGGGGGGGGGDAMSFAPPAPATPKLTAVAAHRLKLSPHGRAQVMRALRHHSSAAAALAPPPPPPPPPTPSPASRAAHAHDLESSLEAIVLLQRSMLEKQWELPFDDDNHAMAIGLAEDDDDTSKATVVVARSSVSARQRRMSGRRRGRTKNGAAHFAVSPELIQSRNRIYLRGTVSKELLTHKQVVHLSHKIKDGIWLQQQRSKLKEKLGNEPSYKQLAHSLKISPPELRSRMHESFLAREMLTMSNLRLVISIAQKYDNLGVELADLIQGGLIGLLRGIEKFDASRGFRISTYVYWWIRQGVSRALAENSKTFRLPTYLHERLIAIRGAKYELEDQGIAPTIENIAGSLNISEKKVLNATEAVNKVLSLDQQAFPSLNGLPGETLHSYIEDQNVANDPWHGFEEWYLKEEVNKLLNSTLNERERDIIRLYHGIGKQCHTWEDISRQFGLSRERVRQVGLIAMEKLKHAARRKNLEALLEDY

SEQ ID NO: 751 - protein, 503 aa, Flaveria ramosissima
MMATNAVVGLRAGEWLLGSTCYYSEVSEKLSCSSNLGFIFVPTTSSITSKKSPNYSHSLVNKRDIHPTRAVKEHVDTALNSSSTDQWDDWVQRLDYLNEEVSEHELPVDALLLLHKSLLEKQWTLSTEETTTTEKNSKKVVTGSGISARRRRLNAQNKTPAKSCSVNQDGRNKQLRSIISSELLQNCQKGYLKGVKNEALLTHSEVVALSEKIKIGLQLEEEKSSLRERLGSEPSEKQLADFLKISQVDLQTKQMECALAREKLTLSNIRLVMSVAQKYKHMGADMSDLIQGGLIGLLRGIEKYDSSRGHKISTYVYWWIRQGVTRTFFENSKTLRLPTHLHERLSAIRTAKAKLERKGITPSIDRIAESLRMSRKKVTNATEAVCKVFSLDKEAFPSLNGLPGDTLHSYIADDCPDNNPWHGVDEGALKEEVRNLIKKTLGEREREIIYLYYGLDNEYLTWEDISRRKGLSRERVRQVGLVALEKLKYAAKNTKLAAMLVYD

SEQ ID NO: 752 - protein, 499 aa, Gossypium hirsutum
MMATAAIIGLTVGKRFLSSSFSYSDIIEKHSYAGDYGGAPHYQTAPTKSLIVAKKSSNCSQSVPSYDRRSRSIKALKEHVDAASLVSTAEPWFQGSNDFEEESYELDYSVEALLLFQKSMLEQQWTLSFERTVFTESPSRKTKKKVPVTCSGVSARQRRFNTRMQPNAKQLRSLISPELLRSRLKGYVRGVVSEELLSHAEVVRLSKKIKAGLSLEDQRLRLKERLGCDPSDEQLATSLKISRAELRSMLIECSLARDKLAMSNVRLVMSIAQRYDNMGAEMPDLIQGGLIGLLRGIEKFDSSKGYKISTYVYWWIRQGVSRALVDNSRTLRLPTHMHERLGLIRNAKYRLEEKGITPTIDRIAESLNMSQKKVRNATKADSKVFSLDRVAFPSLNGLPGETHHSYIADNHEENNPWHGVDEGALKDEVNRLIGITLGEREREIIKLYHGLGKESLTWEDISKRIGLSRERVRQIGLVALEKLKNAARKNGMEAMLLKQ

SEQ ID NO: 753 - protein, 578 aa, Physcomitrella patens
MAVSSLVFIAPTSSSCGCSGIQYRALNLAHTARGRGLESSSSLYFFGGKLQTWKFVENAAKWRNAAGSLRVRCDAGVALVEQRVEEEQKQRLSSDFTTVMKFGGSSVASAHRMREVAQLILSFPDERPVIVLSAMGKTTNNLLKAGEKAVSCGVEESGNIEELQVIRDLHKTTARELKVDESLVTELFEELEQLVMGIALMKELTLRTKDYLVSFGERLSTRLFTAYLNSIGTYARQYDAFDLGIITTDEFTNAEILEVTYPTVRERLLKDLKADADRGTPICVVTGFLGKGVETGCVTTLGRGGSDLTATALGKALGLREIQVWKDVDGVLTCDPRVYSNALPVPFLTFDEASELAYFGAQVLHPQSMRPARDANIPVRVKNSYNPQAPGTLITGERDMSEAEMTSIVLKKDVTMLDIQSTRMLGQVGFLAKVFTTFEHLGISVDVVATSEVSISLTLDPSKLWERELIEQASQCLWLQQELDKMKSELSKIANVQLLKKKSIISLISNVKQSSAVLEKVFRVFKKNDINVQMISQGASKVNISMVVDDDDAPKCVQELHKVFWPDADEATERNGHV

SEQ ID NO: 754 - protein, 575 aa, Brassica napus
MAAAARVQCHNNTSFTGSPLPRRHHNSSTLHASPNRVNFTPLKWIGDGSSSCTRTVSGRPLKGGGTTTARAAFEEEKKTDAVNEVAEEKRRFTCVMKFGGSSVATAERMREVADLVLTFPEESPVIVLSAMGKTTNNLLLAGEKAVSCGVSNASEIEELSVIKELHLRTVKELEIDPSVVSSFLEELEQLLKGIAMMKELTLRTRDYLVSFGECLSTRIFAAYLNKIGVKARQYDAFEIGFITTDDFTNGDILEATYPAVAKRLYDDWMHDPAVPVVTGFLGKGWKTCAVTTLGRGGSDLTATTIGKALGLQEIQVWKDVDGVLTCDPTIYKRATPVPYLTFDEAAELAYFGAQVLHPQSMRPAREGGIPVRVKNSYNPKAPGTIITKTRDMTKTVLTSIVLKRNVTMLDIASTRMLGQVGFLAKVFSIFEDLEISVDVVATSEVSISLTLDPSKLWSRELIQQELDHVVEELEKIAVVNLAKGRAIISLIGNVQHSSLILERAFHVLWTKGINVQMISQGASKVNISLIVNDAEAEGCVEALHKSFFESGDLSELLIQPRLGNGSPVRAMQVEN

SEQ ID NO: 755 - protein, 570 aa, Oryza sativa
MAIALRLAAAPLRLRLVSPAPPAIGGAGDGGRRGGGGAARIGVLGRARCRRRRGGGGRLEVAAAAADDSARCRAKGVGAAAAAAETLGGIGVGGGDQLSVVMKFGGSSVSSAARMREVAGLILAFPEERPVVVLSAMGKTTNLLLLAGEKAVGCGVIRVSEIEEWNLIKDLHIKTVEELALPRSVIHTMLDELEQLLKGIAMMKELTLRTTDYLVSFGECMSTRIFAAYLNKIGVKARQYDAFDIGFITTDDFGNADILEATYPAVAKRLHGDWIRDPAIPIVTGFLGKGWKSGAVTTLGRGGSDLTATTIGKALGLREIQVWKDVDGVLTCDPNIYPNATTVPYLTFEEAAELAYFGAQVLHPQSMRPAREGDIPVRVKNSYNPKAPGTLITKQREMDKVVLTSIVLKSNVTMLDIVSTRMLGQFGFLAKVFSIFEDLGISVDCVATSEVSISVSLDPSKIWSRELIQQELDHVVEELEKIAVVHLLQQRAIISLIGNVRRSSLILEKAFQVLRKSGVNVQMISQGASKVNMSLIVHDSEAKQCIKALHQAFFEDDVLTEVEEEALHMS

SEQ ID NO: 756 - protein, 489 aa, Brassica napus
MALIQQPVQGSSSLCANEIIQTIHCFSRRVASVSAMHTTCSTKSPKERKDKKSSGLISTKHQVDPKRELSRILRTDAAVKSIERKANSEKYNTLWPKAVLEALDDAVKENRWQSALKIFSLLRKQHWYEPRCKTYTKLFKLLGNCKQPEQASLLFELLLSEGLKPTIDVYTSLISVYGKCSLLEKAFATLEYMKSVSDCTPDVFTFTVLISCCCKLARFDLVNRVLLEMSYLGVRCSTVTYNTILDGYGKAGMFEEMENVLADMIEDGDSLPDVYTFNSIIGSYGNGGNIRKMESWYNRFQLMGVEPDITTFNVLILSFGKAGMYKKMSSVMDYMEKRFFSPTVVTYNIVIETFGKAGRIEKMEEVFRKMKYRGVKPNSITYCSLVDAYSKAGLVGKIDSVLRQVVNSDVVLDTVFFNCIINAYGEAGDLATMKELYIQMEERKCKPDKITFATMVKTYAAHGIFDAVRELEKQMISTCESSGKKRLMG

SEQ ID NO: 757 - protein, 806 aa, Phaseolus vulgaris
MAHHPLTHSHSFRERIDETLSGNRNEILALLSRLEGKGKGILQHHQIIAELEEIPEEHRKKLQDGAFGEVLRSTQEAIVLPPFVALAVRPRPGVWEYLRVNAHVLAVDELRPAEYLRFKEELVEGSSNGNFVLELDFEPFNASFPRPTLNKSIGNGVEFLNRHLSAKLFHDKESMQPLLEFLRLHSYKGTTMMLNDKVQNLNSLQHVLRKAEEYLTSVAPATPYSEFENRFREIGLERGWGDTAERVLEMIQLLLDLLEAPDPFTLETFLGRVPMVFNVVILSPHGYFAQDNVLGYPDTGGQVVYILDQVRALENEMLNRIKKQGLDITPRILIITRLLPDAVGTTCGLRLERVYDTEYCDILRIPFRTEEGIVRKWISRFEVWPYLETYAEDVAVELGKELQAKPDLIVGNYSDGNIVASLLAHKLGVTQCTIAHALEKTKYPESDIYWKKFEEKYHFSCQFTADLFAMNHTDFIITSTFQEIAGSKDTVGQYESHTAFTLPGLYRVVHGIDVFDPKFNIVSPGADMGIYFPYTETERRLTNFHAEIEELLYSSVENEEHICVLKDRNKPIIFTMARLDRVKNITGLVEWYGKNARLRELVNLVVVAGDRRKESKDLEEKAEMKKMYGLIETYKLNGQFRWISSQMNRVRNGELYRVICDTKGAFVQPAVYEAFGLTVVEAMTCGLPTFATFNGGPAEIIVDGKSGYHIDPYHGDRAAEILVDFFEKSKADPSHWDKISQGGLKRIQEKYTWQIYSDRLLTLTGVYGFWKHVTNLERRESKRYLEMFYALKYRKLAESVPLAIEE

SEQ ID NO: 758 - protein, 701 aa, Zea mays
MPVAALRPPPVAVGAGRRSARLQARFALRASSLEASAAVTVTVNGSAEAAVERKEKVQEDKDNEGLPVKEEQERGLEVLYDDGFGSVTVKDYFAAAKVLCRDDGGPPRWFSPVECGHPAVDQAPLLLFLPGMDGVGTGLILHHKSLGKVFEVRCLHIPVNDRTPFEGLVQIVENLIKHEHDLSPDRPIYLVGDSFGGSLALAVAARNPQIDLVLILVNPATSFAKTPLQPVLPLLESVPSEFHATVPYLLSFVMGDPLKMAAVSIENNLSPPETLQKLSDSLTSMLPLLSELSDIIPRDTLLWKLKLLKAGAAYANSRLHAVQAEVLLLASGKDNLLPSGEEADRLFKALKNCRVRYFKDNGHTLLLEDGVNLLTVIKGANMYRRGRQRDSVTDYLPPTLSEFRQTFDVDHRLFHLALSPVMMSTLKDGKIVRGLAGVPDKGPVLFVGYHALMGIELSPLYEEFLREKRTVVRGMAHPFLFGKKFESSRQETSRFDTVSMYGGLPVTPINMYRLFQRNQFVLLYPGGVREALHRKGEEYKLFWPDQPEFVRMAARFGVTIIPFGCVGEDDVLELVLDYNDQKNIPGLREWIQSINKEAERVRDSVKGEDGNQDMYLPALLPKVPGRFYYLFGQPIEMKGMGNLVRDRKSANEVYLRIKSQVEEIMSYLKRKREEDPYRSLPQRALYQATWGASAQVPTFEP

SEQ ID NO: 759 - protein, 215 aa, Zea mays
MVFYFKARPEAGDYTIFMGLDKYENEDLIKYGFPEDIWFHVDKMSSAHVYVRLNKGQSMDDMSEGLLEDCAQLVKANSIQGNKVNNIDVVYTPWYNLKKTPSMDVGQVGFHNPKLVRTIKVEKRINEIVNRLNKTKVERKPDLKAEREAISAAEKAERKAQLRDKKRREEMERLEKEKQADIRSYKGLMVQEKMTSNKQIASGSKTLQELEEDFM

SEQ ID NO: 760 - protein, 132 aa, Zea mays
MALEKAKEIIASSPVDLALRKAKETVASHPVVVFSKTYCPFCTRVKQLLAKLGASYKAIELDVESDGAELQSALAEWTGQRTVPNVFVKGERIGGCDATMAMHDGGKLVPLLTEAGAIVTARATATTTTPSL

SEQ ID NO: 761 - protein, 380 aa, Zea mays
MASVAELKEKHAAATASVNSLRERLRQRRETLLDTDVARYSKSQGRVPVSFNPTDLVCCRTLQGHSGKVYSLDWTPEKNWIVSASQDGRLIVWNALTSQKTHAIKLHCPWVMACAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEDDVNSVKFFPDGHRFGTGSDDGTCRLFDMRTGHQLQVYSREPDRNSNELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 762 - protein, 314 aa, Oryza sativa
MAAAARPVDVVRHFPCSSSVAASSSLLLSRSKSRLASPAAAAASSMRRRLVLGVGAAAAPAVAALAASATPAALRDCAATLLITAGAYSLVRAFDGLTARRLIEQNLSRKIVHVLSGVLFMSSWPLFSNSTEARFFAAIVPLLNCIRLLTYGLRLSTDEALVKSVTREGKPEELLRGPLYYVIVLLVSVLVFWRQSPIGIVSLSMMSGGDGFADIVGRRYGSAKLPFNENKSWIGSISMFISGFLLSALMLFYFSCLGYFTVCWDLALGKLALVALAATVVECIPVNDVVDDNISVPLATMLAAYLLFGYSSCC

SEQ ID NO: 763 - protein, 263 aa, Oryza sativa
MLELRLVQGSLLKKVLEAIRELVTDANFDCSGTGFSLQAMDSSHVALVALLLRSEGFEHYRCDRNLSMGMNLNNMAKMLRCAGNDDIITIKADDGSDTVTFMFESPNQDKIADFEMKLMDIDSEHLGIPDSEYQAIVRMPSSEFSRICKDLSSIGDTVIISVTKEGVKFSTAGDIGTANIVCRQNKTVDKPEDATIIEMQEPVSLTFALRYMNSFTKASPLSEQVTISLSSELPVVVEYKIAEMGYIRFYLAPKIEEDEEMKS

SEQ ID NO: 764 - protein, 308 aa, Glycine max
MAYTLSNTLPLSLAFFPDRTLLHPPSTHLFLSRPLRFKSLCVVNLKRPVPPLKASMAETNNNVAVEVFEKEDLAVSLAKYVADLSNKFTSERGAFTVCLSGGSLINYLRKLLEPPYVDTLEWSKWHVFWVDERVVPKTHEDSNYKLALDGLLSKVPIPPGNVYAINDALSAEGAADDYETCLRHLVKNNVIASSPANEFPKFDLMLLGMGPDGHIASLFPGHPLVEEKQRWVTFIKDSPKPPPERITFTLPVINTSAYAALVVTGKGKADAVHSVLGQSQNSVKLPVGLVSPEGELKWFLDKGAASKL

SEQ ID NO: 765 - protein, 173 aa, Glycine max
MTSCTSFASFLISSSSFPSLCFAQTHSITCKQRFPFPSVKGRRKFSTLPFSSTKRLVTRAAEYKFPDPIPEFADAETQKFKSHLLKKLSKKDMYGESIEEVVGICTEIFSTFLHSEYGGPGTLLVLPFVDMADALNEQGLPGGPQAARAAIKWAQDHVDKDWKEWTNGDNNKK

SEQ ID NO: 766 - protein, 863 aa, Zea mays
MASPAGGESPAKPVLLHGDLDLWILEARLLPNMDMFSEHVRRCFAACRPPSSCGTKHPPPAAAGRRHHHHHRNIITSDPYVTLSVSGAVVARTAVIPNSQDPVWEERFAVPLAHRAADLEFQVKDNDTFGAQLIGTVAVPADRVVSGDEVEDWFPVIGTNGKPYKPDTALRLRFKFQPIADNPAYRHGIAGDPDHRGIQDSYFPLRHGGQLTLYQDAHVREGDLPEIELDNGKTFQHNACWEDICHAILEAHHMIYIVGWSVYDKVRLVREPSPSRPLPEGGDLTLGDLLKFKSQEGVRVCLLVWDDKTSHDKFFIKTGGVMATHDEETRKFFKHSSVICVLSPRYASNKLSIFKQQASFGQKFMVVGTLFTHHQKCVLVDTQARGNKRKITAFIGGLDLCDGRYDTPEHRLFKDLDTVFQNDYHNPTFSAGAKGPRQPWHDLHCRIDGPAAYDVLTNFEQRWRKATKWRDRFRRVSHWKDDALIKLERISWILSPSPNVPNNHPSLWVSKEEDHENWHVQVFRSIDSGSLKGFPSDCKAASKLNLVCRKNLVIDKSIHTAYVRAIRSAQHFIYIENQYFLGSSYAWPSYVNSGADNLVPIELALKIASKIKAGERFAVYVVIPMWPEGVPTAASVQEILFFQAQTMEMMYKIIADELKATDNKDMHPEDYLNFFCLGNREEPPSNGSPESEKSTDKSAAALASKYRRFMIYVHAKGMIVDDEYVILGSANINQRSLAGSRDTEIAMGAYQPHYAWSTKNGHPHGQVYGYRTSLWAEHLGTVDDRFKDPSSLECVRFVNQIAVENWQRFTAEEMSTLQGHLLKYPVKVEADGKISPLSDQECFPDVGGKILGAPTSLPDSLTM

SEQ ID NO: 767 - protein, 389 aa, Glycine max
MELLCTANAILPSRSLSIPTPYSLPLKTSLPFPRFNFPKIERLRGLQPCVSVSEGSSAEAEVLEESRIRRVCDKLIGVFMVDKPTPTHWRRLLAFSREWSNLRPHFFARCLERADAAEEDPAMKEKLLRLARKLKQIDEDVQRHNDLLEVVRRDPSGISEIVSKRRKDFTEEFFVHFHTVAESYYENKEEQNELAKLGNACLAAVQAYDAATESVEKLQAAELKFQDIINSPSLDAACRKIDNLAEKKELDSTLVLMITKAWSASKESNMMKDEVKDILYHLYKTAVGNLQRLVPKEIRIVKYLIRIEDPEEQLSALKDAFTPGEELEGTDVDNLYTTPEKLHTWIKSVLDAYHLSGEGTLIREARDLLNPEVIQKLEVLKKVVEKNFM

SEQ ID NO: 768 - protein, 487 aa, Zea mays
MAMQAAFLAGFSQLAAQPSRDCAVAVAPTRVAVAAVGSAKVGARVGLKAGIAAPAPAAGRGVRCRASLIEPDGGQLVDLVAPEEGGRRAALRREAAELPHRLRLGRVDKEWVHVLSEGWASPLQGFMREHEFLQTLHFNAIRGQDGRMVNMSVPIVLSVGDAQRRAIQADGATRVALVDERDRPIAVLSDIEIYKHNKEERIARTWGTTAPGLPYVEEAITNAGDWLIGGDLEIIEPIKYNDGLDQYRLSPAQLREEFARRNADAVFAFQLRNPVHNGHALLMTDTRKRLLEMGYKNPVLLLHPLGGFTKADDVPLSWRMKQHEKVLEEGVLNPESTVVAIFPSPMHYAGPTEVQWHAKARINAGANFYIVGRDPAGMSHPTEKRDLYDADHGKKVLSMAPGLERLNILPFKVAAYDTKQKKMDFFDPSRKDDFLFISGTKMRTLAKNRESPPDGFMCPGGWKVLVEYYDSLVPSEGSSKLREPIAA

SEQ ID NO: 769 - protein, 238 aa, Hordeum vulgare
MSRAATKIFLTPSLLPLPLPQWLRRRRPSISSARRAFAMAASGFGGGEAFPLSSAAGAGALKLHKGDITLWSVDGATDAIVNAANERMLGGGGVDGAIHQAAGPQLVEACRKVPEVKPGVRCPTGEARITPAFELPVSRVIHTVGPIYDMDRKPEVSLKNAYENSLKLAKENGIQYIAFPAISCGIFRYPPKEASNIAISAAQQFSGDIKEVHFVLFSDDLYSIWRETAQEMLMQFEK

SEQ ID NO: 770 - protein, 1958 aa, Phaseolus vulgaris
MSSSRGGAGPSSEAPQPRRIIRTQTAGNLGESVIDSEVVPSSLVEIAPILRVANEVEKTHPRVAYLCRFYAFEKAHRLDPNSSGRGVRQFKTALLQRLERENDPTLKGRVKKSDAREMQSFYQHYYKKYIQALQNAADKADRAQLTKAYNTANVLFEVLKAVNMTQSMEVDREILETQDKVAEKTEILVPYNILPLDPDSANQAIMKFPEIQAAVYALRNTRGLPWPKDYKKKKDEDILDWLGSMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGVLAGNVSPMTGENVKPAYGGEEEAFLRKVVTPIYNVIAKEAARSKKGRSKHSQWRNYDDLNEYFWSGDCFRLGWPMRADADFFCLPSENSFFDKSNDDKPPSRDRWVGKVNFVEIRSFWHIFRSFDRMWIFFILCLQAMIIVAWNGSGDPSVIFNGAVFKKVLSVFITAAILKFGQAVLDVILSWKAQWSMSLYVKLRYILKVVSAAAWVIVLSVTYAYTWDNPPGFAQTIKSWFGNGGSSAPSLFILAVVVYLSPNMLAAIFFLIPFIRRHLERSNYRVVMLMLWWSQPRLYVGRGMHESTFSLFKYTMFWVLLIITKLAFSYYIEIKPLVGPTKAIMSVKITTFQWHEFFPHARNNIGVVIALWSPIILVYFMDTQIWYAIFSTLFGGIYGAFRRLGEIRTLGMLRSRFESLPGAFNASLIPEEASEPKKKGLKATLSRRFPNISSNKGKEAARFAQLWNQIITSFRDEDLISDREMDLLLVPYWADTQLDLIQWPPFLLASKIPIALDMAKDSNGKDRELKKRIGLDTYMSCAVRECYASFKSIIKHLVQGERETKVIEYMFDEVDKHIESDKLIVEFRMSALPNLCKQFVQLIEYLLANDPKDRDLVVILFQDMLEVVTRDIMMEDQDQIFSLVDSTHGGTGHEGMLHLEPEPHHQLFASEGAIKFPIEPFTAAWTEKIKRLFLLLTTKESAMDVPSNLEARRRISFFSNSLFMDMPLAPKVRNMLSFSVLTPYYTEEVLFSLQDLDSPNEDGVSILFYLQKIFPDEWNNFIQRVKSTEEDIKGCESDELVEELRLWASYRGQTLTRTVRGMMYYRKALELQAFLDMAKDEDLMEGYKAVENSDDNSRGERSLWTQCQAVADMKFTYVVSCQQYGIDKRSGSRLAQDILRLMTRYPSLRVAYIDEVEEPVKDSKKKINKVYYSCLVKAMPKSNSASEPEQNLDQIIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTVGFYFSTLITVLTVYIFLYGRLYLVLSGLEEGLSTQKAIRDNKPLQVALASQSFVQIGVLMALPMLMEIGLERGFRTALSEFILMQLQLAPVFFTFSLGTKTHYFGRTLLHGGAKYRPTGRGFVVFHAKFADNYRLYSRSHFVKGIELMILLIVYQIFGHSYRSAVAYILITASMWFMVGTWLFAPFLFNPSGFEWQKIVDDWTDWNKWISNRGGIGVLPEKSWESWWEEEQEHLQYSGLRGIIVEILLSLRFFIYQYGLVYHLNITKKGQKSFLVYGISWLVIFVVLFVMKTVSVGRRKFSANFQLVFRLIKGMIFLTFVSILVILIALPHMTVQDIVVCILAFMPTGWGMLQIAQALKPLVRRAGFWGSVKTLARGYEIVMGLLLFTPVAFLAWFPFVSEFQTRMLFNQAFSRGLQISRILGGQRKERSSRNKE

SEQ ID NO: 771 - protein, 760 aa, Phaseolus vulgaris
MWRLKIGDGGKNPYIFSTNNFVGRQIWEFDSEAGTDEERAQVEAARQHFYQNRFKLKACGDRLWRFQILREKKFKQKTRKVKIEDDEEITWEKATLTLKRTSHYLSALQTSDGHWPAHLGGSHFFIPIMVISIYSTGHLDSVLPKEYRKEILRYLYNHQNDDGGWGLHIEGPSTMYGTTLNYISMRLLGEGANGGHNNACVKARKWIHDHGSVTHVPSWGKFWLSVLGIVDWSGCNPLPPEFWILPTILPMHPAKMWYYCRHVYMPMSYIYGKRFVCPITPLIRELREELFIQPYDESIWKKARHKCAKEDLYYPHHWIQDLIWDSAYLVTEPLLTRWPFNKLIREKALQVAMKLIHYEDENTRYIDGGCVNKALSMLACWVEDPNGDAFKKHVARVPDYLWLSEDGMCIHALSTQSWDAGFIVQALLATNLIDDLGPTLAKAHDFIKKSQVVENRSGDFKSMFHHISKGSWTLADRDHALQLSDGTAECMKCCLLLSMLPEEIVGEKLEPERLYDSVNFLLSLQSKNGGVTVWEPAIAQKWLEHLNPAEFLADIVIEHEYLECTGSTIQALVLFKKLYPNHRREEIDNFIVKAAQFIEDEQLPNGNWHGNWGVCFTYGAWFAVGGLAAAGKSYSNCVAIRKAVKFLLSIQNEDGGWGESYLSCPMKTYVPLEGNRSNVGQTAWALLALILSGQAERDPTPLHRAAKLLINSQLEDGDWPQQEALGVYKRSCLLHYPFYRTVFPLQALSEYRNNVLVPST

SEQ ID NO: 772 - protein, 321 aa, Zea mays
MARLLLFPSQACVDPGRHLLLHPPVSRPRAVRSGPPPAAPRRTGVVSLPGRCPPPLCWNHHPFLPCRSSKRGWVVFASENVQEISSHLPRKDERRSGNLLLRFSALPYCTMAWLSTAQLAQSSVGEKLNMVYEVGELFELGIQLSYLLILIGLLGAGTFFVIRQVLVRRELDLSAKELQEQVRSGDASATEYFELGAVMLRRKFYPAAIKYLQQAIDKWDRDEQDLAQVYNALGVSYKRENKLDKAIQQFQKAVELQPGYVTAWNNLGDAYEQQKDLKSALKAFEEVLLFDPNNKVARPRVDDLRPRVSMYKGVPVKSEKR

SEQ ID NO: 773 - protein, 921 aa, Zea mays
MEGALVQSAIVPAVYRSSSGRFRVRARARTNATMVRNTPTRTLTLGGFQGLRQTNFLDTRSVIKRDFGSIVASQIARPRGSASRGVVRAMFERFTEKAIKVIMLAQEEARRLGHNFVGTEQILLGLIGEGTGIAAKVMKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRQDQIERVTQILGRRTKNNPCLIGEPGVGKTAIAEGLAQRISNGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDDALIAAAQLSYQYISDRFLPDKAIDLIDEAGSRVRLRHAQLPDEAKELDKELRQITKQKNEAVRGQDFEKAGELRDREMELKAQITAIIDKSKEMIKAETESGDVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKEINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 774 - protein, 648 aa, Zea mays
MKRARSSEVFIGVGRLRARRGLAPLLAAAAFAYLLFVSVKLTYLGSAGPAPAVGRLATTGAGEPAARARSSGGGAVSGYGRITGEILRRHEAFEERRKRWGQLGNFTELERVAAEAWALGAAAWEEASAFDGDVDYIASRDVAGEGTAKCPGSLALGAGETTAFLPCGLAAGSAVTVVGTARTARPEYVEALERSGTGNGTVLVAQFAVELRGLRATDGEEPPRILHLNPRLRGDWSSRPVLEMNTCFRMQWGRAQRCDSTPSGDDDLVDGLRKCEKWDWQDVVESKETKTSSWFNRFIGRAKKPEMRWPFPFSEGKMFVLTIQAGVEGYHINVGGRHVASFPHRMGFALEDATGLAVTGGIDVHSVYATALPKAHPSFSLQQVLEMSERWKARPVPEEPIHLFIGILSATNHFAERMAIRKTWMQFPAIQSGNAVARFFVALSHRKEINAALKKEAEYFGDIVILPFIDRYELVVLKTVAICQYGVHNVTADYIMKCDDDTFVRLDIVLHQISTYNKTSPLYLGNLNLLHRPLRRGKWAVTYEEWPEAVYPPYANGPGYVISAGIARDVASRHTNHSLRLFKMEDVSMGMWVEDYNASAPVQYVHSWRFCQFGCVDNYFTAHYQSPRQMLCLWEKLSAGRAHCCNYR

SEQ ID NO: 775 - protein, 1013 aa, Zea mays
MELALASAKPSPRAAGAFPPLIFSPLKPFPLLRFPPRRTAAAALRLRLRLRAAAADAGETSPGEEVFGARRELTGIQPLVEALPPAARTAAELAVAAAAVAAGYGIGLRAGGGSRAVAVAGAAVLCAASVAGAAAVNSVVPEVAAVGLHNYVAGHDDPTNLDNGEVEAIAKKYGVSTQDDAFKAELCDLYARYLYSVLPPGDEDLKGTEVQAIIKFKSALGLDDVDAANMHMEIGRRIYRERLETSDRDADMEQRRASAFQKLIYVSNLVFGDASVFLLPWKRLFGVTDSQIDIAMRENAKNLYSVQLKSIGRGLDIGTLIEVRRAQLAYKLSDEIAAEMFREHAKQLVQENISSALDILKSRIPDSLTQAVEEVNIVIKFNSLLTTLSKHPEADNFARGLGPISLAGEDDHDRRADDFKILYKAYATEVLSDGIVDDKKLSPLNELRNIFGLGKREAEGILSDAKAHIYRRTLAKSFNTELASVHSKAAFLQTLCEKLQFDPELASKMHEEIYRQKLQQFVTDGELSKEEVEALMAFQVRLCIPQETVDAAHTEICGQLFEKVVKEAIASVDGYNADRREAVRKAAQSLNLKTEAVMTIFSKAVRKLFLSYIQRAKEAGNRIETAKELKKLISFNIVVVTELLADIKGELSPVAETEASSAASESEGEDGEHEWESLDTLRKTRPDKELKEKLRKSSQKEITLKDDIPLRDRAELYETYLMFCITGETTNVSFGTAISTKKDDSEFLMLKQLGDILGLTRKEAQDVHIKFAEKAFVQQAEVILADGKLTEAKADQLAKIQKQVGLPTEHAQKIIKGITTTKLSSAIEASVARGQIGIQQVRGLKEANFQLDSLIAEPQRESIYRKTVEELFSSGTGDFDEEEMYVKIPADLIISSEKAKSIVQDIAKVRLENSLVQAIALLRQKKRDDVLSSLNDMLACDAAVPASRPLSWPTPGELDDLFAIYLKSIPKPEKLSRLQYLLGISNEKANEMQYAASEGSLPVAAEEKEELAF

SEQ ID NO: 776 - protein, 478 aa, Zea mays
MAELKRLSESRDLTRIERIGAHSHIRGLGLDSSMEARDTSEGMVGQLHARRASGLILQLIRQGKIAGRAVLLAGQPGTGKTALAMGIAKSLGAETPFASVAASELFSLDLSKTEALTQAFRRAIGVRIKEEAEIIEGEVVEISIDRPLSASGVGGSSVAPSGATAAGKSGRLTLKTTDMETVYELGGKMIEALVKEKVQSGDVIALDMASGKVTKLGRSIGRSRDYDAVGPHTKFVKCPDGELQKRKEVVHCVTLHEIDVINSRTQGFLALFTGDTGEIRAEVREQIDTKVAEWREEGKADIVPGVLFIDEVHMLDIECFSFLNRALENDMAPILVIATNRGITSIRGTNYRSPHGIPPDFLDRLLIITTHPYTEDEIRKILDIRCDEEDVEMSADAKVLLTKIGVETSLRYAINLITSAALACQRRKGKVVEMEDISRVYQLFLDVKRSTQYLMEYQSQYMFNEVPGQADGEDAMQS

SEQ ID NO: 777 - protein, 211 aa, Zea mays
MGFAAFLYLAGFLSDSSGATSVLTETEKTTVLKLQVGLLGMARSFQKELDQIAEKADTSTPAGLSYVLTETTLALLRHPDCCISAYSSVDVKRSIDNGEKRFNQLSIEERGKFDEETLVNVNSIKRNKGGSQRSSGFSNEYIVITILVAAEGVHKVPVINSSNDLKTALQKMGAIPSRKILAVEVLWTPQNENDTLSERELLEDYPLLRPL

SEQ ID NO: 778 - protein, 1792 aa, Zea mays
MSLLRNRRAAAAAAAAAAAAGGGGYPEPPAYNIIPIHDVVMHGEHPSLRFPEVRAAVEALAHAADLPPPPLARAWDAFRADLFDWLGATFGFQLDNVRNQREHLVLLLANAQLRAGGTLPTDHPADVLHHSIARDIRRKLLKNYKTWCSYLGKRPHVHVPSGGRRVAQGVGPDTRRDLLYTALYLLIWGEAANLRFMPECLCYIFHYMALDLNHVIDQSIDIETGRPSVPAVHGVDAFLDKVVKPIYDVLEAEVKFSRNGTKPHSAWRNYDDVNEYFWSRRVFRRLQWPLSPARSFFIKPGNPGRIGKTGFVEQRSFWNVYRSFDRVWVMLILFFQAAMIVAWDGHTPWFSLRYRDIQIRVLSVFITWAALRIVQAVLDAGTQYSLVRTDTIFLAVRMVLKVLVAVGWTITFIVLYVRMWNQRWHDRRWSFSANSRVLNYLEAAAVFLIPQVLALVLFIVPWIRNFLEKTNWRILYVLTWWFQTRTFVGRGVREGLIDNIKYTTFWVCLLTAKFSFSYFLQIRPMVKPTKTILSLHDIRRNWFEFMPHTERIAVIFLWAPVVLIYLMDIQIWYAIFSSLTGALIGLFSHLGEIRSVEQLRLRFQFFASAMQFNLMPEEHLDAVHGGLRSKLYDAINRLKLRYGFGRPYRKIEANEVEAKRFALIWNEIIQTFREEDIISDNEVELLELPPVVWKIRVVRWPCFLLNNELLLALSQAKELVADDRTHWSRIRNNEYRRCAVIEAYDSIRHLLLEIIEDGTVEHIIFSQLFFAFDAAMENGKFCEEYKIELLPEIHSSVIALVELLLKEKKDQTKIVNTLQTLYVFAIHDFPKNKKDMEQLRRERLAPSTLEDSRLLFEDVIKCPGNDDVSFYKQVRRLHTILTSRDSMNNVPKNPEARRRITFFSNSLFMNMPRAPTVEKMMAFSVLTPYYNEDVMYNKDQLRRENEDGVSILFYLQKIYEDDWGNFLERMQRDGMTDDSEIWAGKYQELRLWASYRGQTLARTVRGMMYYHRALKMLAFLDTASEVDITEGTKHLASFGSVRHENDVYPMNGGFRRQPQRRLDRGTSTVSQLFKGQEDGAALMKYTYVVTCQIYGKQKIAKDQRAEDILTLMKKNEALRVAYVDEVHQRGYTEYYSVLVKFDQSLQREVEIYRIRLPGELKLGEGKPENQNHAIIFTRGDAVQTIDMNQDNFFEEALKMRNLLEQYNYYHGSRKPTLLGVREHVFTGSVSSLAWFMSAQETSFVTLGQRVLANPLKVRMHYGHPDVFDRLWFLTRGGLSKASRVINISEDIFAGFNCTLRGGNVSHHEYIQVGKGRDVGLNQISMFEAKVSSGNGEQTLSRDVYRLGHRLDFFRMLSVFYTTVGFYFNTMLVVLTVYTFVWGRLYLALSGLEAGIQGSANSTNNKALGTVLNQQFIIQLGFFTALPMIIENSLEQGFLPAIWDFFTMQMNFSSVFYTFSMGTKSHYYGRTILHGGAKYRATGRGFVVQHKSFAENYRLYARSHFIKAIELGIILTVYAAHSVIAKNTLVYIIMNISSWFLVVSWIMAPFAFNPSGFDWLKTVYDFDDFMNWIWYPGGLFSKPEQSWEVWWYEEQDHLRTTGLWGKILEILLDLRYFFFQYGVVYQLKIANNSRSIAVYLLSWICVAVIFGLFVLMSYARDKYAAKQHLYYRVVQTAVITLVVLVLVLFLKFTEFQIIDIFTSLLAFIPTGWGLISIAQVIRPFIESTVVWDSIISVARLYEILLGVFIMAPVALLSWLPGFQEMQTRVLFNEGFSRGLQISRILTGKRTNTV

SEQ ID NO: 779 - protein, 403 aa, Zea mays
MALCAAAASTATASASAHLSASTARPRGPSSTSLPSSFVGAFPCAVAARTRRRRAAAAAARATVTVRAEARKSVLIVNTNGGGHAVIGFYFAKELLAAGHAVTVLTVGDEASDKMKKPPFSRFSELTSAGGRTVWGDPADVGAAVGGASFDVVLDNNGKDLDAVKPVADWAKTAGVGQFLFISSAGIYKPTEEPPHVEGDAVKESAGHVGVEKYIAEQFGSCWASFRPQYMIGSGNNKDCEEWFFDRIVRNRPVPIPGNGMQLTNVAHVRDLSSMLSLAVEKPGAAAGRVFNCVSDRAVTLAGMAKLCAAAAGADAVDIVLYDPAAVGVDAKKAFPFRNMHFYSEPRAAKEALGWTSTTNLPEDLKERYAEYAASGRGDKPMAFDLDDVILAAVGKAPASVAV

SEQ ID NO: 780 - protein, 190 aa, Zea mays
MALAPAPLQCFLTSSRPAVCTATPPNKRARRPSRISCRASGDDKDKVPSSGGSDLGVKQLGKLAMVALAAGVLVLGPVDGAVAAKSGGRVGGQAFRSAPRSSGPRINNSRTNIYINPPVAPPLGGYGYGSPFFGGYGYGWSPFSFFAPGPSVAVGVGGGFDTLVLFLVLGAVVGAVRRFLNRNNDDYDDY

SEQ ID NO: 781 - protein, 503 aa, Zea mays
MAAAALAMAEQVVAELRVRCETPPSMLREVAVEMAREMGAGLEKDGGSRVKMLLSYVDKLPTGREEGLFYGLDLGGTNFRVLKVQLGGNAKHVVDRDSREVGIPPHLMSGSSSELFGFIASELAKFVDDDEKCANISNGKKREIGFTFSFPVKQRSVASGTLVKWTKAFSINDAVGEDVVAELQTAMEKQGLDMHVAALINDAVGTLAGARYYDKDVVAGVIFGTGTNAAYVEKANAIPKWEGELPHSGDMVINMEWGNFFSSHLPITEYDQELDKESLNPGEQIYEKLTSGMYLGEIVRRVLLKISLQSAIFGDIDHTKLQTHFLLRTPHISAMHHDETSDLKIVAENFEENLEITGTSLEARKLVVEICDIVATRAARLAAAGLAGILMKIGRDHSVEDQRSVIAIDGGLFEHYTKFRRCLETTLGELLGDEASKAVAIKHADDGSGIGAALIAASQSQYKNDLVAVKHADDGSGVKYAEDKRADDGSEIGAALIAASQSQ

SEQ ID NO: 782 - protein, 1638 aa, Medicago truncatula
MAPKSGKGKTNKAKTEKKKKEEKAVAPSLVDIIVVTPYDSQIVLKGISTDKILDVRKLLAVKVETCHFTNYSLSHEVKGQRLNDRVEVVTLKPCLLRMVEEDYIEESQATTHVRRLLDIIACTTKFGKPKRNIPGPDSSKPKKNGKAHNQNKNGLSPPATPNGETRVGSPTSEPASPISENVGMVAIHPTPKLSDFYEFFSFSNLTPPILHLKKCELKEEDDRGKGGYFQLQVKISNGKVIEVVASEKGFYSVGKLSLQSHTLVDLLQQLSRGFANAYGSLMKAFAERNKFGNLPYGLRSNTWLVAPSVGESLSNFPPLPAEDENWGGNGGGQGRNGEYERRPWATDFEILASLPSKTEEERVIRDRKAFLLHNQFVDTSIFKAVAAIQDVMESKSSMNSSPGSVMHQDQVGDLSIVVERGGNGKFDSTLNESSKQSDDVQKNLIKGLSADESVTVNDTSSLAVVVVHHCGYTATVKAIGKANTRKPKVQDIEIDDQPEGGANALNINSLRALLHKSGVDSSEGTLTSLSNFDDLDASKYLVRKVVEESIEKIKEEPSVSKRSIRWELGSSWMQHLQKQENSTDGSSNNNKDGSDVEPAVKGLGKQFKLLKKREKKPSDLNGADSVEQNNDEPNNDEPSSLNELETLLSPEAFLRLKESGSGLHLKSVDELINMAHKFYDEVALPKLVTDFGSLELSPVDGRTLTDFMHLRGLKMGSLGEVVKLSENLPHIQSLCIHEMITRAFKHLFKAVIASVDNAADLPSVIALTLNFLLGGCQTEDTDQTLGDDHHLKIHWLRMFLSKRFGWTLKDEFQHLRKLSILRGLCHKVGLELFPRDYDMESPKPFGKFDIISLVPVCKHVGCSSIDGRNLLESSKIALDKGKLEDAVSYGTKALAKMMTVCGPYHRNTASAYSLLAVVLYHTGDFNQATIYQQKALDINERELGLDHPDTMKSYGDLSVFYYRLQHIELALKYVNRALFLLHFTCGLSHPNTAATYINVAMMEEGMGNVHVALRYLHEALKCNKRLLGADHIQTAASYHAIAIALSLMEAYSLSVQHEQTTLKILQAKLGAEDLRTQDAAAWLEYFESKAIEQQEAAKNGTPKTDTSIASKGHLSVSDLLDFISPDNDSKGNDAQRKQRRPKILPISDNNSQEHDDTPIVDDIVIVDNAKDAAKAVEGKIEEPKAKHGTEEPKKIVDLSMHKPVVTVEAVYETSSDEGWQEANSKGRSGNAANRKSGRRQRPVLSKLTVKGSDNHMYKEASYRNDTTLHQKAAPKVASAMLSPSRKSKTPKALSSKISSTPASLSSLASKSISYKEVAAAPPGTVLKPLLEKTETEKVNDENEMPKNEGSVETSNADTVPQKDEKEPSDADTDPQQDESEQDNSSSELEKVSPSSDQAKSSETNGSKLSAAAKPFSPGTLSASRHLNPVPPASIYDANVSPGILVEPVLPPAAARVPCGPRSPLYYRTNYTFRMKHSSTKIREISGSGGPKIMNPHAPEFVPRSASQIETSEKNSTSKNSLSESEKSEIARQILLSFLVKSVHQNADAVDEPKVSEGKVESFENSSDEVAKDSAVIKIMYGTEEKNKTVVNSSDDSEEQDNLDGEGFVVVTNRRKSRQKTTNGVAELYNQPSICASVR

SEQ ID NO: 783 - protein, 264 aa, Medicago truncatula
MATNSLHSIQHHSLSKRHYYPSETAPPSTLSSSLFLKPTTINPTNITLSHSSSSNSSITFSISQTTSSTPSSTSQTSSFELLQQHLSAKNFREADEETRRLLIVLAGEAAQKRGYVFFSEVQFISEEDLKTIDQLWRDHSDNKFGYSVQKKLFGKAKKDFTKFFIKVGWMKKLDTEMEQYNYRSFPTEFIWELNDDTPEGHLPLTNALRGTQLLSYIFNHPAFDSVPDEVEVSFGSTEGNGALKGLKDSSKPLATKIFKTDYSF

SEQ ID NO: 784 - protein, 400 aa, Medicago truncatula
MAATLQTPLYAAISSSPASSSSSSSSIRTTTSFSFFRSTPPPTLLFNSKNSFSLIRASSTDTVITELDAVSAFSEIVPDTVIFDDFQKFPPTAATVSSSLILGICGLPDTIFRKAVEMALADSECYGLQDPNARLSCFATKALVNVGSDMTKLVPGRVSTEVDARLAYDTHGIIRKVHDLLKLYNDSNVPHERLLFKIPSTWQGIEAARLLESEGIQTHLTFVYSFAQAAAAAQAGASVIQIFVGRVRDWARNHSGDKEIESAKLNGEDPGLALVTKAYNYIHQYGHKSKLMAAAVRNKQDLFSLLGVDYIIAPLKVLQSLKESVASGDEKYSFARRLSPQSADRYMFSDEELVKWDQMSLTNAMGPAAVQLLTSGLDGYADQAKRVEDLFGKIWPPPNV

SEQ ID NO: 785 - protein, 528 aa, Oryza sativa
MADDSASPSPSSASPLQHHREALKSSVRNTAASRRREQAIAIGKERREALIRAKRVCRAPISGSDEAEMEEGDMVVDEEKACLEAKTAHAVEELKSALSIQGKGVQKKKIEALRDLRRLLSQPEVPLVDTAIKAGAVPLLVQYLSFGSSDEQLLEAAWCLTNIAAGEPEETKSLLPALPLLIAHLGEKSSTLVAEQCAWAIGNVAGEGAELRSTLLAQGALRPLTRLMFSSKGSTARTAAWAMSNLIKGPDPKAANELITIDGVLNAIIASLEKEDEELATEVAWVVVYLSALSDRGISLIVRSSVPQLLIGRLFSSENLQLLIPVLRGLGNLIAADDYMVDSVLTVGHNIIDQALSGLIKCLKSDNRVLRKESSWALSNIAAGSFEHKKLIFASEATPVLIRLVTSMQFDIRREAAYTLGNLCVVPTGNCELPKIIVEHLVAIVDGGALPGFIHLVRSADVDTAGLGLQFLELVMRGYPNKQGPKLVEMEDGIEAMERFQFHENEQMRNMANGLVDEYFGEDYGLDE

SEQ ID NO: 786 - protein, 199 aa, Oryza sativa
MENEFQDGKTEVIEAWYMDDSEEDQRLPHHREPKEFIHVDKLTELGVISWRLNPDNWENCENLKRIREARGYSYVDICDVCPEKLPNYETKIKSFFEEHLHTDEEIRYCLEGSGYFDVRDQNDQWIRIALKKGGMIVLPAGMYHRFTLDTDNYIKAMRLFVGDPVWTPYNRPHDHLPARKEFLAKLLKSEGENQAVEGF

SEQ ID NO: 787 - protein, 511 aa, Oryza sativa
MAGGGVAALGVKKERAAEYKGRMTLAVGMACLVAAVGGAIFGYDIGISGGVTSMDPFLKKFFPVVFRKKNDDGQNNYCKYDNQGLSAFTSSLYLAGLVSSLAASPVTRNYGRRASIVCGGLSFLAGATLNAAAVNLVMLILGRILLGVGIGFGNQAVPLYLSEMAPAHLRGALNMMFQLATTLGIFTANMINYGTQHIRPWGWRLSLGLAAAPALLMTVGGLLLPETPNSLIERGRVEEGRRVLERIRGTADVDAEFTDMAEASELANSIEHPFRNILEPRNRPQLVMAVCMPAFQILTGINSILFYAPVLFQSMGFGGSASLYSSVLTGAVLFSSTIISISTVDRLGRRKLLISGGIQMIICQVIVAVILGVKFGTDKELTRSYSIAVVVVICLFVLAFGWSWGPLGWTVPSEIFPLETRSAGQSITVAVNLFFTFVIAQAFLSLLCALKFGIFLFFAGWITVMTVFVHVFLPETKGVPIEEMVLLWRKHWFWKKVMPDLPLEDGDSHHK

SEQ ID NO: 788 - protein, 656 aa, Sorghum bicolor
MRRSSGPGTPCRRRAIQVLVAVSLAYALAVLLLESPLVSTSLPGAGASAAASRKLHLDGAWEGVGRTAPARPGKHPHRETLSADAWWGRARRLAGIVSGLELRHLNSTRSGSLRKVAAEAAESGARVFSGLEALATTLASSRDSSGEEEKSKCPHSIVLSGDEFRERGRTVELPCGLTLGSYITVAATPHQAHPERDPKITMLREGEEPIMVSQFMMELQGLKTVDGEDPPRILHFNPRLRGDWSGKPVIEQNTCYRMQWGTPLRCEGWRSRADEETVDGLVKCEKWIRDDEGRSEESKTSWWLNRLIGRTKTVSVDWPYPFVEDRLFVLTLTAGLEGYHVNVDGRHVTSFPYRTGFVLEDATGLSLNGDLDVQSVFAGTLPTTHPSFSPQKHLEMLPSWQAPPLPDEPVEIFIGILSAGNHFAERMAARKTWMSAAQKSSNVVARFFVALHGRNEVNVELKKEAEFFGDIVIVPFMDSYDLVVLKTIAICEYGVHVVSARYIMKCDDDTFVRLDSVMAEVKKIQNGISLYIGNMNYHHKPLRDGKWAVTYEEWPEEDYPIYANGPGYVISSDIADSILSDFLNHKLRLFKMEDVSMGMWVERFNNTRFVKYVHSVKFCQFGCIDDYYTAHYQSPRQMLCLWDKLQAGKAQCCNMR

SEQ ID NO: 789 - protein, 236 aa, Sorghum bicolor
MAPRDLLLLLLAAVLLPSSSTAADPDAVQDYCVPETGAGARDRAVPVDLSLLPSYPCRSPANLTAADFASAAVRAAGNFSADTGFAGVSVTPATFPALHTLGMSFARADLSAAGGVNPPHYHPRATETALVLSGRVYAGFVDTGGRVFAKVLEKGEVMVFPRAMVHFQMNVGDEPATVYGSFNSENPGIVRIPATVFGSGIKEGVLERAFGLSPEELRRLEKRFGPPKTKTAEMDD

SEQ ID NO: 790 - protein, 389 aa, Glycine max
MDTGSDLVWFPCAPFKCILCEGKPNASPPVNTTRSVAVSCKSPACSAAHNLASPSDLCAAARCPLESIETSDCANFKCPPFYYAYGDGSLIARLYRDTLSLSSLFLRNFTFGCAYTTLAEPTGVAGFGRGLLSLPAQLATLSPQLGNRFSYCLVSHSFDSERVRKPSPLILGRYEEEEEEEKVGGGVAEFVYTPMLENPKHPYFYTVGLIGISVGKRIVPAPEMLRRVNNRGDGGVVVDSGTTFTMLPAGFYNSVVDEFDRGVGRVNERARKIEEKTGLAPCYYLNSVAEVPVLTLRFAGGNSSVVLPRKNYFYEFLDGRDAAKGKRRVGCLMLMNGGDEAELSGGPGATLGNYQQQGFEVEYDLEEKRVGFARRQCASLWERLNRDKN

SEQ ID NO: 791 - protein, 429 aa, Glycine max
MEKLNLALVSSPKPLMLGHVPARDVFRRKHFSFGRVLIAPHRCRFRVSALSSSHHNPKSVQEKLIVKHFASISSSNTQETTSIGVKPQLSPSPSSTIGSPLFWIGVGVGLSALFSVVASRLKKYAMQQAFKTMMGQMNSQNNQFGNAAFSPGSPFPFPMPTAAGPTAPASSATTQSRAPSASSASQSTITVDLPAAKVEAAPTTNVKDEVELKNEPKKIAFVDVSPEETVRESPFESFKDDESSSVKEAWVPDEVSQNGAPSNLGFGDFPGSQSTKKSALSVDALEKMMEDPTVQKMVYPYLPEEMRNPTTFKWMLQNPQYRQQLEEMLNNMGGSTEWDNRMMDTLKNFDLNSPEVKQQFDQIGLSPEEVISKIMANPEVAMAFQNPRVQAAIMDCSQNPMNITKYQNDKEVMDVFNKISELFPGVGSP

SEQ ID NO: 792 - protein, 209 aa, Glycine max
MINKVAVLLVVLLFIIAALASDPDPVMDFCIAKSPDNSFSCKNSSTATVEDFTYSGIKSPGNFKQTGFSSMAVNSNVFPGLNTLGVSFVRADFGVGGVNVPHFHPRATEVAFVLEGKIYSGFVDTNNKVFAKVLEKGEVMVFPRGLVHFQMNVGDRPATILGSFDSQNPGLMRIPNAVFGSDIKEELLEKAFGLSSKELSKLKKRFSPS

SEQ ID NO: 793 - protein, 926 aa, Solanum lycopersicum
MPGNKYTGNQAVASTRLERLLRERELRKSSKVSHFPNESTDNNRGNELSDHDFRQGEADNGGVSYVEQYLEGAALAYNEGWERPDGKPTRQRLLVVANRLPVSAVRRGEESWSLEISGGGLVSALLGVKEFEARWIGWAGVNVPDEAGQRALTKALAEKRCIPVFLDEEIVHQYYNGYCNNILWPLFHYLGLPQEDRLATTRSFQSQFAAYKKANQMFADVVNEHYEEGDVVWCHDYHLMFLPKCLKDYNSQMKVGWFLHTPFPSSEIHRTLPSRSELLRAVLAADLVGFHTYDYARHFVSACTRILGLEGTPEGVEDQGRLTRVAAFPIGIDSERFIRALEVTQVQEHIKELKERFAGRKVMLGVDRLDMIKGIPQKILAFEKFLEENPYWRDKVVLLQIAVPTRTDVPEYQKLTSQVHEIVGRINGRFGTLTAVPIHHLDRSLDFHALCALYAVTDVALVTSLRDGMNLVSYEFVACQELKKGVLILSEFAGAAQSLGAGAILVNPWNITEVAASIGQALNMSAEEREKRHRHNFLHVTTHTAQEWAETFVSELNDTVIEAQQRIRKVPPRLNISDAIERYSFSNNRLLILGFNSTLTESVDTPGRRGGDQIKEMELKLHPELKESLLAICNDPKTTVVVLSGSDRNVLDDNFSEYNMWLAAENGMFLRSTNGVWMTTMPEHLNMDWVDSVKHVFEYFTERTPRSHFEQRETSLVWNYKYADVEFGRLQARDMLQHLWTGPISNASVDVVQGLRSVEVRAVGVTKGAAIDRILGEIVHSKAIATPIDYVLCIGHFLGKDEDVYTFFEPELPSDCIGMPRSKVSDAPKVPGERRSVPKLPSSRTSSKSSQNRNRPVSNSDKKTSNGRRPSPENVSWNVLDLKKENYFSCAVGRTRTNARYLLSTPDDVVAFLRELAEAPISNGTS

SEQ ID NO: 794 - protein, 636 aa, Triticum aestivum
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYVRKDILFAQETAENIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLLDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 795 - protein, 1845 aa, Glycine max
MAPRNSRGKPKGEKKKKEEKVLPVVIDITVKLLDETHVLKGISTDRIIDVRRLLSVNTETCYITNFSLSHEVRGPRLKDTVDVSALKPCLLTLVEEDYDEDRAVAHVRRLLDIVACTTSFGPSSLPPPKNDSGTVPKSGKPEAPPAKQSAKDAEAAAATVDIEGEISHSCPKLENFYEFFSLSHLTAPIQYVKRGSRRRVEEILEEDYLFSLDVKVCNGKVVHVEACRKGFYSVGKQRILCHNLVDLLRQLSRAFDNAFDDLLKAFSERNKFGNLPYGFRANTWLVPPVAAQSPSYFPPLPVEDEMWGGNGGGLGRDGKYDLVPWANEFSFIASMPCKTAEERQVRDRKAFLLHSLFVDVAIFRAIKAIKHVMEEPNFSCSVVENNIIYTERVGDLNINVLKDGSVASCKIDTKIDGVEATGVNQKDLLERNLMKGITADENTAAHDITTLGVINVRYCGYVVVVKVEGGVNENVDSPSQQNIELFDQPEGGANALNINSLRLLLHNTTSPENNKPVSQIQTFESEELGASHAFVEKLIKENLAKLEEEEPGIDYFVRWELGACWVQHLQDQNNTEKDKKPSSEKAKNEMKVEGLGKPLKALKNYKKKSDSSNNNSATEYSKFNREAESSPLPSIESQHETTEAENELVLKGMLSDEAFTRLKESGTGLHCKSMHDLIELSRKYYTDVALPKLVADFGSLELSPVDGRTLTDFMHTRGLRMHSLGHVVKLSEKLSHVQSLCIHEMIVRAFKHILRAVISAVDKEKMASSIAGALNLLLGVPENRESDKSREVHPLVWKWLELFLKKRFDWDLNKLNYKDVKKFAILRGLCHKVGIELVPRDFDMDSPIPFQKSDIVSLVPVHKQAACSSADGRQLLESSKTALDKGKLEDAVTYGTKALAKLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQRLLGADHIQTAASYHAIAIALSLMEAYPLSVQHEQTTLQILRAKLGSDDLRTQDAAAWLEYFESKAFEQQEAARNGTRKPDASIASKGHLSVSDLLDYINPNTKGRDAAAKRRSQITKVRATSYQNTGMSSSDESSKEIPKEASDEEVQISEPVGSADSEQESNSGPDLEQAILKQISDEKLQIYDEIFSEAHAEGEDGWQSVQRPRSAGSYGRRLKQRRAALGKVYSYHKNVEVGTESPFVRSPNPNSRYYFLKKRTISHGSYTDDHTTNITQGNKFGRKVVKAVTYRVKSMPSTSKPCANETLENGDKLLSSLPEPDPIDANPVKNSKVSLGKSPSYKEVALAPPGTISKFQVYNPQSEISVSSEHDSGKHEEEVEANRNVDVDPTLIEVNDTVKEKNNDSLSDSVDDSLDDTGVAIEGKEETELIVAVQDNCMSAEGQSGDVKAQGAVDSSILIHAVDDHVDSYKQELDTSNSSGSLEPSANTNPISQGGEDLRVNVSPSSQIRTGGIPYKKLSASAAPFNPSPAIARAAPIAMNMTLPSGPRAVPAIGPWPVNMNVHPGPTTVLPAVAPMCSSPHHAYPSPPTTPNMMQPLPFMYPPFTQPQSVSPSNFPVTNSAFHANHFTYLNPTISKFGPSAVWPGCHPVEFPLPVPIVEPIPDPISESQALCHGLESPSSASVLPEDIDNIGDSNQVVKTLSSEISEDEAVRSGSESIKENGNMNFHGSENAGNKQHQNIASNGNSSSSGTNMDGEKTFSILFRGRRNRKQTLRMPISLLTRPNGSQSFKVIYNRVVRGSHAPKSMNLSSSKDCTATS

SEQ ID NO: 796 - protein, 16 aa, Zea mays
MGVAGEKFQLGTVGAL

SEQ ID NO: 797 - protein, 171 aa, Arabidopsis thaliana
MSTVRKITLKSSDGENFEIDEAVALESQTIKHMIEDDCTDNGIPLPNVTSKILSKVIEYCKRHVEAAEKSETTADAAAATTTTTVASGSSDEDLKTWDSEFIKVDQGTLFDLILAANYLNIKGLLDLTCQTVADMIKGKTPEEIRKTFNIKNDFTPEEEEEVRRENQWAFE

SEQ ID NO: 798 - protein, 16 aa, Lotus japonicus
MASSSFVTLLLISSFL

SEQ ID NO: 799 - protein, 16 aa, Medicago truncatula
MIISHPFTPFPSCITI

SEQ ID NO: 800 - protein, 16 aa, Medicago truncatula
MVPKMLKFSRMLHSSS

SEQ ID NO: 801 - protein, 16 aa, Oryza sativa
MDKSQGVLLSSNVGAG

SEQ ID NO: 802 - protein, 16 aa, Glycine max
MEKAESSASTSEPDSD

SEQ ID NO: 803 - protein, 16 aa, Glycine max
MALSVSSPSCVRVPSC

SEQ ID NO: 804 - protein, 16 aa, Glycine max
MQSMSLCASLSSTASH

SEQ ID NO: 805 - protein, 16 aa, Glycine max
MATAAVIGLSGGKRLL

SEQ ID NO: 806 - protein, 16 aa, Glycine max
MFLSRSILFVFVFSAC

SEQ ID NO: 807 - protein, 16 aa, Solanum lycopersicum
MSGEERPSSLVVDPLL

SEQ ID NO: 808 - protein, 16 aa, Solanum lycopersicum
MEGAATAQALSRIGLA

SEQ ID NO: 809 - protein, 130 aa, Unknown
  Sequence found in Organisms: Brassica napus, Brassica juncea, Brassica oleracea, Brassica rapa, Raphanus sativus, Triticum aestivum
MASTVMTTLPQFNGLRASKISAAPVQGLATVVPMRRKGNGALGAKCDFIGSSTNLIMVTSTTLMLFAGRFGLAPSANRKATAGLKLEARDSGLQTGDPAGFTLADTLACGTVGHIIGVGVVLGLKNIGAI

SEQ ID NO: 810 - protein, 627 aa, Brassica juncea
MLKPLLLLQSFLFCLFNVAFVGGRLIGGGYSAQENPFTPKASLVRYWNKEIRSDKSSIRSEFLISKASPLNAVESATFAKLAAQNSLPTRLPDFCSAANLFCFPDLSPSLEQHNADVKFSVYDQKNFTNYGNAAAGGTDSFKTYSKDGNVVTDSFRRYSRNAAGHDDKFTVYGDSSNVVEENFNSYGTFGTGGTGEFTNYQNGVNNPTSRFTAYSDGGNGKAQSFKTYTHEANAGNGQSFTSYGKNGNGVPNEFASYGVSANVIGSGFSNYGEKGNAANDSFTSYGSDGNVPQNNFKNYGASGNAASDTFANYRDKSNVGDDSFSSYAKDSNSGTAKFTNYGQSFNPGSETFTGYGKGAEGHKISFKTYTPNSTFKDYAKNGVGFAKYNVSSTSATLGDGKTVNKWIEPGKFFREASLKEGTVIPMPDIKDKMPKRSFLPRSIISKLPFSTSKLAEINKIFHAGENSTMEKIISDAVTECERSPSVGETKRCVGSAEDMIDFATSVLGRSVVLRTTENVAGSKQKVVIGKVNGINGGKVTKAVSCHQSLYPYLMYYCHSVPKVRVYEADLLDLKSKTKINHGIAICHMDTSSWGPKHGAFLALGSKPGLIEVCHWIFENDMNWAIAD

SEQ ID NO: 811 - protein, 397 aa, Brassica juncea
MASSVISLSLTTPLKANSFSKYNLTPLPSLRRISCCSTREITLKPRLALPDTCKQRRSVELLTRCGVSSNDFPAEKEKKRSFGGWVEFLGEAVSTAFPVWVSLGCLLGLAKPSAFNWVTPDLTIIGLTITMLGMGMTLTLDDLRGALKMPKELFAGFVLQYSVMPLSAFLVSKLLNLPSHYAAGLILVGCCPGGTASNIVTYIARGNVALSVLMTAASTLSAVIMTPLLTAKLAKQYVAVDALGLVKSTLQVVLLPVLAGAFMNQYFQRLVKFVSPLMAPIAVGTVAILCGTAIGQNASAILASGKQVVMACVLLHLSGFLFGYLFSRLLRIDVASSRTVSIEVGMQNSVLGLVLAAEHFGNPLTAVPCAVSSVCHSIIGSVLAGVWRRSAPKQLED

SEQ ID NO: 812 - protein, 82 aa, Unknown
  Sequence found in Organisms: Brassica napus, Brassica rapa, Raphanus sativus
MQNEEGQITELYVPRKCSATNRMITSKDHASVQLNIGHLDADGIYTGQFTTFALCGFVRAQGDADSGVDRLWQKKKVEAKQI

SEQ ID NO: 813 - protein, 137 aa, Brassica rapa
MGCIDLINLTSTNIYRLVLTRTSNKPYITRGSSMAAIRAESVATEKLGIFIEKNPPESKLTQLGVRSWPKWGCPPSKFPWTYDAKETCFLLEGKVKVYPDGSDEGVEIEAGDFVVFPKGMSCTWDVSVAVDKHYQFE

SEQ ID NO: 814 - protein, 193 aa, Brassica rapa
MVSTPFHSIIFLFLAFSGGVKISVADEPKTEPVPAPWPEQFHALMFMNKSGSIEIVDLWYDWINGRNFNIIQKQLGKLTYDLEWNNGTSFYYTLDASKTCRTVHFEVGILRPNWLDGANYLGQRNVSGFLCNVWEKVDFLWYYEDVVTKRPVQWTFYTGREAHVMTFEVGAVLEDEKWQAPVYCFHNENKSSE

SEQ ID NO: 815 - protein, 122 aa, Phaseolus vulgaris
MRLLTHNMLSSNIKGVVNGFPLRIEAEKVAEKTVEMNGEFLKKMFEKVDWKAFVDASKAMGYTELPEEADSSMLDSDEFLNRFHHALLELHLEEGALVCPETGRRFPVSKGIPNMLLHEDEV

SEQ ID NO: 816 - protein, 473 aa, Phaseolus vulgaris
MKTLYSLRRFYHVETLFNGTLALTGRDQETTGFAWWAGNARLINLSGKLLGAHVAHAGLIVFWAGAMNLFEVAHFVPEKPMYEQGLILLPHLATLGWGVGPGGEVIDTFPYFVSGVLHLISSAVLGFGGIYHALLGPETLEESFPFFGYVWKDRNKMTTILGIHLILLGIGAFLLVFKALYFGGIYDTWAPGGGDVRKITNLTLSPSILFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 817 - protein, 201 aa, Phaseolus vulgaris
MAVCRFAYCSSASSSSTIVRFPKYPSQHVKSSLLPFSFATMEAPPEGYRRNVGICLMNSHKKIFAASRLDIPNAWQMPQGGIDEGEDPRNAAIRELREETGVNSAEVITEVPYWLTYDFPPKVREKLNIQWGSDWKGQAQKWFLLKFTGQDQEINLLGDGTEKAEFGEWSWVSPEQIVDLSVDFKKPVYKKVLAEFAPYFQ

SEQ ID NO: 818 - protein, 435 aa, Phaseolus vulgaris
MAELLATLGDLERDSFVPLLSKLIGESKYVQNNPPELIPEEDRVVKHVLDVLLPFSTTTGGGPLLVNHVTYSPGRGNLIVEYPGTVPGKILSFVGCHMDVVTANPNDWDFDPFSLSIDGDKLGGRGTTDCLGHVALVAELMKKLGQTKPNLKSTVVAVFIANEEDSSITGIGVDGLVKDGLLNKLKDGPLYWIDTADKQPCVGTGGMIPWKLQVTGKVFHSGLAHKAINALELGMDALKEIQFRFYRDFPPHPQEEVYGFATPSTMKPTQWSYPGGGINQIPGECTISGDVRLTPFYNVKDVMKKLEEYVDDINENIQKLESRGPVSKYVLPNENIKGSLTLTFNEALSGVACDLNSRGFHVLCKATEEVVGHVKPYSITGSLPLIRELQDEGFDVQTSGYGLMATYHAQNEYCLFSDMSQGYRVFSRIISQLED

SEQ ID NO: 819 - protein, 192 aa, Phaseolus vulgaris
MAAESSEGEEETKLSGGNQLLMVDDDLTEMGKKAAWSVSSCKPGNGVSSLRDDNLETYWQSDGAQPHLVNIQFQKKVRLQLIVLYVDFKLDESYTPSKVSIRAGDGFHNLKEIKTVELVKPTGWIYLSLSGVDPRDTFVNTFMLQIAVLSNHLNGRDTHVRQIKVYGPRPNPIPHQPFQFTSREFITYSSIR

SEQ ID NO: 820 - protein, 1637 aa, Phaseolus vulgaris
MVLFTEGVTNSVKAVGFSFLTSDELLRSSRVKITNPILLNPLLNPVSGGLYDPALGPLDDKSLCKSCGQGSKHCPGHFGHIELVSPVYNPLMFNILSSILQRTCFSCHHFHASRKEVEMRTSQFELIMKGDIIRAKSLDSIISDESNHSGDGDESQGVEQLGENWSSLQFSEAMSVLRKFLLRKYKKCQNCGVVNPRISKPTFGWFHMNVLSDDEARANTMRALESETINDDMSLGGGETTEEEDITSTGTAKRDKRKKGKLSSKLAAQNKLSGSLLPSQVKGILELLWENEARLCSYISDIQDQGFGKKAGHSMFFLENIFVPPIKFRPPTKGGDDVMEHPQTVLLTKVLQGNISLGDAHINKLDPSKVLSRWMDLQQSVNLLFDNKTSGQGEVAAGICQLLEKKEGIFRQKMMGKRVNFACRSVISPDPYLAVNEIGIPPYFALRLSYPERVTPWNVTMLRNAILNGPQSHPGATHYTDQQATVKLPPNGKLLSFISRKLPSSRGVILDHGKISDQEFEGKIVYRHLKDGDVVLVNRQPTLHKPSIMAHVVRVLKGEKTVRMHYANCSTYNADFDGDEINVHFPQDEISRAEAYNIVNANNQYVKPTSGDPIRALIQDHIVSAALLTKKDTFITYEVFIQLLYSSGVSMTGLGSFSGKHGQKVFMTNSEFEMFLFPPAIWKPEPLWTGKQVISALLYYITRDSPPFTVEKNAKIPSNFFKTQVRDGKRHTRDKSRNKVEPDDEDKLLIYKNDLVRGVVDKAQFGDYGIIHTVQELYGSKVAGNLLSALSRLFTTFLQMHGFTCGVDDLMITEEKDVERMDQLRSCEEIGDIVHREFIGVMNSDIIDPITLQLNIEKKIRSNGEAALTYLDRKMTSNLNSRTSSGILKDLLSDGILKPSGKNCISLMTTSGAKGSMVNFQQISSHLGQQELEGKRVPRMVSGKTLPCFAPWDCSPRAGGFIIDRFLTGLHPQEYYFHCMAGREGLVDTAVKTSRSGYLQRCLMKNLECLKVCYDHTVRDADGSIIQFHYGEDGVDVHHTSFINKFEALSTNKELVYGNCCRQLDRSSPYINKLPDALKEKAENFFRDSLKQRNLGSLKRAEFLKLMEHKYVSCLAQPGESVGVLASQSVGEPATQMTLNTFHLAGRGEMNVTLGIPRLQEIVMAAARDIKTPFMTCPLRSNKSMEEAICLADKLKKITVADIIKSMKVSVVPVSVLGGQVCSIYKLVMKLYKPKQYPKYSDITLEDWEDTLRISFVRELEDAIENHMALLSKISGIKKFKTDPQSHSNSSEDAHGNGSESETKGKSNDDDDDDDVVEDTEGYEDLGSDAQKRKRQGTDEVDYEDGPEEETHDGVLSEEIENDEDNVDDNMTLDASDSEGLDELSESKSIFEKDSLKREKKKSRPTTRKYDRAVFVKAKGMHFQIHFKFTGEPDILLAEIALRSAKKVCIQNSGRVGECKAVTCKESGVMYYGEDSRKRDDIPASVKEKIPALQTSGVHFKTFWELQDDLDVRYIYSNNVHAMLNAYGVEAARETIIREVQNVFKSYGISVNIRHLTLIADFMTHSGGYRPMNRNGSIADCTSPFIKMCFETASKFIVEAAYHGQVDNLETPSSRICLGLPVKMGTGCHDLIQKLEI

SEQ ID NO: 821 - protein, 481 aa, Phaseolus vulgaris
MARRNSTPGFRFRPTDVELIEFFLKRKVRGKVIPSGVIAELDLYKYAPWDLPDKSALQSGDLEWYFFCPKGKKYSTGGRFNRSTEVGYWKTTGKDRAVEHKNRVVGMVKTLVFHTGKAPKGDRTDWVMHEFRVDDKEMVDEGSSQDSYVICRIFRKEGPGPRNGAQYGKPYDEKEWDTDEEIDSVQSERVASMSTPVPIQPSESHISIANDINPSTSGCAGLTSVSCASKLMPSCSAYCVPSNNQIDSVSCVSELMPSCSALPFSPNCAFDSVSGLSKVTPSCSTVPLTPNYDVDSVSCVSKLMPSCSAFSSAPNSEVDSVSVSKMPSCLPLASAPNNLVDTLSSVSELMPSCTAPSPNHQDDENILSLLDYFKEDDDTMAVNENNGIKKVDPDQANNAECAPCLDPNVIFENLGDLDSLVGLGEGSFSSGQKNGLSTSDMFYTGGDYMLGSWEPQDFLELTDLAGPQPWQNKHGSSGEYK

SEQ ID NO: 822 - protein, 181 aa, Phaseolus vulgaris
MAAEKKLSNPMREIKVQKLVLNISVGESGDRLTRAAKVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDSMKWFQVKYEGVILNKSQAIV

SEQ ID NO: 823 - protein, 124 aa, Phaseolus vulgaris
MNARRDNRNNRVSLFDGIEEGGIRAQSVYSSSHEIDEHDNEQALDGLQDRVNLLKRLSGDINEEVDSHNRMLDRMGNDMDSSRGVLSGTMDKFKMVFETKSSRRMFSLVASFVVIFLIIYYLTK

SEQ ID NO: 824 - protein, 232 aa, Phaseolus vulgaris
MASSSNSWMKEYNEALKLADDISGMISEQSSFPASGPEIQRHSTAIRRKITILGTRLDSLQSLLSKFPGKQPISEKETNRRKDMLASLRSRVNQMASTLNMSNFSNRDSLLGPEGKPDAMARTVGMDNNGLVGFQRQLMKEQDEGLEQLEETIASTKHIALAVNEELGLHTRLIDGLDQHVDVTDSRLRRVQKNLAVLNKRTKGGCSCLCMLLSVVGIVLLVIVIWLLVKYL

SEQ ID NO: 825 - protein, 280 aa, Phaseolus vulgaris
MVQWQRHILPFLRHIHKRVVDHHHANPSAPSLVISRLASSLSQGQVGGRAWTRTTPTLPCFSRPIFLCFQHQGISSTTPLLANSSEETPVLSPLVPVSSLGSSKGEDQKQKAVTKPEKVQAILKGIKQSPKKVNLVAALVRGMLVKDALMQLELTIKRAAKTVYQVIHSARANASHNHGLDPERLLVAEAFVGKGYFKKRLAYHAKGRSGLIMRPECRLTIVVREITAEEEADIARLRVHNFKKLTKRERRLVPHQLIETTPVWGRKSKSSGQNLSAAPA

SEQ ID NO: 826 - protein, 129 aa, Phaseolus vulgaris
MEVISPSSTSSRLNPNAPMFVPLAYRTVEDFSDEWWNLVRSSAWFRDYWLRECFQDPQYQNELFDFDFDLDLEEEEEENEGEEGKEVVSLGVLKWRSSGGGWAEAPRYVEKAPKFVKPKVSPRAIHQPR

SEQ ID NO: 827 - protein, 319 aa, Phaseolus vulgaris
MLVFFICVLLFFVFLYKFIAAYGDFTLMSKKQPKREEIEDKVVWITGASRGIGEILAKQLASLGARLIISARNEVELNRVRAQLKGKHAPDEVKILPLDLSSGEDSLRIAVEKAEYFFSDSGVDYMIHNAAFERPKTSILDVTEEGLKATFDVNVFGTITLTKLLTPFMLKRGHGHFVVMSSAAGKTPAPGQAVYSASKYALNGYFHTLRSELCQKGIRVTVVCPGPIETSNNAGSKVPSEKRVSSERCAELTIIAATHGLKEAWISYQPVLAVMYLVQYMPSVGYWLMDKVGKNRVEAAEKKGNTYSLSLLFGKKKGP

SEQ ID NO: 828 - protein, 133 aa, Phaseolus vulgaris
METQNNNPNPNPHHRNSLPSSLPVWPTIDGSLGLSEEESVSYARRFYKFGFALLPLLWAVNCFYFWPVLRHSHSFPRIRPYVVGSAVGFAVFATVLCSWALTFAIGGERLLGPVWDQLVMYNLADRLGLTSWS

SEQ ID NO: 829 - protein, 1070 aa, Phaseolus vulgaris
MECNKDEAVRAKQIAENKMQAGDYEGGLKFATKAQRLFPDIQNIVQILAVCDVHCAARKKLSEFDMDWYGILQTQQSADEATIKKQYRKLALLLHPDKNKSAGAEAAFKLIGEANRMLSDQCKRALYDSKIGISVGNTAAKVAPSHPNGNAGNYQNIFNSQPHAWNPYHQFENQTFWTCCSHCNTRYQYYKTILNQTLRCQQCSKSFTAHDMGNHNVPPTYWSPFNNHKESAKHASSKEASKSNGGKSHGVEEEGVSMSKCTAGVGAYSKVANSRNGHVAAGVTKAGVKVFKAKESQASTKVGCKRARQSASNDNNKAGNGKGMKDTKDQENTVDPHRKTSRKKQHVLYPETDKAGDFGSSPRRPRHHESFTTPKVEEKEVPVTGGLFSNLNPAYRATGVGGQNGETINKASEPHEETILRNKAKVEQTNVQGREVLNSDLNDRKSKANYCSPSKSNLPPNAEISCPDPDFSDFERDKAEDCFAVNQLWAIFDNDDGMPRFYALVKKVYSPFRLRITWLEADSDGLGEIRWHEAGLPIACGKFRLGDSQRTSDRFMFSHQMHCIKGSDTSTYLIYPKKGETWAIFRHWDLGWSSNPEKHLEYQFEYVEVLSDFDENVGIEVAYLGKLEGFVSLFLHTVLNSISLFCISPHEMYRFSHRIPSYKMTGAERKGVPSGSFELDPAGLPTCLFEVGDTGVAKMDGVNCSHREYSNSKVKQAKSSDSIHKSKLQESIDSERAAQILRRSPRSSQKSMVNGQASTRQFTVRKDDINIEHRGYSPPEGNAASSQTNARKVKTPQKQEKNSYDGETLKTRKLPRDLSKKDALGDASERTRCKLTANQSKNSKNVKSTNIPQLVGESVSDFKKDKTEKMFQCGQIWAIYGDRDHMPNTYAQIKKIEFTPSFRVQVSMLEPCPVPSVKRAISCGTFEVKKSKLQILSPSAFSHQLKVEPLVNNRYEIYPRKGEVWFLYEDQNYELTSSKHGRGKCNIVEVLADSEKSIQVVVLSPHNNSQTIFKAPRIQRSKTGVIEVLREEVGRFSHQIPAFQHRDNVHLMGCWELDPSSVPGSFVPIN

SEQ ID NO: 830 - protein, 224 aa, Phaseolus vulgaris
MKKMESVRRNAEALVEKTMKGNDASHDAAHVWRVRDLALSLAQEEGLSSDPNSMQIVELAALLHDIADYKYLRDPSEEKIVENFLDQEGVEEDKKFKILKIIRGMGFKEEVTGNGSSDWFPEFGVVQDADRLDAIGAIGIARCFTFGGSKKRLLHDPAILPRSDLSKEQYMNKEEQTTINHFHEKLLKLKDMMKTKAGKRRAERRHKFMEEFVKEFYDEWNGLN

SEQ ID NO: 831 - protein, 265 aa, Phaseolus vulgaris
MDSAKTHGAVLACTDGAVLSVNQALEAIRELGIEGVQQSDPLVITSASLLNKLPVESSSFDSAILFWLSSDCPGDQLIQEILRVLKVGGIILIRKSSQSIVGSFDKIISDLQSKLLLAGFSEAQILQSIGIKAKKPSWKVGSAFALKKVIKSSPKIQIDVDSDLIDEDSLLTEEDLKKPQLPPGDCEIGSTRKACKNCTCGRAEEEDKVLKLGLTTEQINNPQSACGSCGLGDAFRCSTCPYKGLPAFKLGEKVALSGNFLAADI

SEQ ID NO: 832 - protein, 300 aa, Phaseolus vulgaris
MAMASNHLRNLTRISVHRILHHRFQSLLNAARFFSDAASSVPQPQPNQQSSPPSSLKDYELAKFAAIADSWWDSEGPFKPLHVMNPTRLAFIRSALCRHFKKDPYSAKPLEGLKIADVGCGGGILSEPLARLGATVTGVDAVEKNIKIAQLHAGLDPVTSTIEFCCTTAEKLVEEGRTFDAVMALEVIEHVANPADFCRSLSALTVPDGATVISTINRSMRAYATAIVAAEYILRWLPRGTHQWSSFLTPEELVLILQRAGINVEEMAGFVYNPVTGRWSLSDDISVNFIAFATKSNSTE

SEQ ID NO: 833 - protein, 395 aa, Phaseolus vulgaris
MASLSSFAPLVFLLLVIGCTARPFYPLPSKGDGGSRKPLQTLRPYNIAHRGSNGEIPEATHPAYTRAIEEGADFIETDILSSKDGVLICFHDATLDNTTDIANYAEFANRKRTYEVQGENITGFFTVDFTLKELKSLRVRQRYTYRDQQFNGKFQIITFEEFITIALQAPRVVGIYPEIKYPVYINQHVKWSDGKIFEDKFVDTLQKYGFKGSYLSKNWLRQPIFIQSFAPTSLVYIANKTDLPKILLIDDIDIPTQDTNQSYWEITSDEYLNYIKQYVVGIGPWKDTLVPVAKNYMRTPTDLVSRAHAHNLQVHPYTYRNENSFLHFNFSQDPYMEYDYWINKIGIDGLFTDFTGSLHHFQEWTSKHQDDDSDNDDNTASKLLHKIAMLLASYK

SEQ ID NO: 834 - protein, 316 aa, Phaseolus vulgaris
MHMHCVQANSIGGFVSSIPKSSLSLSPTTTMAMPSPNSLRVAAAQMTSVSDLAANFATCSGLVKEAASAGAKLLCFPEAFSYVGTKDGDSVSVAQPLDGPIMNQYCSLARESSIWLSLGGFQEKGSDPQHLCNTHVIVDETGKIRSSYRKIHLFDVDVPGGRVYKESSFTEPGKDIVAVDSPIGRLGLSVCYDLRFPEMYQLLRFQHEAQVLLVPSAFTKVTGAAHWEILLRARAIETQCYVIAAAQTGKHGDKRESYGDTLIIDPWGTIVGRLPDRLSTGIVVADIDLSLVDSVREKMPIAKQRMPIDFWKAASL

SEQ ID NO: 835 - protein, 325 aa, Phaseolus vulgaris
MKAVVITTPGGPEVLQLQEVEDPQLQDNEVLIGVHATALNRADTLQRKGFHPPPKGASPYLGLECSGTVLSVGKNVSNWKIGDQVCALLAGGGYAEKVAVPAGQVLPIPPGVSLTDAASFPEVACTVWSTVFMTSRLSQGETLLIHGGSSGIGTFAIQIAKYRGARVFVTAGNEEKLAFCKSIGADVAINYKTEDFVARVKEETGGQGVDVILDCVGASYYQKNIDSLNLDGRLFIIGFQGGVTTQVDLRPLLAKRLTVQGAGLRNRSVENKALIISEVEKNVWPAIAEGKVKPVVYKSFPLAEAAEAHQLMESSEHFGKILLVP

SEQ ID NO: 836 - protein, 392 aa, Phaseolus vulgaris
MEDNNQASSPASPTEGKPILCRAAIARKAGEPLIIEEITVAPPMPREVRIRVICSSLCHSDITFRNLQDFPAIFPRILGHEATGVVESVGKDVTEVTKGDVVIPVILPECGECIDCKSTKSNRCTIFPFKVSPWMPRDGTSRFTDKNGEIIYHFLFISSFSEYTVVDIANIIKIDPEIPPDRACLLGCGVSTGVGAAWRTAGVEPGSTVAIFGLGSIGLAVAEGARLCGATRIIGVDIYPEKFEIGKKFGVTDFVHAGECGGKPVSQFIIEMTGGGADYCFECVGTASVVLEAYASCRKGWGKTIVIGVDKPGARINLSSHEVLHDGKSLMGSLFGGLKPKSHVPILLKRYVDKELQLDEFVTHEVEFKDINKAFDLLSTGKCLRCVIWMDK

SEQ ID NO: 837 - protein, 279 aa, Phaseolus vulgaris
MALQERLDKFKKQQEKCQTTLSSIAASKAAASQKSAAHGSANGRNAPPAVKFSNDTERLQHINSIRKAPVGAQMKRVIDLLLETRQALTPEQINQACYVDIKANKDVFENLRKNPKVNYDGLRFSYKSKYGLKDKTELLQLIRKYPEGLAVIDLKDAYPTVMEDLQALKAAGQIWLLSNFDSQEDIAYPNDPKLHIKVDDDLKQLFRGIELPRDMIDIEKDLQKNGMKPATNTAKRRSAAQIQGISSKPKPKKKKSEINKRTKLTNAHLPELFQNLNNS

SEQ ID NO: 838 - protein, 174 aa, Phaseolus vulgaris
MQSQLVCNGCRSLLLYPRGATNVCCALCNTITSVPPPGMEMSQLYCGGCRTLLMYTRGATSVRCSCCHTVNLVPASNQVAHVHCGNCRTALMYPYGAPSVKCAICHYITNTNNGRLPIPVNRPNGTTNAGTLPSTSTSMPQTQSQTVVVENPMSVDSSGKLVSNVVVGVTTDKK

SEQ ID NO: 839 - protein, 389 aa, Phaseolus vulgaris
MASVDSRKKSVVLALCKYLSLDPSVVPAESLDSDIKSLYLKIKAENGHGDNHSDEVLKWVAFAEAFPVANDACLENLKRLNDELSGKSVLLGNGLKPSEADVIVYSVVHSSLVNLSDTNKEKLPHVLRWIDYIQHKQEFVGLFEKISLQKPGFEPPVTKPVGVVEADLKSKTEQSIKNVNKSEIELCKDKNKTEGKATGRKSTGDKEPTKAKAKPAEKEVAEKENEVSVSLLNIQVGLICKAWKHPSADSLLVEEIDVGEAKLRQVVSGLAKYFSPEELTNRRVVLITNVKPGKLRDVVSEGLVLCASNEGPTVVEPLLPPEGAKIGERISFSGIDGKPEDVLNPKKKQLEKITPHLFTDDKGVATFKGIPFMTSGGPCTSSIPRATIK

SEQ ID NO: 840 - protein, 94 aa, Phaseolus vulgaris
MSAESPSSVRKVVIHLRATGDAPILKQSKFKIAGTDKFAKVIDFLRRQLHRETLFVYVNSAFSPNPDELVIDLFNNFGFDGKLVVNYACSMAWG

SEQ ID NO: 841 - protein, 443 aa, Phaseolus vulgaris
MGLESVGDLAINMILKKLEGEDVARVACASKRFRFSASDDTLWTNLCFHELALTQPIDHLGNPFPSFKECYQAWRGAFDMYPWPLVKRVKKCWDRIKTWLTNNFPEAEATLCKGATEADIQTLENLLKVELPLPTRILYRFHNGQEIVKANPETSTFGSSLGLIGGYSFYNHLVNVYLLPIRQIIQETEQIRRHLSFLRRSKFVLVAASSTFRRKLFFLNCSNGQLYVGTNKLHSEKDIIPCVPQDLISLHRELNIEEQQDAMLLWLEEHGRRLEHGFIKLCDKENGRSINLFPEEPPFCSTAVTNGVKVRASALIIPEFIDPQDENEKYLFAYSIRLSLEPQGCLINGMSFNSCQLHWRHWIIRANDDVVSDFNGEAVIGQYPLLHPGAEEFVYQSCTPLPLPSGSIEGSFTFVPGSLAYPKGDPFLATVAQFPLQLPDYIF

SEQ ID NO: 842 - protein, 150 aa, Phaseolus vulgaris
MSRHPEVLWAQRSDKVYLTVALPDAKDVSVKCEPQGLFSFSASGVQDESYSFSLELYGSIEPEGCKTKSGLRNILCSVQKGEKGWWKRLLKSEEKPAPYLKVDWNKWCDEDEESTSDLVSDDDSRFVDQDEGSSDDDGMLYLPDLEKARG

SEQ ID NO: 843 - protein, 1884 aa, Phaseolus vulgaris
MGAAWRQLKVMLRKNCLLKIRHPFVTAAEILLPTIVLLLLVAIRTKEDTQIHPAQPHIQKDMFVEVGKGISPNFQLLLQSLVDSGEYLAFVPDTDETKLLIDVVSIKFPLLKHVSRVYKEEVELETCIRSDAYGTCNQARNCSNPKIKGAIVFYEQGPQSFDYSIRLNHTWAFSGFPDVTTIMDTNGPFLNDLELGVSAVPTMQYSISGFLTLQQMVDSFVILVAQQSDLNFNAESLDLPLQGFNDSIFFLKSPWTLFNPAHIRIAPFPTREYTDDQFQSIIKKVMGILYLLGFLYPISRLISYSVFEKEQKIKEGLYMMGLKDGIFHLSWFITYALQFGISSGILTACTMYNLFKYSDKTLVFAYFFVFGLSAIMFSFFISTFFKRAKTAVAVGTLSFLGAFFPYYTVNDEGVSIILKVIASLLSPTAFALGSINFADYERAHVGLRWSNIWRESSGVNFLACLLMMIFDTLLYCAIGLYFDKVLPREYGRRYPWSFIFQKDFWRKKKEVKISGKNPESEGNISGEYTSRPAIEAISLEMKQQELDGRCIQIRNLHKVYATDKGDCCAVNSLQLKLYENQILALLGHNGAGKSTTISMLVGLLPPTSGDALVFGKNIVSDIDEIRKVLGVCPQHDILFPELTVREHLELFAILKGVEEHSLDNAVINMADEVGLADKINSIVRTLSGGMKRKLSLGIALIGNSKVIILDEPTSGMDPYSMRLTWQLIKKIKKGRIILLTTHSMDAVDELGDRIAIMANGSLKCCGSSLFLKHHYGVGYTLTLVKSAPTASIASDIVYRHVPSATCVSEVGTEISFRLPMTSSSAFERMFREIEGCMKKPVLNMELSGNGEKENLGIESYGISVTTLEEVFLRVAGCDDDEVECFEENKHSLISDSVASLPTNDDPSTKISYLKTFGNYKRILGFMATMLGRACRLIFATFLSFISFLGMQCCSCCLITRSTFWQHFKALFIKRAISARRDHKTIIFQLIIPTLFLFVGLLFLKLKPHPDQQSLTLSTSHFNPLLSGGGGGGPIPFNLSFPITEKVAQNIMGGWIQKLKSSSYRFPNSEKELADAVEVAGPTLGPALLSMSEYLMSSFNESYQSRYGAIVMDDQSNDGSLGYTVLHNCSCQHAAPTFINLMNSAILRLATQDTNMTIRTRNHPLPTTQSQRLQRHDLDAFSAAVIVNIAFSFIPASFAVSIVKEREVKAKQQQLISGVSILSYWASTYIWDFVGFLFPASFAIVLFYIFGLEQFVGGVSLLPTILMLLEYGLAIASSTYCLTFFFFDHTMAQNVVLLIHFFTGLILMVISFIMGLMTSTMSTNSFLKNFFRISPGFCFADGLASLALLRQGMKDKTSDGVFDWNVTGASICYLAVESFSYFLLTLALEILPSINLTSFMVKKWWEKINIFRHDSPYLEPLLEPSSETVVMDFDEDVDVNTERNRVLSGSLDNSIIYLRNLRKVYFEEKHHGRKVAVDSLTFSVQEGECFGFLGTNGAGKTTTLSMLCGEESPSDGTAFIFGKDICSHPKAARRYIGYCPQFDALLEYLTVQEHLELYARIKGVPDFAMENVVMEKLAEFDLLKHANKPSFSLSGGNKRKLSVAIAMIGDPPIVILDEPSTGMDPIAKRFMWDVISRISTRRGKTAVILTTHSMNEAQALCTRIGIMVGGQLRCIGSPQHLKTRFGNHLELEVKPTEVSSVDLQTLCQAIQERLLEVPSHPRSLLNDLEICIGGTDSVTSAGNTSIAEISLTREMISLIGHWLGNEERVKTLISCTPVCDGASLEQLSEQLFRGGGIPLPVFSEWWLSKQKFSEIDSFILSSFRGARCQGCNGLSIRYQLPYNEDFSLADVFGLLERNRNTLGIAEYSISQSTLETIFNHFAANP

SEQ ID NO: 844 - protein, 231 aa, Phaseolus vulgaris
MARAISLSGARFTMRLISTTTFNATLHKPSSLSLRSRRFLFPLSNAIVHPSTRVAGIRCRVNRAGDSAYSPLNSGSSSFSDRPPTEMAPLFPGCDYNHWLIVMDKPGGEGANKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTRYVRRRENTQ

SEQ ID NO: 845 - protein, 377 aa, Phaseolus vulgaris
MQAVSNARRVSRLFLSPHLRASGAPHYTAVSPFSGLAQHVYRRVTTDPIHCFLSKAFCSSGVDTVEEAPSGDVKELYEKMLDSVKVKRSMPPNAWLWSMISNCKHQHDIRLLFDILQNLRIFRLSNLRIHDNFNCNLCREVTKACVHAGALDFGKKALWKHNVYGLTPSIASAHYLLLYAKDHNDTKLLVEVMKLLKKNDLPLQPGTADIVFSICYNTDDWVLISKYAERFVKAGVKLRQTSLETWMQFAAKRGDTKSLWKIENLRSDTMKQHTLATGFSCAKGLLLERKPSDAVAVIQVLNQTLSDTKKSGIKGELQKLVSEWPLEVIKHQKDEDRKALAASLKSDIPIMVSELLSMGLEANVSLEDLNRKEGIPQ

SEQ ID NO: 846 - protein, 217 aa, Phaseolus vulgaris
MSQLNGAYYGPAIPSQKSYHRPGRGGGCGCCCGCLFSLIFKLILTVIIIVGIAAFLFWLIVRPNVVKVHVTDATLTEFNYTNNTLRYDLALNITVRNPNKRLGIYYDYIEARALFHDARFNSQYPDRFYQGHKTTNVLNPVFKGEHILALKADQSAEFKKENATGLYEIDVKMYLRVRFKLGVFKTKTLKPKVSCDLRVPIKGTATAFETTKCDWDR

SEQ ID NO: 847 - protein, 336 aa, Phaseolus vulgaris
MGEEEKKPEEPKAKEKKPEEPEKKQEEKKEETAAKPAGEKKPEEEKKEVTPPPPPPPQEIVLKVFMHCEGCARKVRRSLKGFPGVEDVLTDCKSHKVVVKGEKADPLKVLERIQRKNHRLVELLSPIPKPPEEQKVPEEEKPKLEEKVEETPIVTVLKVHMHCEACSLEIKRRIQRMKGVESAEPDLKNSVVSVKGVYDPEKLVEYVKKRTGKHAAIVKQEPEKEEKVEETKEAKKEEVEKEKKSGEGEENKEKKEEEAKGETKAEETAASSEDSNKVVPEVKINESFYNSPRYGMEVYAYPAHPVHPVHPAYPGYYHAYPPQMFSDENPNACIVM

SEQ ID NO: 848 - protein, 207 aa, Phaseolus vulgaris
MDSVCASSPPFQTGPSGHPRHFYLAVDRLHFKMQTVIELVDLVARRPSLPIVVCCSTRDDLDSLCSSLSALPFVSSSALYSDLAEDERAFLLEKFRQVTAQWNQTNHGGAPNEDEIGKDERSHMIIVTDACLPLLSSGELPLNAHLLINYELPAKKETYTRRLTTCLTADGIVINMVVGGEVVTLKSIEESSNIVMQEMPMRILDIL

SEQ ID NO: 849 - protein, 202 aa, Phaseolus vulgaris
MSSYLGAGVSTGTVPVNHDTNGKMFDRRIRITELVLRCVILGLGVLAAVLVGTDSQVKEFFSIQKTAKFTDMKALVFLVVANGLAAGFSLLQGLHCIICVVRGRTLLSKPLAWVIFSGDQVMAYVTVAAVAAAGQSGMLAKVGQPELQWMELCNMYGKFCNQVGEGIASAFGVSLSMVVLSCISAFSLFRLYGGNRMKNVYW

SEQ ID NO: 850 - protein, 364 aa, Phaseolus vulgaris
MLRFLLLLFLLGLGARVESHEESGPWSCDSDSEIRAEANFKPGVITLDGRADDWKDIDGSYFPLLPALDPDAENEFKGGKMSVKSGHYGRDIFFLLQVDGDYAYSKGESNKCPSVALMFQIGDGASYHNMGGCEEHSTSCTNKTCKGHEVDIMHFSIGSAIPGRLYGGNPLDNRDGNGGDRFGHLVDLYSWNPHCRYLDGTGPPGSANDSSAQNDWKGAWWHSSFTVHSGFVEDQSPYADNGKKGTYFFEFSRPLRTMDHLQQDVQFNIGGSSKMSVAFWYPLDGQPWHGSGHYSVNCDWVPIDISIGGSLTGNSVDAASSSSWNVASAFSVILSVAALCVSVFVSYRVFNPKSVSFTPLENNL

SEQ ID NO: 851 - protein, 255 aa, Phaseolus vulgaris
MKCVVLLSVVACAFAVAVWAANGDDSLVPPRREVYGNGRIFDISHRYHPEMPEFESKDGIGQFLWLPKSMKNGSIANNSEMKLPTHTGTHVDAPGHFFDHYLDAGFDVDTLDLDILNGPALLVDVPRDSNITAQVMKSLNIPRGTIRVLFRTLNTDRRLMFQKECDTSYVGFSVDGAKWLVENTDIKLIGVDYLSVASYDYLISSHLVLLKDREIIPVEGLKLDDVPAGFYSVHCLPLRLSGAEGSPIRCILIKN

SEQ ID NO: 852 - protein, 203 aa, Phaseolus vulgaris
MCAPISELEQEELLEKLEVFKIKGRDKHGRKILRIIAKFFPARLISIEVLKKYLEERVFPKLGKRKFAVLYVHTGVQRSENLPGISGLRSIYDAIPANVKENLEAFYFIHPGLQARLFLATVGRFLFNAGLYGKLKYISRVDYLWENMRRNEVEIPEFVFDHDEDLEYRPMMDYGLESDHARVYGGAPTMDSPVTTYSMRCIS

SEQ ID NO: 853 - protein, 76 aa, Phaseolus vulgaris
MGAENESQEKRTQERPKSTITQEQFLSWKRQKDAAVSANKAEVSRKRAEDIAAGTIQMNGRELFAHEPWVFDNSQY

SEQ ID NO: 854 - protein, 474 aa, Phaseolus vulgaris
MALKFLNKKGWHTGSLRNIENVWKAEQKHEAEQKKLEELRKQIQEERDRTEFRLLQEKAGLVPHQERLEFLYDSGLSVGKSSNSEGFKVLEQLPKSDAADAPGSSASKEGASVPGALFEEKPQSANDTWRKLHSDPLLMIRQREQEELAKIKNNPVKMAMIKKSIEGTEDKEKAHKKEKRKKHRSSKSKHKKQSDSEDDPTEGRKRSDNGNIYKNHNKAQSDSGYQSDERENMRKDHYEDKKYRERSPGHQQRQRKGKDYNEGADDRNYSRSKSERSVRNSQSNPGYESTEVEKRRMNHYEDRKYRERSPSHQQRQRNDKDYKEDAGDRNYNRSKSERYGSEDQSNIDAPKSGGGRFSETSSNRYSSSHEHGYKRRNVAPKLSEEERAAKLRQMQLAAEVHEEQRWKRIKKAEESDAREAVQNNNASGNNFLDSTQKSVYGADKGGSASIAESVRRRTYYSQGRSGGEGNAFRR

SEQ ID NO: 855 - protein, 117 aa, Phaseolus vulgaris
MAMAWLQLQRIITKGGANLISTLPHSTPYSSSRFFSKSSLYVVKVGIPEFLNGIGKGVESHVPKLESEIGDFQKLLVTRTLKLKKLGIPCKHRKLILKYTHKYRLGLWRPRVESIKA

SEQ ID NO: 856 - protein, 188 aa, Phaseolus vulgaris
MGSINLVLSSTLLLLLVGFATSDINQDKSECMDKIIGLAGCLTYVSGEAAVPTMDCCSGLKEVIDKSKRCLCILIKDRNDPSLGLKVNVTLALKLPEVCKTPTNITECVDLLHLPPNSADAKVFEGFEKSLTNQTSPPSTPAATPAKGENINDDNKKNGGWAKKGLVTEVVCGILPLLLVSHLVLFLV

SEQ ID NO: 857 - protein, 135 aa, Phaseolus vulgaris
MQHSDNEMEASKLSNSIQNIRCHHCAGPLSNRMETSHWNVSPLIRDSFSMIGSAVGGTTSAFYGFNLVMPIVQRRIKGPMWLHFLIGAPPVIVFSSACAGLAGGAVPAAAQLVSSSYHAAYPPPSKDEYIQKSIK

SEQ ID NO: 858 - protein, 538 aa, Phaseolus vulgaris
MQGSSRIASKSGKASSRERKLALKQDVDRLKKKLRHEENIHRALERAFNRPLGALPRLPPYLPPYILALLAEVAVLEEEIVRLEEKVVHFRQDLYQEAVYMSSSMRKLEHSVSAPPNKSNSTMDSPKLEKLKLQSQTVGNSAAESATRPTTTLTEDKENQSCSNSSKSRNQSSNHMNKYAIKRLHNKSPQKRLDHPKIKQEPRLNSQQIADLRNHSPHKSSSEAERPNIISENIVKCLSSILMRMSAVKNPGSACDIPHLWDLKPKMCDEETVFGDPYGICLEFGKRDIGPYKQLCAIDAKSFNPKRTANTLFLLHRLKLLFRKLASVNLENLNHQEKLAFWINIYNSCMMNAFIENGIPESPEMAVALMRKATINVGGHVLSATTIEHFILRLPYHWRFTFSKGTKNHEMTARSMYGLELSEPLVTFALSCGTWSSPAVRVYTASQVENELEVAKREFLQAAIGFSTSKFSVPKLLDWYLLNFAKDLESLLDWICLQLPSELGKQAIKLLEERKTEPLSQFVQIMPYDFSFRYLICT

SEQ ID NO: 859 - protein, 219 aa, Phaseolus vulgaris
MTTSTMDVLHFHHTPFYCEENVYLLCKKLCSDGIAKAEGSDLFVVFISNEKKQIPLWNQKASKRADGVILWDYHVICIQIKQGDVPPLVWDLDSTLPFPSPLPSYVSETIRPSFQLFSDYNRLFRVVHAPIFLRSFASDRRHMKDSGGKWVEEPPPHEPIVAEDGTVHNLNEYINMSVADAITDVTISSVKDVIFTQKNGVVIKDNQLEEFICQLSSLE

SEQ ID NO: 860 - protein, 280 aa, Phaseolus vulgaris
MIRRRLSVLSTSIIRSSNHSKPILRYPSIQFQPFQLPHSPNAHRTISRNEFPEFQGFRAYSLLSLNDLRDNVPRKQPTRKGRGIGSGKGKTAGKGHKGQRARKGIKLGFEGGQTPLRRRLPKRGFKNPFSLIFQPIGLGRIAKFINAGKIDSSELITMKTLKDAGVLGKQAKDGVRLMGRGSEQIKWPIHLEVSRVTVRAKEAVEGAGGSVRRVYYNKLGLRALLKPEWFEKKGRLLPKAARPPPKQKDKVDSIGRLPAPTKPIPFLVETTKDLPVQPLS

SEQ ID NO: 861 - protein, 136 aa, Phaseolus vulgaris
MASITPLHTMLPNAAPKLPASVAVSNTKVSFGPSPGLPCTAIQRNKSRSSRVVVSAVGDVSADSTVYLVAGAVAVALVGTGFPILFSRKDTCPECDGAGFVRKANVTLRANAARKDQTQIVCARCNGLGKLNQIDK

SEQ ID NO: 862 - protein, 211 aa, Phaseolus vulgaris
MGMKAFICLMWLLMWVSQSKGRLLFIPSKPDPNDAAASARWLVSLNFWGVLNTISADLGGAPFGNVVSYSDGLTGAGTGIPYFYLTSLDPTARNALENDKASLTVSEYPLGTCGTKDPMNPTCSKISLTGKLKLVDQQSKEAEFARKALFSKHPEMKDWPKNHNFQFFKLEIENIFLIDWFGGPKPLTVEQYLHPKMNNVGFLVLNLQSAL

SEQ ID NO: 863 - protein, 105 aa, Phaseolus vulgaris
MEEMKVSRRVKWWQNMMYPVRRVWFSVATRLRIRKNGLLKLRHDVRACEYEDIQVMWEMLNRNESEFGNSSKKSNKNNTNKKNKGQCWKLLKWARCAPYYYMCRA

SEQ ID NO: 864 - protein, 1114 aa, Phaseolus vulgaris
MDPEVQQSQVAAILGADPAAFQTLISHLMSSSNEQRSHAEALFNLCKQTDPDNLSLKLAHLLHSSPHHEGRAMSAILLRKQLTRDDSYLWPRLSPQTQSSLKSLLLSSIQTENSKSISKKLCDTISELASGILPDNDWPELLPFMFQCVSSDSPKLQESAFLIFAQLSQYIGDSLTPHIKHLHDIFLQCLTNPSVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFAILMKMLLDIEDVPAWHSAETEDEDAGETSNYSVGQECLDRLSISLGGNTIVPVASEQLPAYLAAPEWQKRHAALIALAQIAEGCSKVMIKNLEQVVAMVLNSFPDQHPRVRWAAINAIGQLSTDLGPDLQVKYHQGVLPALAGAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQLETDDPTTSYMLQAWARLCKCLGQDFLPYMEFVMPPLLQSASLKPDVTITSADSDNDIEDSDDESMETITLGDKRIGIKTSVLEEKATACNMLCCYADELKEGFFPWIDQVAGILVPLLKFYFHEEVRKAAVSAMPELLRSAKVAIEKGQSQGRDLSYLKFLTDSIIPSLVEALHKEPDTEICASMLDSLNECLQISGVLLDESQVRSVVDEIKQVITASSSRKRERAERTQAEDFDAEEGELIKEENEQEEEVFDQVGEILGTLIKTFKASFLPFFDELSSYLTPMWGRDKTPEERRIAICIFDDVAEQCREAAIKYYDTYLPFLLEACNDETPDVRQAAVYGLGVCAEFGGSVFKPLVGEALSRLNAVIQHPNALHSDNVMAYDNAVSALGKICQFHRDSIDSAQVVPAWLNCLPIKGDLIEAKVVHDQLCLMAERSDSELLGPNNQYLPKIVSVFAEVLCAGKDLATEQTAGRMINLLRQLQQTLPPSTFASTWSSLQPQQQIALQSILSS

SEQ ID NO: 865 - protein, 125 aa, Phaseolus vulgaris
MAYLRFLHAPLPQPQLTLGFPSPPQFLSIAPPLNFSLSSSSFRCKVFRRLKVNQRVLTVFATNPNSVDGKSPKEGSEVNKTSNAAQGPPLLTILAGLFVLFVVCWSIWSIIAWLISLIVTAPAPK

SEQ ID NO: 866 - protein, 259 aa, Phaseolus vulgaris
MKKIKPVVSMDPPYEAYQGQRTRFRHQSLLQDYEDLHKETEAVRRKLQATEQKRLILEDEVRFLRHRFKYLLKHPIPKPQPKKEVVKSQKLKIQTPIISKGKSYSRKDHTSRSHSASHLNPNGKISNVAEVPLQKTSHLFDLNQNARNFSSSRKDSTIHCSASPARDLNHKERLHSSKEATKKSVAPFFDLNQISREEEELQGNSETMRIEEPKRSTHRVGSDEQHNDIKLSACRSVGDGSNRAGKRKISWQDQVALRV

SEQ ID NO: 867 - protein, 414 aa, Phaseolus vulgaris
MDAIRKQLDVLMGANRNGDVREVNRKYYDRDVCRLYLVGLCPHELFQLTKMDMGPCPKVHSLQLRKEYEEAKGKGTDNYDRELEDVIDKLIGECDRKIGRALKRLEDEDAKAAIAISVSEVTQTLEVLELSKQIKEKLKEADQYDLEGKTDLKIRALEVVEELRTKRADKQSMLLLDAFNKDRASLPTPLPNPPPLAPIPVVAPDPRTQEMINEKLKKAEDLGEQGMVDEAQKAMEEAEALKKLPARQEPVLDSSKYTAADVRITDQKLRVCDICGAFLSVYDSDRRLADHFGGKLHLGYMQIREKLAELQEERNKSRKTDRHEDRRSKERSKDQDRESSRDRERGESREQGRDHDRRSRDRDRHYDRDRGHERDRDRVSDRTRGYESRSRRRSRSRSRERTRDYDRHRRHDRY

SEQ ID NO: 868 - protein, 376 aa, Phaseolus vulgaris
MAAESSRRSGKRPFVEEDDESSKEPPAKRVRFPKGKKVKPGDEVVDKGNVEEGEVDIMNPRVAAKAAKERANQRNQFTAELLSEGTGGIGIDFSVAEVTYEDSENFVDDGIQIEPFNLDKEREEGYFDAAGNFVEYVRENEIKDAWLDNIEVDPKYSALKSVPTNDEDEEPPDLSSEDIGIMKRRIANVLESGETVLQALRRLKGNSDRKAKMSAEAKIIFDQLTEDAMKLMEDGEYNVYHEKREVFVREAEGYERLSQAKEGTSNQHLASGEASGNGDDDFDMFANDDEQDTSKPSTNENNAVSQSSSDATNSAGALQNDYVYDESSGYYYSSSLGYYYDPNTGLYFSAASGQWYSFNEETSTYEEVDEVPSNVN

SEQ ID NO: 869 - protein, 138 aa, Phaseolus vulgaris
MDDLFDSSLNLEDTHYKEGYDEGHSHGLVAGKEEARQVGLKVGFEIGEELGFYRGCVDIWTSAVRLDPTCFSSRAKTIVGQMEELIEKYPLMDPENVQVQEIMDSLRVKFKMVCSSLHVKLEYNGYPKSSTEANDIQF

SEQ ID NO: 870 - protein, 744 aa, Phaseolus vulgaris
MTMPRVSANPSPSCLVSMASTVRAYALPIILFAGAMFYQLFIIPNAFPPSHYDVLQIESYSSIDKVQEAYEKLESKLNSAEEAFDIHKFLKIRYAYELLTDPLWKRDYDTFGIDEQLHIVESGSKRYAGKHISELDFPLLQARSGFVDHSSKVITSSDFQYIFPDVKPWLIQLFSSGSENCAQFSKSWNKIASLLDVVANTGVVELGEKELAIYLADKSSTGKPFFRNGVPSLIVIPAGCRSPKCMTRFNGELSVDKVTNWFATTIVDLPQINYYSRESLVPNFLGKTSHHKVKVLFFSTFGERAAPFIRQAAKDYWAFASFAFILWREEESSYWLGAFGVHSAPAIVFLKDPGVKPVVHHGLFHLLSCYLITIRIYVCSFIELAIYALCIAGSVNNSIFLQLMENNKQQELRQLRSVTSMELGCDPHGYSRAGYDTMIWYCAIVVGRPSLELNKMRETMCRVQETFFKHSQVDASSDNQSLTPAVDAFKRRRLTFAWLDGEKQKDYCQFYIGQAGSDHTCGQRRSVTDIPRLFVIRYLRNGSAVDLRTEQKTDWKSSLVQDLISDSDLAGQFVAGYKGEDDVSQITAWLANIISDGDSRELPFFTLRTPKLVPDDTEPIWSITAQNIPLKNLKQSILGSLSGLSIYREDPRVGPFLLLGALISLGTIWLRRSQQQVQPSEQNQPNSNQPSESNQPTQPSSKDERKQMPRDRVRSRSNKKPTPSMTDFEPSDAYQVPLSDSDSQ

SEQ ID NO: 871 - protein, 158 aa, Phaseolus vulgaris
MNKGGGAGLGGGAGAGSGPTAAAASAAAQKQKTLLQRVEGDIANIVDNFSHLVNVARVNDPPVRNSQEAFMMEMHSARMVQAADSLLKLVSELKQTAIFSGFASLNDHVEQRRIEFNQLAEKTDHALSRVGEEAAANLKELESHYTSSAQKTMQNLQP

SEQ ID NO: 872 - protein, 630 aa, Phaseolus vulgaris
MAAARLTSFVAVSSAAVVSMSTFSDRAYADSSFRIPFFSSSPSNAPAPPNQSSDSSSEPPAPEEPNKSGFDPESLERGAKALREINSSSYSKQVFDLMRKQEQTRLAELDAEKVHYELIQSQGDIERQRKMAEEQRNLIQEQAQRQAQVLRYEDELARKRMQTDHEAQRLHNVELVKMQEESSVRKERARQSTEEQIQSQQRQTDRERAEIERETIRVKAMAEAEGRVHEAKLTEDHNRRMLIERLQGERDKWLAAINTTFGHIEGGLRALLTDRDKLLMTVGGATALAAGVYTTREGAKVTWGYINRILGQPSLIRESSMEKFPGSKIISQAKNKLLNSSTLAGTEKPIGSKNGLENVILHPSLKKRIENLARATSNTKAHQAPFRNMLFYGPPGTGKTMVAREIAKRSGLDYAMMTGGDVAPLAAQAVTKIHDIFDWAKKSRKGLLLFIDEADAFLCERNSTHMSESQRSALNALLFRTGDQSRDIVLVLATNRPGDLDSAVTDRIDEVIEFPLPGEEERLKLLKLYVNKYLCDDNNGTKGGFLPKKQPQKITIEDLSEDVFREAAKKTEGFSGREIAKLVASVQAAVYGRPDCMLDSQLFREIVDYKVVEHHQRLKLAAEGGQPGQI

SEQ ID NO: 873 - protein, 254 aa, Phaseolus vulgaris
MALAPSKVSPFSGFSLSDGVGAVRNPTCSVSLSFLNKKVGSRNLGVSASTVPLTGVIFEPFEEVKKEELAVPTAGQVSLARQYYADECESAINEQINVEYNASYVYHSLFAYFDRDNVALKGFARFFKESSEEEREHAEKLMKYQNTRGGRVVLHPIKNVPSEFEHVEKGDALYAMELALSLEKLVNEKLRSVHSVADRNKDPQLADFIESEFLSEQVEAIKKISEYVAQLRMVGKGHGVWHFDQSLLHDGHAA

SEQ ID NO: 874 - protein, 165 aa, Phaseolus vulgaris
MAASVFNTPSFTLFVFLSLQLYLSFSSSSSPSIHDLLRSKGLPPGLLPEEVKSYTFSRNGHLEVFLDAPCMTKYENRVLFEQVFTANLTYGSLIGVEGLQQEELFVWLPVKDIIVNDPSSGLILFDIGLAHKQFSLSLFEDPPHCKPEGGLRNHVRKEKGLEVLR

SEQ ID NO: 875 - protein, 422 aa, Phaseolus vulgaris
MMSVTGKAIDFAGKNLVSCGCSSNASFDRYTVRNYAKVNSKGCGRGHGVCKLFCCTRRNTQCRVSSMKTAEPTVNGGSQAIESLTKGSYLKGYSESPISPATFFEVVADDLLTLNKNLQSIVGAENPVLMSAAEQIFSAGGKRMRPALVFLVARATAELFGLKELTVKHRRLAEIIEMIHTASLIHDDVLDESDLRRGKKTVHQIFGTRVAVLAGDFMFAQSSWYLANLENIEVIKLISQVIKDFASGEIKQASSLFDCDVQLEEYLIKSYYKTASLIAASTKGAAIFSGADRSITEKMYEYGRNLGLSFQVVDDILDFTQSAEQLGKPSGNDLAKGNLTAPVIFALEKEPKLRDIIESEFSEVGSLDEAINLVKSCGSIERAQELAREKADLAIQSLQCLPQSVYRLALEDMVAYNLQRIA

SEQ ID NO: 876 - protein, 116 aa, Phaseolus vulgaris
MASDETQNKVIEPSSSDLLASAKLVANAAQSTLRNESDKVDKTKVADAAGDLLDAAGKYGKLDDQKGVGQYVDKAADYLHQYQDKAAAPSQPADSKPEESGGLGGLANLAGGFFKK

SEQ ID NO: 877 - protein, 355 aa, Phaseolus vulgaris
MAAMATTALTSNPKLSFFDHKPTSFHGKPVSQSRLTPTKSSSKQPTISMSLTPPPYDLQSFKFQPIKESIVSREMTRRYMTDMITYADTDVVVVGAGSAGLSCAYELSKNPAVSVAIIEQSVSPGGGAWLGGQLFSAMVVRKPAHLFLDELGVDYDEQEHYVVIKHAALFTSTIMSKLLARPNVKLFNAVAAEDLIVKEGRVAGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGRNNAIDGTCGVGREEPELVLASANTEDIVDA

SEQ ID NO: 878 - protein, 261 aa, Phaseolus vulgaris
MDSLEEQVFMFIDEQYYHYHSNFSNESELQVEEDLWWQDNSDSDDSSQRTLYWESQVALLQEILEHYSQSGSKLRREVGRIIEEVKGSDFCSCYKANFLDCSTCLRREIVTKLRDRGFTTNLCVSKWETTKKFPGGCHEYIEVFANTSSKKNQIRILIELELREQFQIAKASENYQDLVSCLPEFYIGKPEFLTAIIRVMCNAAKKSMKEKKMHVGPWRKSSFMKMKWAEFNQTLNNKSFGTHTTQSYLGISGAHTPVVVT

SEQ ID NO: 879 - protein, 128 aa, Phaseolus vulgaris
MSKKGGSGASFQKDVPWRASSSTVKPIPKIHHSPLLRVSQTPVTDYAVSVMRHPDPIGSGLGDDAIVEAAGPDCLVPGQKMPIQLLGLQVWPIHVDLKFLEPVGRELKMLGKFMDDAVELMNKSFIER

SEQ ID NO: 880 - protein, 165 aa, Phaseolus vulgaris
MAQKTENEETEFKVPETITLCVNNCGVTGNPATNNMCQNCFSAFTASTATTSSAASAGISSPSARSVASARPQKRSFPEEPSSAADPPSSDQNAPSEAKRVVNRCSGCRRKVGLTGFRCRCGDLFCAEHRYSDRHDCSYDYKAAGREAITAGENPVVRAAKIVKV

SEQ ID NO: 881 - protein, 254 aa, Phaseolus vulgaris
MALLVHAPEISVALQIAPNPNPRLSKVHSFKPQTKGKTIGSARGVRVSCKVKDYEVLDLGLDESVNSYGQFSAPVKPGSKQSKEKEEEKQNYHVNVGYAIRTLREDFPDLFYRELSFDIYRDDIVFKDPMNTFIGIENYKSIFWALRFHGKVFFKALWIDISSVWQPVENVIMVRWTVHGIPRVLWESRGRFDGTSEYKLDKQGKIFEHRVDNIATNSPPRFKVLSVAELIQSIGCPSTARPTYFETSSHPERT

SEQ ID NO: 882 - protein, 945 aa, Phaseolus vulgaris
MRIAKEESSSSAAQAISLISAVKELQEVTAMDLNKLLRDSENFTIQYLTEKGSILKIDMEKLVGSLPLHLSTLLMSAVRNEALFRYLLRGIRLLHSLCDLASRNSKFEQIMLDDVKIMEQLTDLVFYMLIVLGGYRKEYHAFSYMHLLHSTLVACNLHLLTGFISTQWQDIVHVLLAHPKVDIFMDAAFGSVRMVVSFLENTLVAYQEDVSVESNLTAGQIVYYLCQQCEASLQFLQSLCQQKLFKERLLKNKELCEKGSILFLARSILKLHIQPSFPSRVMAAISRLKAKILSILLSLCEAESISYLDEVASSARSLDLAKSVALEVFDLLKKAFGRDPGHLTADRSHPMGFVQLNAMRLADIFSDDSNFRSYMIICFTKVLTAIISLSHGDFLSCWCSSNLSEMEEDASLEYDIFAAVGWILDNTSPDVRNATNLEFNLVPNSMPKASYAHHRTSLFVKFFANLHCFVPNICEEQERNLFVLKVMECLQMDLSNLLPGFSFASDAPKAAIASKNLRSLLSHAESLIPNFLNVEDVQLLRVFFGELQSLFTSTGFGENQVQDSKFEESQSWDKISKFNINEHYQEAQSAVGFPPSLTGKEPADLNKKGSNFKEGMSENSAFPDMDQHNSRAEETNQGKGLNRQNQVDDKGIPGKTASGGARDMDKDAQNVETSGSDTSSAKGKNVVDHMDIGELSKSNERLKRTAVEENPEDEKIELSQRRKRKRTIMNDKQVLLIERALKDEPDMQRNAVSLQSWAEKLSVHGSEVTSSQLKNWLNNRKARLARTARDVRTAGGDADNPVLEKQRGPVPGSYDSPESPGDVSHVARIASGDNKPEPSLARFVDIGSPEFGRCNAGQYVVLVGVRGDEIGRGKVFQVHGKWYGKSLEELATCVVDICELKADKGMRLPYPSEATGNTFAEAETKLGVMRVLWGSNRVFPLRSEI

SEQ ID NO: 883 - protein, 132 aa, Phaseolus vulgaris
MLTVEREERRIVAVVPLVQRTKRTKKKKKKNKKNKKKQHFMDVWRNIIFPVRRVWLALSARLKARKNGAGLLKLQDDVQTCGYEDVQVMWEMLQRTESDVVESHHKRKQLPFWRIFVWSNHSEVSSESANHT

SEQ ID NO: 884 - protein, 1028 aa, Phaseolus vulgaris
MVSDSYSKMISDVTIRSMMKNGEYCGEDLGVLRERELARLRSGSAPPTVEGSLMAVGGLFEGSPAAVGYGGIRGFGSEEELRADPNYANYYYSNVNLNPRLPPPLASKEDWRFVQRLRGGSKVGGVGDRRMASDDGGIEGGHSNSLFSVHPAGFGVKEEGGLKHRKGGAEWSGEDGLIGLPALGLGSRQQRSIAELFHDERNNASSASKHPHNLPSSNLFDDIAEKSETRVAYVHQELNALRSGGNKQGISAAQNFVGSGPQSYASALGASLSRSSTPDSQLLPRAASPCLPPIGDGRSSSADKKISNGQNLLNAVSSNLNDSADLASALASMNLSTKDIIDDEKHSQSSRHNELDYTHSFKQQPYLNSPDSLAYQRHSATQSHLKVNKGSSFGLDLNKSPGYADEQLEPHKAGGVSVNTHLKGPSTPTFTNRGSSPAHYQNVEDISYPNYGMTGYSVNPSSPSMMASQLGSGNLPPFFENAAVAASALGLNAMDSRALGRGVALGPLLAATELQNSSRLGSHAAGSTQQLPLMDPLYLQYLRSGDVASAAQIAALKESVINRECTDLLGLQKAYVESLIAPQNSHFNVPYLSKSATLSPNSFGNPSYGLATSYPGSPLAGSLFPNSLYGPGSPMNQSERNMRLSGMRNAAGGFMGAWHSDTVGGLEENFPSSLLDEFKSNKTKCFELSEIAGHVVEFSADQYGSRFIQQKLETASMDEKNMVFHEIMPQALSLMTDVFGNYVIQKFFEHGTAAQIRELADQLTGHVLTLSLQMYGCRVIQKAIEVVDMDQQTKMVTELDGHIMRCVRDQNGNHVIQKCIECVPEDAIHFIVSTFYDQVVTLSTHPYGCRVIQRVLEYCHDLKTQQIMMDEILLSVCMLAQDQYGNYVVQHVLEHGKPYERSAIIKELTGQIVQMSQQKFASNVIEKCLSFGTPTERQVLVNEMLGSTYENEPLQIMMKDQFANYVVQKVLETCDDQQLELILNRIKVHLNALKKYTYGKHIVARVEKLVAAGERRISILTLNPAQMV

SEQ ID NO: 885 - protein, 346 aa, Phaseolus vulgaris
MDAQRALLDELMGAARNLTEEERKGYKEVTWDDKEVCGFYMVRFCPHDLFVNTRSDLGPCPRIHDPKLKESFEKSPRHDAYVPKFEAELSQFCEKLVMDLDRRVRRGRERLAQEVEPAPPPPLTAEKSEQLSVVEEKIKNLLEQVESLGEAGKVDEAEALMRKVETLNAEKTALTQPQNDKVLMLGQEKKMALCEICGSFLVANDAAERTQSHVTGKQHVGYGMVRDFITEYKTAKEKADDEEKLAREKETEERKKQREKESERRRRSDSSDRDRHRDKDHNRERDRYRDRDSERERSREHDGRGYRDGGRGVDYRLRNGRNGGRDRYRDRSRSRSPVKHGYRRSS

SEQ ID NO: 886 - protein, 333 aa, Phaseolus vulgaris
MNRGVLQSSPVQQMITGNPNWWNININSMPPQAPPFFSTTPSNFPIPYAPTSLPFPSWNENQELPESWSQLLMSGVVDEQGKVGMGQFQSKKLENWEDQMLAQAPNASLVDVKQENSANSYVYGHGNEELQSSKPSWSPKSCVTSFSSSMLDFSNSNTDARHPPPDRSSECNSSAAGGALKKARVQPSGTTQATFKVRKEKLGDRITALHQLVSPFGKTDTASVLLEAIGYIRFLQSQIEALSLPYLSGGPGNGRQQNSVQGEKNCIFPEDPGQLLNENCLKRKAAGEPDTQEEQQKGLRSRGLCLVPVSCTLQVGSDNGADYWAPALGGGFR

SEQ ID NO: 887 - protein, 203 aa, Phaseolus vulgaris
MGESDRGKGNVSLEGEKVILVPYMEDHVPKYHQWMKDPSLLQATASEPLTLQEEYRMQLSWFQDPTKETFIVLDKDLVVGQFSHGQPHLEAMVGDVNLFMNDLDDPHVAEVEIMIAEPKSRRKGLGKESVLMMITFAIEKLGINIFRTKIGDSNGASLDLFQKLGFVQTSYSSTFKEVTLELQITQPKKEEILGLIKMVIKHT

SEQ ID NO: 888 - protein, 521 aa, Phaseolus vulgaris
MASMHSNFVPNLSFNRFQTPPSSYLVGAGIVQRGVILSNYCRRRVPCIKCEKKDEEEHIKHVSVERPPYHSYFDSTSGQLEPASGARASIPSQEYWPEGTASRVRAARAPAPTAESTTSPSYGAKPGSRRKNYKASVPAAASSSSQSTVEFSGAGSGSSELLVESSEESQDHSSEFVVYQSEPEEEELSEYEFNKRVGLSHPFVDPKTKRPIEGVLPNEELWWNWKESDKEQWSRWQRRKPDVETVFLKAMAETGQIKLHGEEPTLTETALYRARREIYKEERLQAEQERLERDGPIAYYSEWVKAWKRDTSREAIQKHFEETGEDENAQLVEMFCHQTDREYRVMMGTDYRIQRDPLAMRMREDQIKQIWGGDPVYPTVNYIQDPNEVIDYRGPNFHEPTPNMVAYLKEHGKLTSRDEFDKTMAEEKTELVEMTDMDEAMAKAVDIGENDDEEDSDVEEVEEGGEEEKLSDYWSVLKSTPELRKSKPQPKPKKNGAMSLDEAVEDSENLTDFLMDFEEEE

SEQ ID NO: 889 - protein, 142 aa, Phaseolus vulgaris
MGSLMAGWGSTHVDPKSATLKRNRSLTKDEIDAYWKSKKKIEEEHLTAISSSPHTLLNEDGSRSTEKKFQKSISMPVTRVRESLNINLVDTSLEQLIKKNGWWTKSSWAFLNEPPVNEAASYKYTSQFHVTNMPSSKNKITA

SEQ ID NO: 890 - protein, 186 aa, Phaseolus vulgaris
MAKKEMDVVKGLDLQRYMGRWYEIASFPSFFQPRNGENTRATYTLNSSEGTVHVLNETWSDGKRSFIEGSAFKADPKSDEAKLKVKFYVPPFLPIIPVTGNYWVLFVDDDYQYALVGEPTRKNLWILSRNTQIDEEIYKQLVERAKEEGYDVSKLHKTPQSDPPPLGEEGPRDTKGIWWIKSIFGK

SEQ ID NO: 891 - protein, 386 aa, Phaseolus vulgaris
MESSAAMDVEEQPSPNPTNVKRFGLKNSIQTNFGDDYVFQIVPKDDWSAMAVSLSTNAVKLYSPMAGQYFGECKGHTATINQILFSGTSHHQVLCSCSSDGTVRAWDTRTFQQVSCINAGSSQEVFSFSLGGTSGNLVAAGCKSQILFWDWRNMKQIACLEDSHVEDVTQVHFVPNEQGKLISASVDGLICTFDTTGDINDDDHLDSVINMGTSIAKVGIFGESYQKLWCLTHIETLGIWNWKDGRNEGNFSDARTLASESWNLDHVDYFIDCHYYRESEKLWVIGGTNAGTMGYFPVNYKGVATIGAAEAILEGGHTSVVRSVLPMSKIHSNSPTQDIFGWTGGEDGRLCCWLSDHSSESNRSWISSTLITRPEKTRKKNRHQPY

SEQ ID NO: 892 - protein, 290 aa, Phaseolus vulgaris
MATIESALTLFAPQRFSDYRSSAKPPHSIKLHDSTSLIFSSNASSFKTARLCLRLCSALQELPTTEKTPGPTQPTDNLTKLYVANLSWSLSPADIKGIFAQCGTVTDVEIIRNRKGRHMGYAFVTMDSGEEAQVAVDKFDSSELSGRIIRVELAKTFKKPPPPPPPPPPPPQPRETRHVLYVSNLAWKARSTHLRQVFTENFKTPVSARVVFDSPAKRSAGYGFVSFLTKEDAEAAISNVDGKEIMGRPLRLSFSEKKDNEAGSEKEEDQIKDAESEDEDQGSVAQPEES

SEQ ID NO: 893 - protein, 402 aa, Phaseolus vulgaris
MALQGSMSFAAFTLFLVLTTVSHGRNINPPVYGICSSSVILHGYKCQEHEVTTNDGYILSVQRIPEGRANGSGSRTRKQPVIIQHGVLVDGMTWLLNPPEQDLPLILADNGFDVWIANSRGTRFSRRHISLDPSSPAFWNWSWDELVSYDLPAIFNYVFTQTQQKINYVGHSLGTLTALASFSEGKLVNQLKSAALLSPIAYLSHMNTALGVIAAKSFVGEVTTLFGLAEFNPKGLTVDAFLKSLCAYPGIDCYDLMTEITGKNCCLNSSTVDIFLRNEPQSTSTKNMVHLAQTVRRGVLTKFNYVRPDYNIMHYGDVFPPIYNLSNIPHDLPLFISYGGRDALSDARDVQNLLDNLKFHDVDKLSVQFIKEYAHADYVMGFNAKDFVYNAVISFFNHQVNT

SEQ ID NO: 894 - protein, 305 aa, Phaseolus vulgaris
MGFSVAASLGTHIALRNTHEARIKCHFLYKRQESNIIGFKFSKPKALQRKISLSKQEFSDLDERKSPDEVREEIKKCYELIHRLGRGAVYLGSSRMGPSHSHYVQTQELAKEIANLLDCTSWSGAGPGLMDAVTQGAMLAGKPVGGFKIGKEAGEWTASNFHPYLPSENYLTCRFFSARKHGLVDAVVRNNSFDKTAVVALPGGIGTLDEVFEMMALIQLERIGSKFPVPLLLMNYDSFYSKLLDFLNDCEGWGTVSKGEVASLWKVCNSNSEALAYLEEFYGISSIDKSKSVTKFCSTYESPSS

SEQ ID NO: 895 - protein, 756 aa, Phaseolus vulgaris
MELKVLTQMQVTLLLLLIVLTRTGTAADDQDLLGCPNKCGDVSIPYPFGVGVSDITGKNCYLEKNLELNCTDSILYAGNVEVQNITLVGQMEMNFFVSSICKINISNGKNKSNTPTLQTASFTISSTDNKFVSIGCDTYGYLNSYVDQAKYSTGCLTRCDKNDPNVKNMQRNDGKCSGIGCCQVDIPPGMKNISIQASSFDDFKSFSGNSCSVSFVVKNGGYSFKMDHLKHIPFDKAPMVVDWTVGDGACNVSKNNDNYACTSNHSVCEDPPYANRNGYQCKCKQGFVGNPYLRTGCTDFLECTTGNHNCARDEYCHDIPGSFECLCPVGLTGKATNGGGGCQPKKEDDAFTKIVIGSGVGLIALFVGVSWLYLMHQKRRLLKLKEKFFQQNGGIILRQKLSARGETSQSATIFSVEELKKATNNFDESLIIGRGGFGTVFKGVLLNNEVVAIKKSKIMDSSQVEQFINEVIILSQINHRNVVKLFGCCLETEVPLLVYEFVENGTLFDYLHKQGQVPNVSWKTRLRIATEAAGALSYLHSEASIPIIHRDVKTANILLDESNTAKVSDFGASRLVPLDQTEIATIVQGTFGYLDPEYMQSGQLTEKSDVYSFGVVLVELLSGEEPFSSHKTEEKRSLTFHFLSSLEKDSLIDVLENDILDEENKQEIMEVAILAARCLKLRGEERPSMKEVTMELEGIRHMDKHPWTNTSQDFEESQYLLSEPQSTPEHGYSSGQQSTGFDSLRELELINFGNGR

SEQ ID NO: 896 - protein, 979 aa, Phaseolus vulgaris
MEVSDDDDGGHVFLVCTNTDSIQAAETLNNEILVSTTDILAWDLPTILTFPTIKVQAHPNRLIEQSLYFRGLLSGNFSESCLGSISINWNVSEFLQILKHMCDCVLDITLDNFFPLYEGALYFGVESLLLKCEVWLSEVLSPEGFQSTQIKMEDLIQIWKFGSDRASDYVLHLCMGYLARNFMWAKHSNFFVKLPFDLLLSSVKHPHLTVDSELHLSDALLLWLESNLENLERPSKTEDNCNGILKQIRVGLLPLWFALGKRNSFYFRQLAEESLDSIFRLLNIVPMGSLDTFKYSDLHHLRIRLTEYSKKMDLSGCPQITSTILRLSLIPQSYLTVPMQKKIIENLFINCEHPVRDKWVFPQNLSEETLSFEAVQEVDMSKCQKLCVEHAVDCFRKSFPSLRTLKAGYLLNIGTISFLQLLEKCPLVSEIDLTVDITPLIPASVTVLSSSPAEIQPIPEKTSSVKYQAVQIMLFNEFGPPLSNVTKLTLEGRTDVSDLGLQYISKLCVSLCHLNIKGCISVTDIGISDLISTSKKLNSIVVCDTSFGVNSVQALCSAISDSGNISLHSRDKRLNSAVSNFETLHIGGCQGVSKSSLIELMSQTQVLKSLCLRGTDLIDQALYNYVGSSLEMLDISNTKISRAALAYVIQGNPSLKCLKARDCRNLFPGDNCAEKRESDFPSLHEKLHAELGKMYRLEEIEFGWGFSSFSFISLEPALMSLKAINIGLGGMLGEDALKRLPAICPLLETIILHFQVISDIIVMNFVASLKNLQVLAMCYCFGDISMSSFKFPMQNLRKLRLERVTPWMTNDDLVVLTQNCRNLAELSLLGCSLLDADSLPIISCGWPGLVSIHLEDCGEVTANGASALLDCKALEDILLRHNGPGLCRNFVCYATSEMPLLRKLSLDICDAREGDFDIPNYAGRYSLSTLNIARCKSKKCAFNLPASTSGARSRSVHIETLVLVWNNRDLIRTVVKERL

SEQ ID NO: 897 - protein, 414 aa, Phaseolus vulgaris
MKVLNGKGKYAQGNLNLLKSVVILLPFTLLILMLPFSLTINSSFSSPNEVYVSRSSYDFNVTEIKRCNVFSGEWVPYSKGAYYDNETCDLIIDQQNCMKFGRPDREFLKWRWKPDECELPLFDATLFLEIVRGKSMAFVGDSVGRNQMNSLLCLLNPVARPEDISSRYATDPIYFRRWFYADYNFTVVTLWSPFLVRSSDVHSSLTNLYLDKADESWSGEVKNFDFVIISAGQWFFRTALFYEKGQVVGCHKCEQSNITELSHYYGYRKAFRTALRTIVKMKGYKGVTFLRTFSPAHFENSEWNKGGSCERRKPYGKEEMKFDGYIFETYKVQVEEFRGARREGRKRGLKFLMLNTTEMMLRRPDGHPNNHVWGHEMKNTHSDCVHWCLPGPIDTWNELLFYQLKTHHKSFISS

SEQ ID NO: 898 - protein, 914 aa, Phaseolus vulgaris
MADSVVSFVLDHLSELVAREANLLYGVKDRVQSLQNELQMINELLNTSKRKKGISNTVVNQIRDVAHLAEDVIDTFVAKVAIYKRRTMLGRMLHGFGQVRLLHDVADKVDKMKTTLNEIRDNKDKYDAFKEINNQSAAEEEEEKERAQSLHKLRRDVEEENVVGFVDDSKDIIKRILEGGSNRKVVSIIGMGGLGKTTLARKVYNSSEVQQHFECRAWVYVSNECRVRELLLGLLKHLMPNFEQQCRGKKKGKKSTQDNSSLSEEELKKLVRNSLESRTYLVVVDDLWKRQDWDEVQDVFPDNNRGSRVLITSRLKEVALHTSHDLPYYLQFLSEEESWELFCRKVFRGEDYPSDLEALGKQMVQSCRGLPLSIIVLAGLLAYKEKSHREWSKVVGHVNWYLTRDHTQVKDIVLKLSYDNLPRRLKPCFLYLGIFPEDFQIPVTPLLQKWVAEGFIQDTGNRDPDEVAEDYLYELIDRSLVQVAKGKTNRDVHVHDLLRDLCISESKEDKVFEICTDNNILIPTKPRRLSIHCKVGHYISSSNNDHSCIRSLFLFGQDDFGTGKQWKWLSKDFKLVRVLELGPTWLSTLSNLGNFIHLRYLRIEATSDFTFVPSSILHLWNLQIIDLSNWRYVTEISFPVEMWKLKHLRHLNARGPIKLRGNCSGSDEKMWNLQTISDLVVNRQATSLIKKGTFPNLKMIRLCVTSEYKDDEITKLLQSLQQSSHLSKLEIVLWDIYDKGCKPKELLQSLGQFNCITFLIIENVFDLLTCAFTFPPNVMELELSEINRITDEGMNGLGNLTKLKILELWGPLYKGDSFDLNCVEGSFPKLEVFEMAYLSLEKWKLGNGGMSRLQSLIIYNCESLDDLPNELWSLSGLRRVNVRECSKQMYDTLRNLETNNGVELILEEDRDTLL

SEQ ID NO: 899 - protein, 249 aa, Phaseolus vulgaris
MLTLNHNAISSSFSTVPFHANYALSTPTQFLFSSNLNYSFATTATRKLKSFQLKAGFWESIKSGLMKNNSMQVIDPPSIDEEDEEPLPQEFVLVEKTEPDGTIEQIVFSSGGDIDVYDLQALCDKVGWPRRPLSKLAAALKNSYIVASLHSIRKSPGSEGDEQKRLIGMARATSDHAFNATIWDVLVDPSYQGQGLGKALIEKLIRALLQRDIGNITLFADSQVVEFYRNLGFEADPEGIKGMFWYPNH

SEQ ID NO: 900 - protein, 1029 aa, Phaseolus vulgaris
MESVNDLIQEAKLRTLWWALCIFAVSYFLTHTSKSMWMNLPMSIIFVAGLRILFNRVEFRWKVQEPKPLTYLSHLEKKQLSLKDSRLTSLPPPAKWKRKIDSPAVEAAMREFIDKILKDFVVDLWYSDITPDKEFPEQIRAIIMDVLAEISGRVKEINLVDLLTRDVVDLIGDHLELFRRNQAAIGVDVMKTLSSEERDDRLKFHLLNSKELHPALISPESEYKVLQQLMSAVLATVLRQREAQCPVIRSIARELLTCLVMQPIMNLASPGYINELIEALILLLNDDGTEGMGSNQSTNVAGHHHGHSVVSEGGHNNLTPSNKNPSLNQGTEMILAKTSDQGGTSLQGNNLHQESSQARPADWARMLEVATQRRTEILMPENLENMWTKGRNYKRKENKIIKVGFQDLPAKSPSTDSLPPRKLAQETSASKRGKYEDAEGNSPLPKFNALGSDPLQNVATAKISESSQNPEKELSFAKDLATDGYESPLKRSNSASSLGILTNKGGSIISEFYNPELERHSEGFRGKSSSDMVVRKERPLVSKLRCRVLGAYFEKIGSTCFAVYSIAVTDAQNKTWFVKRRFRNFERLHRHLKDIPNYTLHLPPKRIFSSNTDDAFVHQRCVQLDKYLQDLLSIANVAEQHEVWDFFSVTSKNYSFGKSPSVMKTLAVNVDDAMDDIVRQFKGVSDGLRRKVVGSSSLMSEGSVTSSTTWNLSLNSDEIDKIIPRQGTSESVLSSDEEGEKNNNFDDENIVSEVAQVSGLHFDNALILKGYSSPLNNRDEESNNLDFDRKHDMVVEARVGNDVPATNFILIPDNLEDPVGGPPEWSPPNVSVPILDLVDNIFQLKKRGWIRRQVYWMSKQILQLVMEDAIDDWLLRQIHWLRREETVAQGIRWVQDVLWPDGTFFLRVGIPRMISSDDDQMPSQTTSRSGGSNIKKSESGSFEEQLEAARRASDIKKLLFDGAPTTLVSLIGHKQYRRCARDVYYFSQSNTCVKQLAYAILELVLVSIFPEMRNVVLSVHQHVKSSSSI

SEQ ID NO: 901 - protein, 386 aa, Phaseolus vulgaris
MSETIRENDARLTSQTSTSSRFWPRWIPTSIDHIIAAEKRLLSVVKTGYVQEHVNIGSGPPGSKVRWFRSASNEPRFIHTVTFDSKPGSPTLVMIHGYAASQGFFFRNFDVLASRFRVIVIDQLGWGGSSRPDFTCKSTEETEAWFIDSFEEWRKAKNLTNFILLGHSFGGYVASKYSLKHPEHVQHLILVGSAGFSSDSDAKSERITRFRATWKGALLNHLWESNFTPQKLVRGLGPWGPNIVRKYTRARFGTHSTGEILTEEESTLLTDYVYHTLAAKASGELCLKYIFSFGAFARMPLLLSASKWKVPTTFIYGFEDWMNYQGAQEARKLMKVPCEIIRVPQGGHFVFIDNPTAFHSAVFYACRRFFTLDPDNEPLPEGLTLA

SEQ ID NO: 902 - protein, 237 aa, Phaseolus vulgaris
METQYEELAREDSIPDSSSEDEEEEIEKELADVTFEELQKARSNGAHAFFQKPKEDKKLKRANKNRPMEASSKKPVSAFREAIQAPKKVIRDPRFESLCGTLDPEGFRKRYNFLYENDLPAERQALKKELKKYKDPKRISEIEEHISWIDKQMKSDSRKNIDTQILAKHKKKEREAAKEGKRPFYIKKSEIRKQRLIEKYNNLKSSGKLEAFVEKRRRRNAAKDHRYMPYRRSGDVE

SEQ ID NO: 903 - protein, 682 aa, Phaseolus vulgaris
MSGGGCSIVWFRRDLRVEDNPALAAGVRAGAVIAVFIWAPEEEGQYYPGRVSRWWLKQSLAHLDSSLRSLGTPLITKRSTNSVSSLLEVIKSTGATQLFFNHLYDPLSLVRDHRTKEVLTAQGITVRSFNSDLLYEPWDVNDAHGQPFTTFSAFWERCLSMPYDPQAPLLPPKRIIPGDASRCPCDTLVFEDELEKASNALLSRAWSPGWSNADKALAAFVNGPLIEYSKNRRKADSATTSFLSPHLHFGEVSVKKVFHLVRIKQVFWANEGNKAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPEYVLQAAGIELGSNYPLPIVGIDAAKVRLQEALIQTWQQEAASRAAIENGTEEGLGDSSESAPIAFPQDTLMEERPAEPVRNNPPHGTRRYEDQMVPSMTSSHVRVEEEETSSDLRNSAADNRAEVPTNVTTQQNARETVNQGELLNVNRNTRVQNNATMWLRNAAEDSTAESSISTRRERDGGVVPVWSPPASNFSEQYADDENGIGASSSYLQRQHPQSHQLMNWTRLPQTG

SEQ ID NO: 904 - protein, 537 aa, Phaseolus vulgaris
MEVSKDPNSNPGHFEDSDSELELYTIPSSSRWFAWDEIHETERTAFKEFFDASSISRTPKIYKEYRDFIINKYREEPSRRLTFTEVRKSLVGDVTFLHKAFLFLENWGLINYGAPSAADVEKEEEEEEPCKVRLEEGTPNGIRVVATPNSLKPILVPRGAKTGGNATAASLKLPPLASYSDIYGDLIRQKEGNCGLCGGKCGSGHYLCTQDNIIICANCFKSGNYGEKRSSEDFVLSESSENSGKHDTVWTEGEILLLLESVLKHGDDWELVAQNVQTKTKLDCISKLIELPFGELMLGPAHRNVNINSANGVVVNNAKQVQSSSSDNQEISKTKDQPPEPTNENEQNGDAVKESPSKRQRVTPLSDSSCSLMNQVGLISNVVDPHITAAAADAAVSALCDENLCPRDIFDVEEDSARDLEGEGLEMERSSLSEIPLPLRVRAATATALGAAAARAKLLADQEVREIEHLVATIIEAQINKLLYKVKHFDDLELLMEKEHAEMENIKDSILTERIDVLRRTFRSGITRWKDYSYVKS

SEQ ID NO: 905 - protein, 239 aa, Phaseolus vulgaris
MEYTYSAEAETYTSSSTTPSSAMRSKKKANNNTRRFSDDQIKSLETMFETESRLEPRKKLQLARDLGLQPRQVAIWFQNKRARWKSKQLERDYGILQSNYNSLASRFDALKKEKQTLLIQLQKLNHLMQKPLEAGQSRTQDEAANSMDSESENGGTMKCEHEEKPSPTMERSEHVHGVLSDDDASIKVEDFGLEDEHDLLNFVEHADDSLTSPEDWSAFESNGLLGQTTSDYQWWDFWS

SEQ ID NO: 906 - protein, 630 aa, Phaseolus vulgaris
MSEEKMSEKDSTEAQQNPNLEDCLKLLKGERDEQRLAGLLLVTNFCKAQDHSSLRRVYDAVGPRFLYRLLRTGLGSSLNENRDAYLSLSITVLAAFCRVPDIASSDDMLFNIPLVLEVIPTLSGSSLLQECYEFLYLVSAASENGITRFCESGGIKVLASQMTVLQDGSYLMEVSFKLLQLILGRMSLDIIQSNDLSDFPVIVAAIARQFAVLHNSLKFEALHLLNVILTSKDSSQLREALQLLPQESWSHNIRTGIMAVLQNRVAPAERLQALILAESMVSMHGEDWLVSQVNTNDARDPASADMCLLLVLEQSRVEIAVLLNELAYLKYEAPQDTSATSEAIFSKRHNVAVAYSLVEKIIKLISNVEENGGNLLDEGTLTKVILQLNETIAVVLEYLEDAKEHGQKKGDDLLASVRIIGSYLAEAPLACKEKVQDLLGYMLYIEGEDEQRPFYSVCFLLPLLSQITMKIEGCKALASCKGIEAVLDCFNKLVGSNAFLEDNGCIFLACDTILNLLLKKDKVHTMLDESASVRLLKALAYWTDNTDEMSSMMMASSICALVFEYTSEEALLNRPDFNYSTLRSLYVLIARCLTSSEQDTKEDMDLLEIVSSGFSRWAHRYPRIQEAVKN

SEQ ID NO: 907 - protein, 368 aa, Phaseolus vulgaris
MEVSQVLCMNGGVGDASYANNSLVQQKVISLTKPIREEAITSLYCSKLPKSLAIADLGCSSGPNTLFVVSELIETVEKLCRQLNHKSPEYKVFLNDLPGNDFNNIFKSIDSFKEKLQNEMEGGPCYFSGVPGSFYGRVFPSRSLHFVHSSYSLQWLSKVPEGVDNNKGNIYLGRTSPSSVVRAYYDQFQRDFSLFLKCRAEELVEGGRMALTFLGRRHEDPCSKDGCYIWELMASALNDMVSQGMIKEEQVDSFNIPQYTPSPSEVKLEVLKEGSFSINRLEVSEVNWNAFDDWNALEFESERFESVGDGGYNVAQCMRAVAEPMLVSHFGEDIIEEVFTRYQQILADRMAKEKTKFFNVTILLTRKT

SEQ ID NO: 908 - protein, 245 aa, Phaseolus vulgaris
MPSAQDPFYVVKEEIQESIDKLQSTFRQWEKAADAGERSNLSKEVLTSCESIDWQVDELDKAISVASRDPSLYGIDEVELENRRRWTSEARSQVSTAKKAVEAGKRSNITNNASLNGMHRELMRLPNSHQTASGQYPTQDNDDFMESESDRQMLLIKRQDEELDELTVSIQRIGGVGLTIHEELLAQEKIVDELGNEMDSTSNRLDFVQKKVAMVMKKASAKGQIMMILGLLALFIFLFILVFFT

SEQ ID NO: 909 - protein, 1199 aa, Phaseolus vulgaris
MSSSSSSMAAPSEKWIDRLQFSSLFWPPPPDGQQRKDQIAAYVEYFIQFTSEQFTDDIAELIRNRYPSKEILLFDDVLATFVLHHPEHGHAVVLPIISCIIDGTLVYDKASPPFASFISSVCPKVENEYSEQWALACGEILRILTHYNRPIYKIERQYGETERSSSGSHATTSEPIDGKSVHNSLTNQEKKPIRPLSPWITDILLASPVGIRSDYFRWCSGVMGKYAAGELKPPSTASSRGSGKHPQLVPSTPRWAVANGAGVILSVCDDEVARNETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRHVDGVEVQHEPLGGYISSYKKQIEVPAAEASIEATAQGIASMLCAHGPEVEWRICTIWEAAYGLIPTSSSAVDLPEIIVATPLQPPILSWNLYIPLLKVLEYLPRGSPSEACLMKIFAATVEAILQRTFPPESTREQSRKSKYLSIIGSASKNLAVAELRTMVHSLFLESCASVELASRLLFVVLTVCVSHEAQFSGSKRPRGEDNYPAEEIIEDLQTSENQKESKNRKMKKQGPVAAFDSYVLAAVCALACELQLFPLISRGSNNLVSNNAQVIAKPAKLNGSSHRQNGSSHIRQNGSSHIRQNGSSHDLRNGLDSAVRHTHRILAILEALFSLKPSSVGTPWSYSSNEIVAAAMVAAHVSELFRRSKACMHALSVLIRCKWDNEIHSRASSLYNLIDIHSKAVASIVNKAEPLEATLIHAPIWRDSRIYCGNKRQNQCESNCFDPGQTSIIPSADSFPSKPVHTSKKTPCSNEAAGCTLGKGVSGFPLDASDLANFLTMDRHIGLNCNAQIFLRSMLAEKQELCFSVVSLLWHKLIASPETQPCAESTSAQQGWRQVVDALCNVVSASPTKAATAVVLQAERELQPWIAKDDDLGQKMWRINQRIVKLIVELMRNDESAESLVIVASSSDLLLRATDGMLVDGEACTLPQLELLEATARAVQPVLEFGESGLAVADGLSNLLKCRLSATIRCLSHPSAHVRALSISVLRDILHTGSIRYNLKPRRINGTHNPSYQYFNSDAIDWQADIEKCLTWEAHSRLSTRLPINFLDTAAKELGCNISM

SEQ ID NO: 910 - protein, 296 aa, Phaseolus vulgaris
MIDLSTLNPAQITVMGSAFCVMLSMHFTSQLLSQHLFYWKNPKEQKAILIIILMAPLYATVSFVGLLDIRGSKEFFTFLESVKECYEALVIAKFLALMYSYLNISISGNVVPDEIKGREIHHSFPMTLFQPHTVHLNYRNLKLLKYWTWQFVVIRPVCSILMISLQLLGLYPTWLSWTFTIILNISVSLALYSLVVFYHVFAKELAPHTPLAKFLCIKGIVFFCFWQGMLLEVLAKFGVIQSRHLRLDVEHIEEAMQNILVCVEMVVFSVLQQYAYHPAPYSGEVEKMLRQNKKND

SEQ ID NO: 911 - protein, 851 aa, Phaseolus vulgaris
MEQNEPVTLTLTAEAELKKDHAISDPDEKMEENQSLTAEDERDNDKAVSDSDDSDSEDEAQQNLLLQSLHTELAANPSNYDAHLQYITLLRRTGDVDKLTRAREAMSELFPLSPALWQQWIKDELSLIPASRPEAFSRILKLYERGVFDYLSISLWCDYINFVQEFDPMVRQCTPTGISKARDLFETALTAAGLHVAEGSKIWEAYRQYEQSILLSTNDTDAQAKEKQVQRIRSLFHRQLSVPLADMSSTLTAYKAWEAEQRNLQDVESVDLVDIYPHVPSSYQKALEMYNARIHLEEYILSPNISDSERIQHYMNYLKFEQSFGMPARIQVLFERAITDFPISPDFWIDYTRYLDNTLKVGNIVTNVYSRATKNCPWVGELWIRYMLSLERGHTSEKDLSEIFEKSLHCTLSTVDEYLDLFLTRVDGLRRRMASSSQEDLEYKIIRETFQRASEYLSPHLKNTEGLLHLYVYWARLETKLGKDVIAARGVWENCLKICGSILETWTGYIAMEVELGNINEARSIYKRCYSKRLSGTGSEDICHSWLRFEREFGKLEDFDHALHKVTPRLEELKLFRIQQESKSGEESEKHLKRNAREKRKLGSDITEEQSPSKRLREIGNPKKAPEENNYQQHNTSQVTKVEGVNWKNNKTDDNPSEQQSNHEKNRAYSDQCTAFISNLHPTANYEHIRNFFSDVGGIIAIRILHDKFTGKSRGLAYVDFSDDEHLAAAVAKNKQKLIGKKLSIARSEPKRGGRESSNPKTLTEHAHTSNHSGRKGSVSNETDDAYKGDVKDAKFSSRKPGNDNIQLRGKNTFAVPRNVRPLGFTVNKPISEEGDEKPKSNEEFRKMFIR

SEQ ID NO: 912 - protein, 179 aa, Phaseolus vulgaris
MKNSEVYHERQKLQFCLVHSLNSLFQQKDAFTREKLNGISERLALEDSSTETWTPFSVLFKPHHNVFTGNYDINVLIAALEEKGKSVVWHDRRKGASCIDLDAPVLMGIVINVSVTRFGGIWKSRHWIALRKIDGVWFNLDSDLPAPLPFHDAHKVREFLDFTLAQGGEILIVLNEKQS

SEQ ID NO: 913 - protein, 459 aa, Phaseolus vulgaris
MHNSGGGGGSGGVCHLVAMPFPGRGHINPMMNLCKILASRRPKEILITFVVTEEWLGFIGSDPKPEAIRFAAIPNVVPNERHKAANFPAFYEAVMTNMEAPFDRLLDRLEPPPTAILGCVELRWPIALANRRNIPVAAFWTMSASFYSMLHHLDVFAQQRRLNVDKDTLDGEVENIPGISSAHLADLRTVLHENDQRVLQLALECISKVPKANYLLLTTVHELEAETIESLKAIFPFPIYPIGPAIPYLELGENPSSVNNDHNPDYIKWLDSQPPESVLYISLGSFLSVSSAQMDQIVEALNSSNVRYLWVARADASWLKDKCGDKGVVVPWCDQLKVLSHSSVGGFWSHCGWNSTLEALFAGVPMLTFPLFLDQVPNSSQIVDEWRNGCKVEQEKLDIEEIVAKEKIEKLVKRFIDHESQEGKQIRGRAREIRATCLKAIGTGGSSDGNLDAFIRDIS

SEQ ID NO: 914 - protein, 580 aa, Phaseolus vulgaris
MGLCHGKPVETSQSEGGHHVFPGGKEVVVAPSPKIATKGSKFPFYSPSPLPSLFKNSPANSSVSSTPLRLFKRPFPPPSPAKHIRALLARRHGSVKPNEASIPEGSECEVGLDKSFGFSNHFHAHYELGPEVGRGHFGYTCSAKGRKGTFKGHDVAVKVIPKSKMTTAIAIEDVRREVKILRALTGHKNLVQFYEAYEDNDNVYIVMELCKGGELLDKILSRGGKYSEEDARIVMIQILSVVAFCHLQGVVHRDLKPENFLYISTEENSTLKVIDFGLSDYVKPDERLNDIVGSAYYVAPEVLHRSYGTEADMWSIGVIAYILLCGSRPFWARTESGIFRAVLKADPSFDEAPWPSLSADAVDFVKRLLNKDYRKRLTAAQALSHPWLTSHCDDVKIPFDMIIHKLVKAYICSSSLRKSALGALAKTLTLVQLAYLREQFNMLGPNKSGLISMQNFKTGILRSVTDASKDSRVLDYVNMVSSIQYRKLDFEEFCAAAISVHQLEGMESWEQHARRAYELFEKEGNRPIMIEELASELGLSPSVPIHVVLQDWIRHSDGKLSFLGFVRLLHGVSSRTFQKA

SEQ ID NO: 915 - protein, 194 aa, Phaseolus vulgaris
MSILKKRSKEVLIYSITESKISNIFSALIIFLGSLGLLLVAISSYLGMDLFLFSEEISNFPFIPQGATMAFYGIGGLFISFYLWWILLWNIGGGFDIFDKKNKKVCFIRWGFPGKNRRIILKIPMNEIQSIRIIAGVQERGILTRTLTYESIVYMETIEQGFITLTRIEDNLTPPEIANKAGELAFFLGVPLLY

SEQ ID NO: 916 - protein, 462 aa, Phaseolus vulgaris
MGLIPSETTPSHVLLFPFMSKGHTIPLLHFAHLLHRRSISVTVVTTPANHPFITDSLKGTAASVVTLSFPTITNIPVGVESTDKLPSMSLFYEFVTATSAMQPQFEQLLQTLPRVNFMVTDGFLWWTLDSATAFGIPRFVYYGMNCYIKAVLIEAMRNGILKGSQPDNELVELTRFPWIRVCKEDFDPTFRNPHPSGVEYTFTMNSISSSQRSHGMLVNSFYELESTFVDYVNADSSPKSWCIGPLCLVKWTPKVYSDEGLKPRWVTWLDHKLEEKCRVLYVAFGSQAEISSEQLEEIALGLEESEVSFLWVMRKEEWGVPDGFEERVKGRGMVVREWVDQIEILMHGSVEGFVSHCGWNSVLESVCAGVPILAWPMMAEQYLNARMVEEEVKVGLRVETCDGSVRGYVKREGLKKAVMEMMEGEKGRKAREKVRELAEMAKLATQEGGSSSSTLESLLNQA

SEQ ID NO: 917 - protein, 519 aa, Phaseolus vulgaris
MADQKNENPNRGSVNVESAKGRNKLPNFLLSVRLKYVKLGYHYVISNAMYLMLIPLFGIASTHLTTLSIKDFLQLWENLKFNLVSVTVCSSLMVFLATLYFMTRPRGVYLVDFACYKPHVDCTCTRETFVEKSGLTGSFSEENLSFQKKILERSGLGQKTYLPPAVLSLPPNPCMAEARKEAEEVMFGAIDQLLAKTGVKAKDIGILVVNCSLFNPTPSLSAMIVNHYKLRGNVLSYNLGGMGCSAGLISIDLAKQLLQVHPNSYALVVSMENITLNWYFGNNRSMLVSNCLFRMGGAAILLSNRSGDRRRAKYQLVHTVRTHKGAEDKSYGCVFQEEDETKRVGVALSKDLMAVAGEALKTNITTLGPLVLPMSEQLLFFGTLVARKVLKMKIKPYIPDFKLAFEHFCIHAGGRAVLDELEKNLELSEWHMEPSRMTLHRFGNTSSSSLWYELAYTEGKGRIKKGDRTWQIAFGSGFKCNSAVWRALRTINPAKEKNPWMDEIHHFPVHVPKVAPIAS

SEQ ID NO: 918 - protein, 347 aa, Phaseolus vulgaris
MVVVTPPTASNKWTQLSSLASQIDDRKASMGRVMEKPTQDLLQQQQQALKCPRCDSSNTKFCYYNNYSLSQPRHFCKACKRYWTRGGTLRNVPVGGGCRKNKRVKRPNGDASANSPPSSSTPSSNSNPPSRPHIPSSSTANHVNVNPLFYGLPNSNGCDVMDVPFPRFNLQSQLNALGLGFSSGVNVISSEPSDNGFSTTTTTSNTNNFLSAYNSIFGSSSSSTCAPSTPVMASLLSSTLLQQKFIGGAGVKGHHDGNGFQGFAPLQGLQMEGSNNISSKEVKAEGPNRLELEWSNNNNNNGGGGACQNQMEHVGLSDPNSLYWNTATGLSAWSDQPNFGPSVTSLI

SEQ ID NO: 919 - protein, 129 aa, Phaseolus vulgaris
MGRVFVMELEGRSYRCKFCRTHLALADDLISRSFHCRRGKAYLFNNVVNFTLGTPEERMMLSGLHTVADIFCCSCGQIIGWKYESAHEKSQKYKEGKFVLERGRIVDEVDFSTEFYIDSRGCMSDGDEA

SEQ ID NO: 920 - protein, 290 aa, Phaseolus vulgaris
RKEMEDAVAVIPGFMSCTCDHVGGCTAPGSRSSGEIAPVHFFGVYDGHGGSQVAKFCAKRMHDVIAEEWNREMADGAEWQRRWETVFANSFERTDNEILSDAVAPEMVGSTASVVVLSGCQIIASNCGDSRVVLCRRTQTIPLSVDQKPDRQDEFLRIEGEGGKVINWNGARVFGVLAMSRAIGDRYLRPWIIPVPEITFTARTDEDECLVLASDGLWDVMSNEEVGEVARHILRRRRRSLSGEETSPAQVVADSLTEIAYGRNSKDNISIIVVDLKSKRKRQQRPPLIS

SEQ ID NO: 921 - protein, 375 aa, Phaseolus vulgaris
MKKQQTQKSEFEFCKACGINHDQGLRHKYFPNHKKSLSTFLSRFRKKLSDVRFFLNAPIPLNPQLASRNRFWCVFCDQDIHEHSSSFACANAIRHLASALHLKNLKHFFWKYGAAADQLDAFMFSDDDVTKWEKKCVARKDEANEGSRRTVVGPSSDDHIHNQLTSGNSNSFETNVYSHSVKSYPSNPVLPLPNYTNEYQISSSGLSGIANVATSSEARPDAKPIVFQDFLGVQLITQISSMPIESAEKKVYSEAPPPWIDTTEAVQMHSSSNKLGKSKMLNPNRVGAAWVEKRKIEMEKEKRGETIRNGRDASWLPNFGRVWQSGSRRESRKEFEREKQLQKLNVETESEMAIKIQPYVSKRMRMDSVGDNASG

SEQ ID NO: 922 - protein, 116 aa, Phaseolus vulgaris
MEGVVKFACLVGFVVVVSIAGVDSAGECGKSTTPDNEAFKLAPCSSAAQDENASVSQSCCAQVKKIGQNPSCLCAVLLSNTAKMAGVNPQIAVTIPKRCNLANRPVGYKCGPYTLP

SEQ ID NO: 923 - protein, 565 aa, Phaseolus vulgaris
MWRRSFSSSTPTATATLKGKKWDALIIGGGHNGLTAAAYLARGGLSVAVLERRHVIGGAAVTEELIPGFKFSRCSYLQSLLRPSVIKELELGKHGLKLLKRNPSSFTPCLDGRYLLLGPDKQLNHSEISKFSLADAEAYPRYESQLENFCKFMDLVLDSPPPESVQHKLSINEKLKNKIQNSVFWASCLRHVSSMGQKDMVDFMDLLLSPASKVLNNWFEADVLKATLATDAVIGSTASVHTPGSGYVLLHHVMGETDGERGIWSYVEGGMGSISKAIGNAAIEAGAHVVTNAEVSRLLIENSSTVCGVTLADGTEVHSSIVLSNATPYKTFMELVPDDVLPNDFVRAIKHSDYSSATTKINVAVDKLPEFRCCKLDHPHAGPQHVGTIHIGSESMEEIHSACQDAASGTPSRRPVIEMTIPSVLDKTISPPGKHVINLFVQYTPYKPLDGDWQDHKYRESFAQKCFTLIDEYAPGFSTSVIGYDMLTPPDLERVIGLTGGNIFHGAMGLDSLFLMRPAKGWSNYKTPLQGLYLCGSGAHPGGGVMGAPGRNAARLALQDIRERT

SEQ ID NO: 924 - protein, 212 aa, Phaseolus vulgaris
MASTMFTYPSLHLHIYSHKTSNPSEYSIHSQPRKNFSIRCTSLESTPPEGEFLTPDPTFSTVNSEESFPIEKRRRSEIVRERRGKKLVQPEPPNFEIGWKRTKEINQEVPVGYVIADFLEKLETLMEKEFGSTELLAKVGEIVAERAREEAEVLMDEGKVEERMVTELFRVLKLMEMDLAMVKAAVKEETLGERLELAKARCRQAILVAYSF

SEQ ID NO: 925 - protein, 209 aa, Phaseolus vulgaris
MDSFSFNNLQAEKANAILKHRKLRRVASLLRIIEVCAVLVLVSRFSMQLPVAVRNSGEYFRDLSLFMNSPRFVFLIGNIIIIALFAQFSAQGNNVVQEPNLYQELIQNTTKNQETVVAEYSRKKQRMKTGEAKISLEKGYRRCEREKRRGVMRRCESESEKGRKKIEGVAVEEVARPEDGMSNEEFRRTVEAFIAREQRIRREEDYYLL

SEQ ID NO: 926 - protein, 366 aa, Phaseolus vulgaris
MPPVPISPVKVGHIDDVQELRKTKPRTIPQRFVRDMTERPTLSTTPLPPSNTHMPVIDFSKFTNGNKEEVLSEIFNLATACEEWGFFQVINHEIDLNLVERIENLSREFFMLPLEEKQKYPMAPGTVQGYGQAFVFSEDQKLDWCNMFALGLEPEYVRNPNLWPKRPERFSETVEEYSGKIRKLCYNLLKYIALGLDLKGDVFEKMFGVSVQAIRMNYYPPCSRPDLVLGLSPHSDGSALTVLQQAKGGPVGLQILKDNTWVPIQPIPNALVINIGDTIEVLTNGKYRSVEHRAVAHEEKDRLSIVTFFAPSYDVELGPMPEFVDENHPCKYRTYNHGEYSKHYVTNKLQGKKTLDFAKIQTKNTN

SEQ ID NO: 927 - protein, 751 aa, Phaseolus vulgaris
MVSIGSKALVSRSSMGDHDSESPKQAKSKRRKHKKGGAAHEFDSNPKHTNSNSNSNSNTFTSPPQLSRVRKQLDPETTQYFSEIANLFETEGVELEERSLICANALQETKGKEFEIASDYIVSHTLETILQGCDVDHLCDFLHSSANDFPYIAMDRSGSHVAETAIKSLAVHLQHDEARPLVEEALTVICKVIAANSVDVMCNCYGSHVLRTLLCLCRGVPLDKSAYYLSKSTTLLAERLNSKEFSKKDDETNFEPGFPNLLKVLVSDMLKHAKKRIKTLQVDQFSSLVFQTVLRVLAGDDEELLHVIPFLLGCKDKYNAEESFINTKVVADLKNLLKESKFSHLMEVILEVSPEALFNELFTKVFRSSLFELSSHQHGNFVVQALISYSSNQDLMELIWEELGPNLEDLFKMGRSGVIASLVAASERLHVNERKCCQVLADAVCPPDDSPKGIVPRLMFLDSCFSYEDKSNWSWQSGARMNVMGSLILQTVFRFRSEYIQPYITSITSMEATHVLEAVGDSRGSHVIEAFLCSGASGKQKRRLVIKLKGHFGEVALNSSGAFTIDKCFTASNLSLREAIVSEVLAVRSDLSKTKQGSYLIRKLDIDGFAANPDHWRSKQVSKESTYNDFYTMFGSNDTKLTKNDSFLSDTLNNKSNPKAVKEMRKEIDQSLGSGASFLSFQKNPKKEKHKSKKNAYNSGDDDESSNRKKRSKKEKVESGFDTAATAATGKTLKKRRRDDLSEASQKKVKA

SEQ ID NO: 928 - protein, 586 aa, Phaseolus vulgaris
MTEHGVGPDLVTHNIILSAFKSGAQYLKALSYFELMKGTHIRPDTTTLNIIIHCLVKLQQYDKAIDIFNSMREKKSECTPDVVTFTSIIHLYSVCGQVDNCEAAFNMMLAEGLKPNIVSYNALIGAYAACGMDNEALLVFNEIKGNGFRPDVVSYTSLLNAYGRSQKPQKAREIFDMMKTNKLKPNLVSYNSLIDAYGSSGFLTDAIEVLREMEQDGIQPNVVSICTLLAACGRCSRKVKIDTVLTAAKMRGIKLNTVAYNSAIGSYMNVGEYDKAINLYKSMRKKKIKTNSVTYTVLISGCCKMSKYGEALSFMKEMMHLKLPLTKELYSSVICAYSKQGQIEEAESTFNLMKSSGCYPDVVTYTSMLDAYSAAGNWEKAYALFEEMEASDIKLDTIACAALMRSFNKGGQPGRVLNLAESMREKEIPFTDTIFFEMVSACSILQDWRTAVDLIKYIESSLPVISSGCLNQFLHSLGKSGKIETMLKLFFKILASGIDVNLNTYSILLKNLLSSGNWRKYLEVLQWMEDAGIHPSNEMYHDISAFSQKCCGHENAAVIKERLESLKRKSEDQISANRPGETPVLS

SEQ ID NO: 929 - protein, 227 aa, Unknown
  Sequence found in Organisms: Brassica napus, Brassica rapa
MGISRDSIHKRRATGGKQKQWRKKRKYEMGRQPANTKLSSNKTVRRIRVRGGNVKWRALRLDTGNYSWGSEAVTRKTRVLDVVYNASNNELVRTKTLVKSAIVQVDAAPFKQWYLQHYGVEVGRKKKNAAASAAKKEGEDGEDAAPAAAAAPEEVKKSNHVQRKIESRQEGRTLDSHIEDQFASGRLLACISSRPGQCGRADGYILEGKELEFYQKKIQKKKGKGAA

SEQ ID NO: 930 - protein, 265 aa, Unknown
  Sequence found in Organisms: Brassica napus, Brassica juncea, Brassica rapa
MTVIDILTRVDTICKKYDKYDVDKQRESNISGDDAFARLYGAFETQIETALEKAEIVTKEKNRASAVAMNAEIRRTKARLSEEVPKLQRLALKRVKGLTTEELAARNDLVLALPARIEAIPDGTAGGPKSTSAWAPSTTSRPDIKFDSDGRFDDDYFQESHESSQFRQEFEMRKIKQDQGLDMISEGLDALKNMASDMNEELDRQVPLMDEIDSKVDRATSDLKNTNVRLKDTVNQLRSSRNFCIDIVLLCIVLGIAAYLYNVLK

SEQ ID NO: 931 - protein, 470 aa, Brassica napus
MALAINVSSSSSSVISTSSFPSLELKVSAPRIGSLRLSDRVNVSTASLSLSGKQSSSVKPLNVQSVAKESFVPSQAASMVTSEVTEKLDVVEVEDFEELAKSLETASPLEIMDKALEKFGNDIAIAFSGAEDVALIEYAHLTGRPFRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKENSNANAAANVNGTSSTVADIFKSENVVSLSRQGIENLMKLGNRKEAWIVVLYAPWCPFCQAMEGSFDELADKLGGSGVKVAKFRADGDQKEFAKRELQLGSFPTILVFPKNSSRPIKYPSEKRDVDSLTSFLNLVR

SEQ ID NO: 932 - protein, 238 aa, Unknown
  Sequence found in Organisms: Gossypium hirsutum, Gossypium raimondii
MENCYPFSLLEPPNCDGCNAAAISNEPPFVVPWPVEPLFSASSSVRCHGFTSPAIPDKATVASKSHSEAEKRRRDRINSQLTALRKLIPKSNKMDKAALLGSAIEQVKDLKRKATEIGKAFAIPSETDEVSVDYNVPEDKTFIRVSICCDDRPEVFSELIRVLKGLRLSIVEAEISSVGGRTKSNLILCNESDNREGVSSNLKQSLNVVVNKINALSSDESKSNYRIRSKRQRLFLSS

SEQ ID NO: 933 - protein, 203 aa, Unknown
  Sequence found in Organisms: Gossypium hirsutum, Gossypium raimondii
MQRAVRAFSVHGNTVKNAILHRIRVVNPVIRPVMFSRSLTSASMEEHGFESTTISDVLKAKGKGADGSWLWCTTDDSVYDAVKSMTQHNVGALVVVKPGEQKSIAGIITERDYLRKIIVHGRSSKSTKVGDIMTEENKLITVTPETKVLQAMQLMTDNRIRHIPVINEKEMVGMVSIGDVVRAVVSEHRAELDRLNAYIQGGY

SEQ ID NO: 934 - protein, 176 aa, Unknown
  Sequence found in Organisms: Gossypium hirsutum, Gossypium raimondii
MAPRSKPSPISPNPDPNSKEIRYRGVRKRPWGRYAAEIRDPRKKTRVWLGTFDTAEEAARAYDAKAREFRGAKAKTNFADNNANDFTRSPSQSSTVESSSPPPLDLTLASPCSSLPVTAQRPVYFFDAFATGGSGCPASGFAQSDSDSSSSVVDFEGGVRRRVFDLDLNQLPAEMD

SEQ ID NO: 935 - protein, 344 aa, Unknown
  Sequence found in Organisms: Gossypium hirsutum, Gossypium raimondii
MHPSKPLNLFFILTVMIRLCFADLPSFREAPAFRNGRECPQTTWSSLDKEIHNPSIIHIAMTLDTAYLRGSVAGVFSVLHHATCPENIVFHFVTTHRHGAKLTRAITSTFPYLNFHLYYFNTNLVKGKISSSIRRALDQPLNYARMYLADLLPAGVRRIIYFDSDLIVVDDVINLWSINLRSHVLGAPEYCHANFTNYFTSKFWSNPAFSASFKGRPRNPCYFNTGVMVIDLWKWREGKYTEKLENWMRIQKRYRIYELGSLPPFLLVFAGDVEGMEHRWNQHGLGGDNLEGLCRALHPGPVSLLHWSGKGKPWLRIDSKRPCPLDSLWAPYDLFRHPSLFSNS

SEQ ID NO: 936 - protein, 192 aa, Unknown
  Sequence found in Organisms: Gossypium hirsutum, Gossypium raimondii
MGSEVLRPQDCLIERIRLPPTACPRRRYGNGSFNPSYYHNYNNNNGNGRSNRKPVQRKRIGSEQGISKKYSSADDLKTVRNNVMVEKVTIMRRGESLDSKIKIDNGGGGREGGLVVMGTDRLGPDPEMVPKQIKIVDAKSSVTVKSDVYAGSAFSVSPAPSSLPLPTFSKKKQVPVDDSATRDLRRLLRLDL

SEQ ID NO: 937 - protein, 329 aa, Gossypium hirsutum
MAEAEVGSGEGKPQEMSLKDKGNEFFKAGNYLKAAALYTQAIKQDPSNPTLYSNRAAAFLHLVKLNKALADAETTITLKPQWEKGYFRKGCILEAMERYDDALAAFQIALQYNPQSAEVSRKIKRLSQLAKDKKRAQEVQNLRSNVDIAKSLETLKSEMSEKYKSEDSWKEMFSFLIETMETAVKSWHETSKVDPRVYFLLDKEKSQADKYAPVVNIDKAFESPHTHSSCFSFLRQYAEDSFSRAACLVAPKSIIAYPQVWKGQGSRKWKHGQHDGFFVQFESPLLRKLWFISSSNEMGKTLCRDPEVLDIGAHEVLPRLFKEKLSSSS

SEQ ID NO: 938 - protein, 617 aa, Gossypium hirsutum
MMMMNKNWKFVRLRQEFQVGVLLLLLCQSLACWSLNEEGFALLRLRERVVNDPFGALWAWKEEDGEINHCSWFGVECCDGKVIALNLKDLCLEGTLAPELGTLIHIKSIILRNNSFTGTIPEGISKLKELEVLDLGYNNFNESLPSGLSNDLSLTIQNSDRSEGAVLRRLLQETANTSAKSPKAPPLNYSMPPSPRTSRAPTHPASSEPSTNSTYLRGAPVPRPPSAPASKPSGNDTVPNTSAPSPSGSNPSIPDSKSSHQAAILVGSIGGGTFLLILIIIAYLLKTYKVSTVKPWATGLSGQLQKAFVTGVPKLKRSELEAACEDFSNVIGSTTIGTVFKGTLSNGVEIAVVSVPVESTKDWSKNLETQFRKKIDTLSKVNHKNFVNLLGYCEEDNPFTRMLVFEYAPNGTLFEHLHFKESEHLDWAMRLRIIMGMAYCLEHMHQLNPPVPHNNLSSSAVSLTEDYAAKISDPCFWNELTASDREGDRINLSDTTMASLESNVYTFGVLLFEIVTGRMPYLVDNGSSEDMASDYLRREQALVEMVDPTLNSFDKDQFDLIGEVIKSCIDPEPGHRPDMRGVSARLREITAITPDNAIPKLSPLWWAELEIMSSEAS

SEQ ID NO: 939 - protein, 243 aa, Gossypium hirsutum
MRQQYVFTTLTLLILFSLSCSTTLAQSPALAPAPSGPTNVTKILEKAGQFTLFIRLLKSTQVANQLLGQLNNSNNGMTVFAPTDNAFSSLKSGTLNSLTDEQKVQLVQFHIVPTYLTSSQFQTISNPLRTQAGDSGDGKFPLNVTTSGNSVNITTGLTNTSVSGTIYTDGQLAVYQIDQVLQPLQIFAPRPPAPAPAPAKSKNKKATTVADSPDVTPADNSKAATLQNVGLFGVAALVIALSL

SEQ ID NO: 940 - protein, 255 aa, Gossypium hirsutum
MLGIFKKELMNPPKELHSPASLTSSNKTKLPNQIINHFLSSNPNNAFSMGFGSSACFAYAPTENRFPNHQRLFCGVDEIYCIFLGDLNNLSSLLKQYGLSKGTNEAMFIIEAYRTLRDRGPYPADQVLKDLEGSYGFVVYDSKAGSVFAALGADERVKLYWGVAADGSVVVSDNLKLIKESCAKSFAPFPPGCMFHSEQGLTSFEHPRSKMKAMPRIDSEGVMCGANFMADAQSRTSRMPRVGSEANWALRGSKA

SEQ ID NO: 941 - protein, 443 aa, Gossypium hirsutum
MAAYRLLIFSLFLALVFTKIGADASTEPLIESDAADSSALKMELDQLKSKIRLLESNVEEKIRELKTKDEMIKQKDKIIEEKSDTMASLHSELSSLQKKGTPDAEERVGKAHAKALELQKQVDRLKTELEAKLKEKDYLESRATKAENKLNELNLQLENLQKINKEQENKLAKTERALNIAEEELIKAKFDATSKANELMEVHSAWLPPWLATQLIRGQAFIQTHWNQHGKPNMDMVIQKALEKKALAKKWAEPHMEAIKTKWVPAAKDQWVAVTTYAEPHVQSLTAKTVEIYEVSKATITPHIIKVQETVDPYFQEAKKFSKPYIDQVATLAKPHVDKISVVMKPYTKEVVKAYGRFLESATTYHQQVQASVQETLKKHELTRPLATKELEWFSASALLALPIIILFRIFSAIFCKKTKKRVRHTNAVHHGRRKGKRGHTDK

SEQ ID NO: 942 - protein, 201 aa, Gossypium hirsutum
MASTFSYNSFGFLLILVAFSSLINISSAGRQIAPKTSIEFIRTSCSSTTYPKLCYESLLTQASMIQTSPQLIAHVALNVTLSTAKSTSAMMVKLAKSQGLKPTEVGAMQDCVEELEDTIDELRKSISEMGQIKGSNFGLMINDIQTWVSAALTDENTCADGFGGKNMNGSIKTAVRSKIVTIAHLTSNALALVNSYASFHG

SEQ ID NO: 943 - protein, 264 aa, Gossypium hirsutum
MNNLEECKADNPQHLQQEEMAASAGAMDGLAASALRSVLQRVHQTAERCGRESQRIRVVAVSKTKPVSVIRQVYDAGHRCFGENYVQEIVKKAPQLPDDIEWHFIGNLQSNKVKPLIAGVPNLAMVETVDDEKIANHLNRVVGSFERKPLKVLVQVNTSGEESKSGVEPSGCVELVKHVSLNCPNLQFCGLMTIGMPDYTSTPENFKTLANCRSEVCKALGIPEEQCELSMGMSSDFELAIEMGSTNVRVGSTIFGAREYPKKN

SEQ ID NO: 944 - protein, 386 aa, Gossypium hirsutum
MTTTKKNMLPPGLVNNLQEVLLSRKGGNSNTNNDEQQQKPDAVTDSTETSTSASDENDNSKPVVLVTNGEGIYSLGLVYLVQALVRSGLYNVHVCAPQSDKSVSSHSVTVRETITVTPAEIDGATAYEVSGTPVDCVSLALSGALFSWSKPLLVISGINRGSSCGHHMFYSGVVGGAREALVSGVPSLSISLNWKREESQESDFKDAVAVCLPLITAAIRDIEKGVFPKSCFLSIEIPTSPSANKGFKLTKQSMWRSAPNWLAVSANRHPSSAAHFMSNQQSLGLQLAQLSRDASAAGAARRISAQRQNVEVESVGAVKSDTNKVKKYFRLEFINKEQEEAEEDLDFKALDNGFVAVTPFSLCPQIEVDIQTAASDWISGALQVEQ

SEQ ID NO: 945 - protein, 548 aa, Gossypium hirsutum
MQTSQKHQTRVNIHRLYHQPAKDVDQFCLPHIQILENNACSDVGSQGPSVSYQAYKDQIFTLESSTATASFVAYDSPSAISVSSSRSPFSPQGSQSWMSDPHHSPDNTHGSPFSGSSVVDDSNGLKHKLRELEVSLLGPESDIIDSCNCCFTSGAHQAASMAGLNHEQLVDMIPRLDLKEVLIACGQALYDNDMSRVAGLMHVLEKMVSVCGEPLQRLGAYVLEGLRARLESSGSNIYKALKCQEPTSSELMSYMHILFRICPYYKFAYTSANAVIKEVMEYEQRIHIIDFQIAQGTQWMYLIAALSKRPGGPPFIRVTGIDDSQSNHARGGGLSIVGQKLSEFAKSYNVPFEFHDTSVSTSEIQVQNLNICPGEALAVNFPYVLHHMPDESVTISNHRDRLLRLVKSLSPKVVTLVEQESNTNTSPFFSRYIETLDYYTAMFESIDVACPRDDKQRISAEQHCVARDIVNMIACEGQERVERHELLGKWRSRFMMAGFSPYPLSSLVTLAVRDMLKEYNNNYRLVEREGSLYLGWINRAMATSSAWR

SEQ ID NO: 946 - protein, 211 aa, Gossypium hirsutum
MAISHVPYYLSKLPSPLFTCRLAAKKISEFSMENPQHPEGKEACESNPTNVKRVSDDIMPHLLNLYGSRVTPRDFEIYAADASFEDPLMCAHGVKQIKSSFYSLSKVFSESRIVEYSINEKEISAGKHEILVDNKQQYKFLGRNIDMISLIRLFVKDGKVVRHEDWWDKKPLRNRETVKLPCVGRMIELTRRGSMFVTHALMGFGKDPPTG

SEQ ID NO: 947 - protein, 137 aa, Gossypium hirsutum
MAAEEGKTADAQFFHLLSNLLHQVEALTNQEEVELRSKIEALGLEVTKVPSMSTHSLDELEIARELDKLSAKLDGVDEMISSAMAADPQVRSLLSGTADLWMPVITANADERRNLAASISTDNNPLGNNEDDIKPDN

SEQ ID NO: 948 - protein, 426 aa, Medicago truncatula
MEMERMAEFSRNYMDRPPRKRARLGWDIPETPKAQVGLFCGQEVENISSYAPSEHNITSSLFKGVARNGSPPWRDDDKDGHYMFELGDNLTSRYRVHGKMGEGTFGQVLECWDRERKEMVAIKVVRAIKKYREAAMIEIEMLQQLGKHDKGGNRCVQIRNWFDYRNHICIVFEKLGPSLYDFLRKNNYRSFPIDLVREIGRQLLECVAFMHDLHMIHTDLKPENILLVSSEYLKIPDYKSSSRAPCSFYKRVPKSSAIKVIDFGSTTYERENQNYIVSTRHYRAPEVILGLGWSYPCDVWSVGCILVELCTGEALFQTHENLEHLAMMERVLGLLPQQLLKRVDRHAEKYVRRGRLDWPEGANSRESIKAVMKLPRLQNLIMQHVDHSAGDLIHLLQGLLRYDPFERVTARDALRHPFFMRDHLRR

SEQ ID NO: 949 - protein, 1138 aa, Medicago truncatula
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANSPLLGSLPKAGGFPPLGAHGPFQPNPAAVPTQLAGWMSNPTTVAHAAVSGAGAIGLGAPSMPGALKHPRTPPINPSVDYPSGDSDHVAKRTRPMGITDEVNLPVNVLSGTFPGHGHSQAFNAPDDLPLPKTVTRTLNQGSSPMSMDFHPVQQSLLLVGTNVGGIALWEVGSREKLVSRNFKVWDLSACSMPFQAALVKDPSVSVNRVIWSPDGALFGVAYSRHIVQIYSYHTGDDVRQHLEIDAHVGGVNDLAFSHPNKQLCVITCGDDKTIKVWDAVSGAKQYTFEGHEAPVYSVCPHYKENIQFIFSTALDGKIKAWLYDNLGSRVDYDAPGRWCTTMAYSADGTRLFSCGTSKDGESSIVEWNESEGAVKRTYQGFRKRSMGVVQFDTTKNRFLAAGDDFSIKFWDMDNIQLLTTVDADGGLPASPRIRFNKDGTLLAVSANDNGIKIVANADGIRLLRTLENNSMYDASRASEMAKPTINSMSSAAAATSAALAERASSVAAIAGMNGDTRSMGDVKPRISEEANDKSKIWKLTEINEPSHCRSLKLPENVRVNKISRLIYTNSGNAILALASNAIHLLWKWPRNERNSSGKANASVPAQLWQPSSGILMTNDIADSNPEDSVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKTRFLQLPPGRTPSAQSDTRVQFHQDQIQFLVVHETQLAIFEATKLECLKQWAPRDSSAPISHATFSCDSQLIYASFLDATVCVFNASNLRLRCRINPPAYLPASVSSNSNVQPLVIAAHPHEANQFAVGLSDGGVHVFEPLESEGKWGVPPPNENGSSSNNVAVATSVGLSSDQAQR

SEQ ID NO: 950 - protein, 148 aa, Medicago truncatula
MASSSMASAATGFLLSLNVAANSTTSSASSRSTMLMFPLKSNNIGSSSSRLVVRATDEAAPAAPAAPAAPAADAAPTPKPKPPPIGPKRGSKVKILRKESYWYKGTGSVVAVDQDPKTRYPVVVRFQKVNYANVSTNNYALDEIEEVV

SEQ ID NO: 951 - protein, 399 aa, Medicago truncatula
MAIFSATLGSFGAISFLSSSQSQQHDPSSSSIVNPFNFPKCPHKLPPPCQWHPHYRHHNPKIMVSSSSSSNNTHIDEFDSGLLQRPSAPDSYDALRQARRSSDWKAANAYRDSGLIYNGRVEGFNAGGLLVRFYSIMGFLPYPQLSPVHSCQEPDQTIKERARELIGAILSVKVIIVDEEKRKLVLSEKEASWFKHSKHINIGDLFEGRVGSVEDYGAFVHLRFPDGLYHLTGLIHISEVSWDLVQDVRDFLREGEEVRVKVISIDTVKMRLTLSIKQLEEDPLLETLDKVIRQDGSGVPNSISSTTSSPIDPLPGLDTILEELLQEDGINEARISRQGFEKRVVSQDLQLWLSNAPPMDQRFTLLARAGRQVQEIHLKTSLDQEGIKKAIQRVLERVP

SEQ ID NO: 952 - protein, 360 aa, Medicago truncatula
MNTLSLHFYTPHSFLSLKPKPQPRIQCCSTNNNIIDDIDMVKTKQGTYEQKQNKVCVLWDLDNKPPRGPPYNAAVSLKNLAERFGDVTDISAYANRHAFIHLPQWVLNQRRERKNLDILERKGIINPPEPYVCSVCGRKCKTNVDLKKHFKQLHQRERQKKLNRLNSLKGKKRQKYKERFVSGDDKYNDAVREILKPKVGYGLASELRRAGVFVKTVEDKPQAADWALKKQMMHSMSRGIDWLFLVSDDSDFSEMLRKAREANLGTVVVGDVDRALGRHADLWVPWNAVENGEVMDMDLIPRNRDRRRTNSTSTTMDDFGDVLFFHEGEEMEDDFMLEYSDDDDFDEDSDEEDEDGFYIY

SEQ ID NO: 953 - protein, 669 aa, Medicago truncatula
MVEEAPPSSLITLCIDHLANQLLFGEDEVIAIIPVIYELPSHLLDDLISRLTPHALYHFHLHMPFQDVNEEDFSRDDSTNNKRKRSRDWNLNTAWQKLFELRWPDLINQIQPSDWQKAYWEAHLQNCLDEAAEIALISPFKGRLADINISESILRHIGFVRLAEHEYDKYSKLSYHCLQFGSHVRIMATHRDFPKATLCSFCKITVDCREIPNIHQFTAWFGGGVRKRTSRCCLRLQNILCSAETTRLLRECKLQSMVVRCIRSVEQVNGLCRLINQHSRTLTSLEFIHCTLYENFLNTLLDSVVRKSVHKYALQKHGLQHLSIVSSSFGPCTGSLPTGLQSLLSSARSMCSLKLCGSRLGRNFAKALFVTLLSVSSCISVLDLAENEISGCLSHFNRRVPSYLRESHIGIGESLQLLRVLNLRGNNLRKDDAENLGYAFAYMPNLEDLDISDNPIEDEGLRYLIPYFAGTSEMCSRLACLKLEACDLSCDVVNHLLDSLPVLNGTLKSLSIAENCLGSKVAGALGRFLSTPIEVLDASGIDLLPSGFLELQNMLTIEEELSLVIINISKNRGGIQTARFLSKLLPQAPRLVDVNASSNCMPIESLSIISSALKFAKAAGNVLNLDLTGHDWDYTPELTSLCTEFVHNGKPILMLPVSSATAAPIDHDP

SEQ ID NO: 954 - protein, 371 aa, Medicago truncatula
MVLFCVNRISHHFRDCELLHFGVGFRFHSFHLSFPRSLKPCLPGNAISVTNRSNENKCYSSKYSGGAGEIPLLFDSSFSQQEDDREIISDGISAVAGGIVALGKFDALHIGHRELAIQASRAGPPFLLSFVGMAKVFGWEHRAPIVAKCDRKRVLSSWFPYCGNMVPEEFEIEFSSVRHLSPRQFVEKLAKELRVRGVVAGENYRFGYKAAGDASELQKLCEEYEMEAYIIKSVMDKNQYSTNINSSIGSKERGQVSSTRVREALAVGDMRYVSELLGRQHRLVLMATDRETFSFSQYKVSAPKSCLLNLAPKEGLYEKCSLLLGQENVMLCRVIIDSKFVHIETDYGGSSDIFGTHDLQYLLIEFGDSST

SEQ ID NO: 955 - protein, 410 aa, Oryza sativa
MGVVGALLGPEAEALVRLRAAAWRLRREVAAATDDDEHWAFAYSMLHRVSRSFAIVIQQLGPDLRNAVCVFYLVLRALDTVEDDTSIPTEIKVPILQEFHRHIYNRDWHFSCGTKDCKILMDKFHYVLTAFLELGSGYQEAIEEITRRMGAGMAKFICKEVETVDDYDEYCHYVAGLVGIGLSRLFHAAGLEDLAPESLSNSMGLFLQKVNITRDYLEDINEIPKSRMFWPREIWSKYVDKLEDLKYENNSVKAVKCLNEMVTNGLIHTEDCLRYMSALKDITILRFCAIPQVMALATYALCYNNVNVFRGVVKLRRGLTARIINETNSMADVYTAFYEFSSLLAEKIDDNDPNASLTRKRVNAIKETCKSSGLLKIRGYDLDRPKRNPAMIMMLLLLLVAIFLGALYRR

SEQ ID NO: 956 - protein, 351 aa, Oryza sativa
MAAAAAAAVACGMSTSFLIRLSPSPPASSHVPLPRSPASSARPRRASSVSLSTAPRPRARAAGSDSPSNFGGQTSLMPPFSLMLDEGSRSKKPYRWQRVLLKVSGEALAGDHTENIDPKITMAIAREVASVTRLGVEVAIVVGGGNIFRGASWAGCSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDADPKRNPNARLLEAVSYHEVQTRDLSVMDMTAITLCQENNIPVVVFNLQKPGNIAKAIVGEKVGTFIGCTKDQDQIVGNALDQERRLVNEL

SEQ ID NO: 957 - protein, 298 aa, Glycine max
MLFTFFTSLPFTLLCDTHSFCFTFSMASCSIGTPNIKVLNLHFGGKKVGLSRQFGTRSWISRLQYTSLVMSRQTVRFLASSNGPSTEIQFAARSEGSEEIRSSGLTSELIPNINEVEFLLTKLCDTSSIGELDLKLAGFHLHVVRDLTEKTKTLPPLIPASVSIINVTETPKTNGSVPTTSLAVSKPVDPVPSSGSIQRFLDKAADEGLVIIQSPKVGFFRRSRTIKGKRAPPSCKEKQNVEEGQVICYIEQLGGELPIESDVSGEVIKILRQDGDPVGYGDALVAILPSFPGIKKLQ

SEQ ID NO: 958 - protein, 861 aa, Glycine max
MANEDLGSWTDLLHSSTKLLEQAAPSAQFPPLQRNLDQLEALSKKLKSKTIRTEAPSQSIAATRLLAREGINAEQLARDLKSFELKTTFEDVFPVEATSVEEYLQQVHEMAMVSAVQEAQKDNLRSFNDYMMKVLEEDWQKEKRDFLQSLSRISTLPRTNIAANSNVGTLPGQLAFVSSTSQVSSGMPSMEIVPLTGRPIVEKKASVYAEVVKKLNKARESGSPFKPAAAFKGAYENLGIDASGGKSVTMRKIWHLVQMLMGEESAVQRVSKRMSLIIGARRHLEWGHEKYIMDTIQSHPAQAALGGGVGNLQRIRAFLRIRLRDYGVLDFDAGDARRQPPVDTTWQQIYFCLRSGYYDEARNVAQSSRASHQFAPLLTEWINKGGMVPEEIAAAASEECERMLRTGDRVGRTAYDKKKLLLYAIISGSRRHIDRLLRDQPSLFSTIEDFLWFKLSAVRDCPSGPSSIVLSDGLIPYSLDDLQSYLNKFEPSYYTKNGKDPLVYPYILLLSIQLLPAVLYLSKEAGDEGYNIDAAHLSIVLADHGVLSEGAGSGQKLGVMDAYAEVSTIIRQYGSMYLRLGDLQMALEYYAQAAAAVGGGQLSWTGRGNVDQQRQRNLMLKQLLTELLLRDGGIYLLLGARGAGEEGELGRFVTDPKARQLFLIEAACHCQEAGMYDKSIEIQKRVGSFSTALDTINKCLSEAICALFRGRLDGESRTAGLIHSGNEILETYTYYPDASLQEREHVLEQQTVLRQLESILSIHKLVRLGHYVDALREVAKLPFIPLDPRGPDIAVDVLENLSPHVQACIPDLLKAALTCLDNVTDSDGSLRALRAKIASFIANNLKRNWPRDLYESVAQRL

SEQ ID NO: 959 - protein, 657 aa, Glycine max
MEDTVSALRSLMVSHSPPLDALVVPSEDYHLSEYVSARDKRREFVSGFTGSAGLALITKKEALLWTDGRYFLQAEKELSAGWKLMRIGEDPAVDIWMADNLPKEASVGVDPWCISIDTAQRWERAFAEKQQKLVPTSKNLVDEVWINRPPAEINAVIVHPVKFAGRSVADKLKDLRKKLVHEQTRGIIFTALDEVAWLYNIRGSDVAYCPVVHAFAIVTSNSAFIYVDKQKVSVEVQTHLVENGIEIQEYTAVSSDATLLATDELDAVSTAKAALAETEARKIPSEIDKSVNGEHQAEENSNDLIWADPVSCCYALYAKLNPDTVLLQQSPLALAKALKNSVELDGLKKAHIRDGAAVVQYLVWLDKKMQDIYGASGYFLEKDSVKKEKHLQSLKLTEVTVSDQLEGFRASKEHFKGLSFPTISSVGSNAAIIHYFPKAETCAELDPDKIYLFDSGAQYLDGTTDITRTVHFGKPSTHEKACYTAVLKGHIALGNARFPNGTNGHSLDILARIPLWKDGLDYRHGTGHGIGSYLNVHEGPHLISFRPQARNVPLQSSMTVTDEPGYYEDGEFGIRLENVLIVKEADTTFNFGDRGYLSFEHITWAPYQTKLIDLNLLSPEEINWLNSYHATCRNILAPYLDEVENAWLKKATEPVGA

SEQ ID NO: 960 - protein, 237 aa, Glycine max
MQTQEYFLPDKMVLPLADEAIDPHMRAPLASAFDAYLPPGVRQITPFERFNVQPSEACPKNFVIFDQTDQRSRIMFHPAMTYKFNSPGLNVHATGSQDFEKNKANQMEREVSSPFEEDPNDIDALLSIGVDELDDFDEEEVSTARTQENYESLSDTCSSYCSKSRKRSSSSSVQKSSGAGGFCHNEGKHWEMKRMVRMLRKIVPGGGNQMDSVAVLDEAVKYLKSLKVEVEQFGVEP

SEQ ID NO: 961 - protein, 292 aa, Glycine max
MRKKLDTRFPAARIKKIMQADEDVGKIALAVPVLVSKALELFLQDLCDRTYEVTLQRGAKTMNSLHLKHCVQSYSVFDFLRDIVSRVPDYGHGHGHGHSEAGADDRALPKRRKAVGDDGNDSDEEAKRSKMRELGHTGTPGRGRGRGRGRGRGRGARTIERDICHQQVESEPCTSILQSSNDIPNTSVPIDNGPQSKELPKENFVISEESTQSFRNIDLNANLNENEDKNAGTAVPASLPEPTSMDTAMEIKHEEIPGWSLSDVDKMGIDTMQLANLGSRLEEDEEDYDEEG

SEQ ID NO: 962 - protein, 1079 aa, Glycine max
MECLKSPFLFSTSLLPPPSHQPYSITPNIKNKKNKKPRVPIFIRCTIQRDPWSPTSGDPTRPKPRSRNPKKPLSDDNARRIIKGKAAYQSILRRNQGPQAQTPRWIKRTPEQMVRYLQDDRNGQLYGRHVLAAVKKVRSLSQRVDGDYDMRMVMASFVGKLSFKEMCVVLKEQKGWRQVRDFFAWMKLQLSYRPSVIVYTIVLRLYGQVGKLKLAEEIFLEMLDVGCEPDEVACGTMLCSYARWGRHKAMLSFYSAIKERGIILSVAVFNFMMSSLQKKSLHREVVHVWKDMLGKGVIPNNFTYTVAISSFVKEGLHEDAFKTFDEMRNYGVVPEELTYSLLINLNAKSGNRDEVQRLYEDMRFRGIIPSNYTCASLLSLYYKYEDYPRALSLFSEMVRNKISTDEVIYGLLIRIYGKLGLYEDAHKTFEETKNRGQLTSEKTYLAMAQVHLTSGNVDKALEVIELMKSSNLWFSRFAYIVLLQCYVMKEDVASAEGTFLALSKTGPPDAGSCNDMLSLYMGLNLTNKAKEFIVQIRENETNFDKELYRTVMKVYCKEGMLPEAEQLTNQMVKTEYFKNDKFFMTFYWILCEHKGDMESDDELVAIEPIDKFNATALGLMLSLYLANGNFNKTKILLKLLLGYAAGGSKIVSQLIINLSKEGEISKAELLNHQLTKLGCRMDEATVASLISHYGKQQMLKQAEDIFAEYINSPTSSKVLYNSMINAYAKCGKQEKAYLLYKQATGEGRDLGAVGISIAVNSLTNGGKHQEAENIVQRSLEENLELDTVAYNTFIKAMLEAGKLHFASSIFEHMISSGVAPSIETFNTMISVYGQDQKLDRAVEMFNQASSCSVPLDEKTYMNLIGYYGKAGLMLEASQLFSKMQEGGIKPGKVSYNIMINVYANAGVLHETEKLFHTMQRQGYLPDSFTYLSLVQAYTRSLNYSKAEETIHAMQSKGIPPSCVHFNILLHAFIKAGLIHEAKRVYEDLSTFGLVPDLVCHRTMLNGYLKCGYVEEGINFFESICESTKSDRFIMSAAVHFYKSAGKGRQAKEILNLMNNMGIPFLKKLEVGSGERVKTP

SEQ ID NO: 963 - protein, 602 aa, Glycine max
MEALRVAPTTPPLLRRHHPLRQMARHPLTARPRRAPLIAATLSTPPEAAHSSVAAAVAEDPSEAAPPPRPRVLPDSLQYPPGFVGAIPARSRSDGGGGGIDAMTYLTNILSSKVYDVAIESPLQLAPKLSARLGVKVWLKREDLQPVFSFKLRGAYNMMAKLPRELLERGVICSSAGNHAQGVALAAKRLNCSAVIAMPVTTPEIKWKSVEALGATVVLVGDSYDEAQAYAKKRGVEEGRTFVPPFDHPDVIMGQGTVGMEIVRQMQGPIFAIFVPVGGGGLIAGIAAYVKRVNPEVKIFGVEPTDANAMALSLHHDQRVILDQVGGFADGVAVKEVGEETFRICKELIDGVVLVSRDSICASIKDMFEEKRNILEPAGALALAGAEAYCKHHGVQGKDIVVITSGANMNFDKLRVVTELANVGRKQEAVLATVLPEEPGSFKQFCELVGQMNITEFKYRYNSNEKAVVLYSVGIHTVSELRAMQERMESSQLKTYNLTESDLVKDHLRYLMGGRSNIQNEVLCRFTFPERPGALMKFLDPFSPRWNISLFHYRGEGETGANVLVGIQVPKSEMDEFHDRANKLGYDYKVVNNDDDFQLLMH

SEQ ID NO: 964 - protein, 336 aa, Glycine max
MAGNPATTSSSALSPEKFNFNFSPDNPSRITLTSDQVNHCTQALNILKEKLHAPNVITQEFAHLQANRITPSEMRRRCTVAYDDVNLRKNRYTDVLPFDKNRVVLKSSTDYRPEAQGYINASLVSTSSAGNVSQFIATQGPLQHTYEDFWEMIIQYHCPAIIMLTRLVDNYKMTKCGDYFQAEDRPREVGNISIIGKWENTTETSLVLRHLEVNHREVEDAPLSVLHIQYPEWPDHGVPKDTFAVREILKRLYHLPPNFGPIVVHCSAGIGRTGTYCTIHNTIQRIVAGDMSAVDIAKTIAMFRSQRIGMVQTQDQYIFCYNAIIDELEDLVSQQQ

SEQ ID NO: 965 - protein, 362 aa, Glycine max
MSTCQLKDLSPSLQYANFKYSAEYWITGDLITPPQHRANSFTKRVLDPLLADVVFVPFFATLSANKGAFRKKHGNDDYKRQRQVVDAVKSTQVWNRSGGRDHVFVLTALFGRPGGDFGGWSRGGGGSNCGESDVVPHTQVSVIKDVIVPYMHLLPRLDLSENKVRHQLLYFKGAKHRHRGGIIREKLWDLLVSEPGVIMEEGFPNATGREQSIKGMRTSEFCLHPAGDTPTSCRLFDAIQSLCIPVIVSDIIELPFEGMVDYAEFSVFPAVNDARKPSWLGNHLQSFSKEQKDRFRQNMAQVQPIFVYDNGHPGGIGPIPVDGAVNHIWKKVHQKLSMIKEAIIRERRKPPGASVPRRCHCT

SEQ ID NO: 966 - protein, 512 aa, Glycine max
MKNPRKKKRPKPQKKLEKNKGVVAAAAVVAENENENEEEKRKRSILEALVEAFSLSSVREASMAYNIAGGDPDRASEILRKGFSDRSEDSFSCFSYGSSSSSSSSSGLELGSKGGWRQQQQQKKMVASTGTVSTVLGKEYVRRNNNNIRNKGLSSNGVFEMEEAEQFLCSMLGDDSDINLAVVRDVLCQCGNDIERASDILLDLAASTNEKPNTARHPNYGVDNIDDERFFADPNDSLIDRRLECTSLSWEGYLSNNPWSVGSFGRKYAEVLNNSKANSAVSPGCTKSEIPQKVLESLFNIPKSTEHDKNTMNWRNVVKKIQSLGPGFYVSPHVAESQQRTCAKGDEYHVFREDSRKQWDSVKSYYTKAATAYTKRERAYAAYLSDQGKEQTKLAQKADTKASHDIFVARNKGIENVITIDLHGQHVKQAMRMLKLHLLFGSYVPSVQTLRVITGCGSHGVGKSKLKQSVINLLDREAIEWREENRGTVLIKLSRWREYSFLDTSSDSDSND

SEQ ID NO: 967 - protein, 374 aa, Glycine max
MYLSEKPRPIDFYKEEGARDMMIEVVSNGDLPPPPPPPPMILGESSGEDPEVEIKAPKKRAETWVQDETRSLIGLRREMDALFNTSKSNKHLWEQISAKMREKGFDRSPTMCTDKWRNLLKEFKKAKHQDRGSGSAKMSYYKEIDEILRERSKNVQYKSPTPPPKVDSFMQFADKGIDDTSISFGPVEATGRPTLNLERSLDHDGHPLAITTADAVAASGVPPWNWRETPGNGGESQSCCGRVISVKWGDYTRRIGIDGTPEAIKEAIRAAFRLRTKRTFWLEDEDQIIRSIDREMPLGNYTLHIDEGMAIKLPLYDEPDHIPVHTEDKIFYTEDDFRDFLTRRGWICLREFDSYRNIDNMDDLRPGAIYRGVS

SEQ ID NO: 968 - protein, 958 aa, Glycine max
MGKKNKVKENGGKEHCSSTLFVSNLPYSFSNSQLEETFSEVGPVRRCFIVTQKGSAQHRGFGYVQFAVEEDANRAIELKNGTSVEGRKIVVKHAMPRPPCEERQSKPNKEGKTDDLTKPKDDDEDSTLSGAEKNVSVLKEEEVQVSKQKNMRKPTETKKSALCDDVPDEGSCSEKQRVARTVIFGGLINSDMAEEVHGKAREIGTVCSIKYPLSRKDLEQHGLLQDGCTLDASAVLYTSVKSARASVATLHRKEIGGGNIWVRQLGGEGSKTQKWKLIVRNLPFKAKENEIRDMFSSAGCVWDVFIPQKTNTDLSKGFAFVKFTCKQDAEKAIQKLNGSKFAKRLIAVDWAVSKKIFSSDTNNALASEKGQQNMSDEDSTDEDFELVDKRSGQGDSDTDYSSAMEEEGTPPEDNFDKEADIAKKVLNNLLTSSSKGTSVNNDSMLIKENKGSRSDEIVKDADEKASNESEKVSGVSKPEISSRNNLLNPKGTEDDLQRTVFISNLPFECDNEEVKQRFSGFGEIEYFVPVLHQVTKRPRGTGFLKFKTVEAANTVISTARAASGMGILLKGRPLKVLKALDKKSAHDKELEKAKNEVHDHRNLYLAKEGLILEGTTAAEGVSASDMLKRLELERKKKTKLQSPNFHVSRTRLIIYNLPKSMNEKELKKFCIDAVVSRATKQKPVIRQIKFLKNEKKGNVAQERYSRGVAFVEFSEHQHALVALRVLNNNPETFGPEHRPIVEFALDNVQTLKLRKAKLQSQHQTPQVDNNAMDNDNPGTVEGCKPVKDRKRKSREHDEPAKESVLNTNGESGVAVANGKSPQGHKSKRQKGNNKSKKALKENREAALSMKPKNNENGHNNGGASLEGQNTATDSNRRKSGNKDDVGFRKRKMQNQEQEAGQKVLKKRLKKNKGSVGKDVVDKLDMLVEQYKSKFSHKGSLENDGEKRHSKQLRKWFQS

SEQ ID NO: 969 - protein, 79 aa, Glycine max
MSKVVTLFTLALLLSFNLIHASRPNPSLNVVSSSHEDVAATKEEIDEESCEEGTEECLIRRTLAAHVDYIYTQKHKPKP

SEQ ID NO: 970 - protein, 714 aa, Glycine max
MTLLAIKMTRWLTQVAVWRFVGFVSTIVGLVCYGLSSSFNYLFGEWSLLKIFLYSGFSLFICLGNLFAKVCRPSTSTSLRFKAHSSFLVLTITSVYSYFADKAMNGKPDVYSLISCVSFAIMSFSLSRQTQCGFEVDLFYFFLGCLIVLLLKIKFALAVVGVGFSYSLIILRSSLDTALHHNLGAQVDQLASTTDTSAVVLFVDQLGRTDIDVAAVQDIVVEGQRDNAQRDNASMMQQLMACIEVLRQGNSNLTNMLLEHTKEYFDDKSELAGVDHNFVIDALPSGKINDLEETIKLMVDDGLEKECCDVYCNWRRESLEQCIINLLRLQGINIEEKLEQREFQYYILRWIKAVNVAHRILFPSERRLCDCIFSRFSSVAALCFNEVCRGALIQLLNFAEAVASGSPSEWRLSKILDMFETLRDLIPEFQSLFPESMVKEVMKVHDKLGEASRVIFMNMENVIFHIPETKVIAPADGRVHLMTKHVIRYLVFTSRAQKILEQILEQYPKFANEVAKSNSVSDQIDQVIKRLETELVTVSKNYDKPALRYFFLMNNWRCVELEAIKLRLNLGCFHKDTTKVQQNLELYQSSSWNMVLNFLKLENNELVEPNANAESLKGSLNLFNMHFKDICSTQSRWLAFDKQLSEKIIMSLQHILLPAYGNFIEKLQDVLGIHASEYIKYGLFDIKDQLNHLFLGSMPMNQYLKDKEKLLKLA

SEQ ID NO: 971 - protein, 164 aa, Glycine max
MAAYREPMNMNMSDRAPVSPQQPHSPWHSPVPYLFGGLAAMLGLIAFALLILACSYWKLSGYLEGNGETERDLEAGETEQDQKPAKPYEEKILVIMAGQEKPTFLATPSVSSSCSTSRTSSFGDNTSTCTCEENRKSLEMAVKEGSAAGTGTTETAHTSSDQNL

SEQ ID NO: 972 - protein, 311 aa, Glycine max
MKGEVQLQPPAVMQNPSDSDPLLHNQEEEEEDESPGSSGEIKNEEEDVEAGLLPCCRICLESDSDPEDELISPCMCKGTQQFVHRSCLDHWRSVKEGFAFSHCTTCKAQFHLRVESIEDNTWRKIKFRLFVARDVFLVFLAVQTVIAAIGGFAYIMDKDGSFRNSFDDGWDRILSRHPIPFYYCIGVLAFFVLIGFFGLILHCSSLNSNDPRMAGCQNCCYGWGILDCFPASMEACFALVVVFVVIFAILGIAYGFLAATMAIQRIWQRHYHILTKRELTKEYIVEDLGGCYFPPKLDPEHEGRLKMLKLL

SEQ ID NO: 973 - protein, 869 aa, Glycine max
MATCTSLSLCPHTFCCRHRPHPTRRSLASCSLSPSSLPDTDGPKVLRKRSRRIEGPRKSMEDSVQCKMEEFYEGQDGPPLRVLPIGGLGEIGMNCMLVGNYDRYILIDAGIMFPDYDELGVQKIIPDTTFIRKWKHKIEAVIITHGHEDHIGALPWVIPALDSHTPIFASSFTMELIRKRLKDHGIFVPSRLKVFRTRKKFMAGPFEVEPITVTHSIPDCCGLVLRCSDGTILHTGDWKIDETPLDGRVFDREALEELSKEGVTLMMSDSTNVLSPGRTTSESVVADALLRNISAAKGRVITTQFASNIHRLGSVKAAADLTGRKLVFVGMSLRTYLDAAWKDGKSPIDPSTLVKAEDIDAYAPKDLLIVTTGSQAEPRAALNLASFGSSHSFKLTKEDTVLYSAKVIPGNESRVMEMLNRISEIGSTIVMGKNECLHTSGHGYRGELEEVLRIVKPQHFLPIHGELLFLKEHELLGKSTGIRHTTVIKNGEMLGVSHLRNRRVLSNGFISLGKENLQLMYSDGEKAFGTSSDLFIDERLKIALDGIIVVNMEIFRPQNLDSPVENTLKGKIRITTRCLWLDKGKLLDALHKAAHAALASCPVSCPLAHMEKIVSEMLRKMVRKYSGKRPEVIAIAIENPAAVLANEINTKLSGKLNVDGMSALRKVVDGHEKENQRTEMQIRDRIDVGGLLPTKDNAISSGAEDGLSDAEDPNDYFKPFVESSPVEKSIKTNNGYVPRKEKSSPLKDDCSEDTEECNSVNTSDSEPKSSKSAKRNKWKHEEVKKLIDMRGELNDRFQVVKGRMALWEEISQNLLANGISRSPGQCKSLWTSLLQKYEEVKNEKKNKKKWPYFEDMERILADNKTLETK

SEQ ID NO: 974 - protein, 1729 aa, Glycine max
MKKSSYPNPTPRRHDFHRPPPPTHGCGWAPRPAYHRPYHQWRPRFHPHAARIDRPPEPYFRVELRLGSSPLHRDDVEALIDECHSRHDTFTFYPVDDVAAVLSYRSWEQARDAVVWFWEARLAEKHDFTPTLDSNVVVVKDDVDCRLRPVFARHVKGLTEGKEVKRWMEESERLSKEISRLSSSLSKPLRLGVHNELVEKKKGLVDEKNLVERRLKEFESAMQCLLKYLEGGVDVEGVTVFRFDGGFDWKRIHCLIKRECRRLEDGLPIYAYRSDILQEIHYQQIMVLIGETGSGKSTQLVQFLADSGIGTDESIVCTQPRKIAAKSVAQRVQEESIGCYEGQSIKCCSTFSSSREFDSRIAFMTDHCLLQHYMSDNNLSGVSCIIIDEAHERSLNTDLLLTLLKSLLCRRVEMRLIIMSATADAKQLSDYFFACGIFRVLGRSFPVDIKYVPSDYAGDSGSAVVASYVSDVVRMATEVHKTEKEGTILAFLTSQIEVEWACEKFQAPSAVALPLHGKLSSDEQFRVFQNYTGKRKVIFSTNLAETSLTIPGVRYVIDSGLVKDSRFDPGSGMNVLKVCWISQSSADQRAGRAGRTEPGVCYRLYTEADYQSMDLNQEPEIRRVHLGVAVLRILALGVKDVQGFDFVDAPSPSSIDMAIRNLIQLGAIELNNDVHDLTSEGWCLVRMGIEPRLGKLILGCFKHGLGREGIILAAVMANASSIFCRVGNEFDKQRSDCLKVQFCHCDGDLFTLLSVYKEWEALPRERKNKWCWENSINAKSMRRCQDTILELETCLEREHDVVTPSYWRWDPCMPSNHDKNLKRVILFSLAENVAMYSGCNQLGYEVAQTGQHVQLHPSCSLLVFAQKPSWVVFGELLSISNQYLVCVSAFDFQSLYDLCPAPLFDVSKMEERKLLMKTLSGLGCILLKRFCGKANCNLLALVSRIRKACMDERIFIEVNVDNNEIHLYASSNDMDIALGLVNDVLEYERKWLRTECMDKFLYHGSGFSPPVALFGSGAEIKHLELEKRSLSVDVCHPNINEIDDKELLMFFEKNTSGCICAVHKFTGNTRDEDRDKWGRITFMSPDIVRRAAELDGREFCGSSLKVVPSQLGGDKTFSFPAVKARISWPRRLSRGFAIVKCDIKDVDYILRDFYNLAVGGRYVRCEVGKKSMDSVVINGLDKELSEAEISDVLRTATTRRILDFFLVRGEAVGNPPCSALEEALLKEIYPFLPKRNPHISPCRVQVFAPEPKDAFMRALITFDGRLHLEAAKALEQIEGKVLPGCLSWQKIKCQQLFHSSLTFPTPVYRVIKEQLDEVLASFRNLKGLECNLDRTFNGSHRVKITANATRTVAEVRRPLEELLRGKTIEHDSLTPAVLQLMLSRDGFSLKNSLQQETGTYILFDRHNLNLRVFGSPNMVALAQEKVIQSLLSLHEEKQLEIHLRGRDLPPDLMKQMIKNFGPDLHGLKERVPGVDLTLNIRRHIIILHGSKELKPRVEEIVFEIARSSHHLVERFGNGPSCPICLCEVEDGYRLEGCGHLFCRMCLVEQFESAIKNQGTFPVCCTHRDCGDPILLTDLRSLLFGDKLEDLFRASLGAFVATSGGTYRFCPSPDCPSIYRVADPGSAGEPFVCRACYSETCTRCHLEYHPYLSCERYKEFKEDPDSSLIEWCRGKEQVKCCSACGYVIEKVDGCNHVECKCGKHVCWVCLEFFSTSNDCYDHLRTIHLTI

SEQ ID NO: 975 - protein, 322 aa, Glycine max
MKRLSSSDSSSALMTICPSTEEHSPRNSQHMYGREFQSMLDGLDEEGCVEEPGYQSEKKRRLSVDQVKALEKNFEVENKLEPERKVKLAQELGLQPRQVAVWFQNRRARWKTKQLERDYGVLKANYDALKLNFDTLDQDNEALRKQVKELKSRLLQEENTGGSGVSVKEEIITRPADSEDKTMEQSKSDPSSETSNINPSSESEEDHLNYECFNNNDDCVGGTAASLLQVDFKDGSSDSDGSSAILNEDNMYSPLKFNNCSISTSPSSSSMMNCFQFQKPYHHHAQYVKMEEHNFLSADEACNFFSDEQAPTLQWYCPEQWS

SEQ ID NO: 976 - protein, 125 aa, Glycine max
MAGRFRELMKKYGKVALGVHLSVSTASITGLYVAIRNNVDVESILEKFHMGTVSEGQNPNPNHSDGAAAPPKNRTAQIAASAGGAFTLAILCNKALFPVRVPITVALTPPIARFLARRKIIKSGV

SEQ ID NO: 977 - protein, 333 aa, Glycine max
MDYICLFVTFTAIALLGFVFVVFFEAYKRRNNHQHIEVPAIFEDPSSLKQVPCPHIVDPATKYISLIIPAFNEEHRLPGALEETMNYLHQRTLKDSSFTYEVVIIDDGSADETKRVAFEFVRKYTVDKVRVILLGRNHGKGEAIRKGMMHSRGELLLMLDADGATKVTDLEKLENQIQAVAKREYHHGDSSDSDPRFRISDVPAAVFGSRAHLEEKALATRKWYRNFLMKGFHLVVLLAAGPGIRDTQCGFKMFTRAAARKLFSNVRLKRWCFDVELVFLCKWFRIPVSEISVNWSEIPGSKVNLLSIPNMLWELVLMSVGYRTGMWRISNST

SEQ ID NO: 978 - protein, 706 aa, Glycine max
MELQRRPDQCLPVRKGLKRKLEEEFDDDPQISAPPTGDARDALLSDVKEQVSLLDSNFSWNEHDRAAAKRATHALADLAKNEEVVNVIVEGGAIPALVKHLQAPPLAESDRLPRPMPFEHEVEKGSAFALGLLAVKPEHQQLIVDSGALKHLVDLLKRHKNGLTSRAINSLIRRAADAITNLAHENSSIKTRVRKEGGIPPLVHLLEFADTKVQRAAAGALRTLAFKNDENKNQIVECNALPTLILMLRSEDAAIHYEAVGVIGNLVHSSPDIKKEVLLAGALQPVIGLLSSCCSESQREAALLLGQFAATDSDCKVHIVQRGAVRPLIEMLQSSDVQLKEMSAFALGRLAQDTHNQAGIVHNGGLMPLLKLLDSKNGSLQHNAAFALYGLADNEDNVSDFIRVGGIQRLQDGEFIVQATKDCVAKTLKRLEEKIHGRVLNHLLYLMRVSEKAFQRRVALTLAHLCSADDQRKIFIDYNGLELLMGLLGSYNPKQQLDGAVALCKLANKAMTLSPVDAAPPSPTPQVYLGEQYVNNATLSDVTFLVEGKRFYAHRICLLASSDAFRAMFDGGYREKEARDIEIPNIRWEVFELMMRFIYTGSVDITLDIAQDLLRAADQYLLEGLKRLCEYTIAQDISLENVSSMYELSEAFNAISLRHTCILFILEHYDKLGGKPGHSQLIQHIIPEIQNYFVKAITKANSNIQP

SEQ ID NO: 979 - protein, 350 aa, Glycine max
MSEAQKQVWKGAIPLQIHLHESEVTTLPPPPPALVLAPRIGYLPLLISLLKPQFSTTLPPGVDTIWFEYKGLPLKWYIPTGVLFDLLCVEPERPWNLTVHFRGYPSIVLLPCEGEDSVKWSFINSLKEAAYVINGNSKNVMNMSQTDQVELWGSVLNGNFETYRRVASKLKLGTFEDEYMENVSSVLVKSSQSTGDTDVTGQLKTGRIPVRLYLWTVNEEFDDFEDAPQIDNWDKVSYINRPVEIYKEDGKYFSLNDAVKRILPEFFLENSFVTDGDANINQSGEEGESSSDPGSCCNTLEIAEIKLVRIQGIEPILDIPFSWVVNNLMNPEYFLHMCVCLKVSKANAVQ

SEQ ID NO: 980 - protein, 148 aa, Glycine max
MDLHLSVRLPVSLPCFSHSQNVKLQLQRRRLSTVSSALAETAASMAVAVTVVGAAATLLVKRSKTSESSQIQFKACEDCGGSGICSECKGEGFVLRKRSDESAEKARVQAKNMATRFTAGLPKKWSYCTKCSSGRSCSTCGGSGKLSY

SEQ ID NO: 981 - protein, 548 aa, Glycine max
MDTPNAQPQAASASTPRKKMTKQLTGKRDDTPLHSAARAGNMTVLKDTVGGTEEGELRVLLTKQNHAGETVLYVAAEYGYVDMVRELIQYYDLAGAGIKARNGFDALHIAAKQGDLDIVKILMEAHPELSMTVDPSNTTAVHTAALQGHTEIVKLLLEAGSNLATISRSNGKTALHSAARNGHLEVVKALLGKEPSVATRTDKKGQTAIHMAVKGQSLEVVEELIKADPSTINMVDNKGNTALHIATRKGRARIVKLLLGQTETDALVVNRSGETALDTAEKTGNSEVKDILLEHGVRRAKAIKAQPGTATARELKQTVSDIKHEVHYQLEHTRQTRRGVQGIAKRINKMHTEGLNNAINSTTVVAVLIATVAFAAIFTVPGQFADEPKDIPAGSGMTIGEANIAPQAAFLIFFVFDSIALFISLAVVVVQTSVVIIESKAKKQMMAIINKLMWLACVLISVAFLALSFVVVGKDQKWLAIGVTIIGTTIMATTLGTMSYWVIRHRIEASNLRSIRKSSMGSRSRSFSVSVMSDSELLNNDRKILYAI

SEQ ID NO: 982 - protein, 454 aa, Glycine max
MNPNDANSPKPLEILQMNPVPPFLSKTFDLVDDPTLDPIISWGSTGFSFVVWDPLEFARIVLPRHFKHNNFSSFVRQLNTYGFRKIDTDKWEFFNEAFQRGKKHLLKNIQRRRSSQSQQVGSYIGIECSTEAGRSDVEIEIERLRKERTMLMEEVVDLKQEQRRMAHRAGEVNQRLQSTEQRQKQMVSFLVKLIQNPAFLARLRHEEQKEIDSPRVVRKFVKQHQHETGTAETLQEGQIVRYQHDWRNIGMSSETPKLSPVSIEQSPHYLSQGLAGEVSVGAEDLTAQIENIVSNDLAAVHGITVSQEIMIGEGLSSFGAEDPLFKGKSVMSPILEVPPEYFASFPEGLTKGKDFQDFSALGTEGMIKLEDIWDSGLNVSGAASGSGNELWSNHVNYEEFPEFGVTSGMSDSDIWDIGLGSLGIDKWPTDEPSLGETNGQAGQPKEDRPKNFGP

SEQ ID NO: 983 - protein, 931 aa, Glycine max
MKRFSACCFTSRISKFHSHWKHNHSQSQIMAGNISGPSGSKGANILLNHDFSSGLTSWHLNSCTGYVISSKSGTQGGIPMDLDANYAVITDRKECWQGLEQDITNKISIGSTYTVSACVGVSGVSQGSSDVLATLKLEHHDSATRYLFIGRTSVNNDSWEKLEGTFSLSTMPDRVIIYLEGPAPGVDLLIRSVVINCSTPNDNTTSTGCVSAGDDNIIVNPQFDDGLKNWSGRSCKIMLHDSMNDGKIVPKSGKFFASATERTQSWNGIQQEITGRVQRKLAYEVTALVRIFGNNVSTADVRATLWVQTPDLREQYIGIANVQATDKDWITMQGKFLLNGSPSKVVLYLEGPPPGTDILLNNLVLKHAAKTPPSTPPDVKNVAFGVNIIENSNLADSTNGWFPLGNCTLSVKTGSPHIIPPMARDSLGPHELLSGRYILVTNRMQTWMGPAQTITDKVKLFVTYQVSAWVRIGSAGSSGPQNVNVALGVDNQWVNGGQTQVSDDMWHEIGGSFRIEKQPSKVMVYVQGPASGVDLMVAGLQIFPVDRHTRFRYLKIQTDKIRKRDVILKFSGLDSGSYANTSVKVIQTHNDFPIGTCISRTNIDNEDFVNFIVKHFNWAVFGNELKWYWTEPQQGNFNYKDADDMLSLCQKHKIQTRGHCIFWEVDETVQQWIKSLNKNDLMTAVQNRLNGLLTRYKGKFSHYDVNNEMLHGSFYQDRLGKDIRANMFKTASQLDPSATLFVNDYHVEDGCDTRSCPDKYIHHILDLQEQGAPVGGIGIQGHIDCPIGPIVSSSLDKLGILGLPIWFTELDVSSVNEYVRADDLEVMLREAMAHPTVEGLMLWGFWELFMSRDHSHLVNAEGDINEAGKRFLALKQEWLSHSRGHVDEQGQYNFRGFHGTYNVQVVTPSKKISKTFVLDKGDSPLVVSIDL

SEQ ID NO: 984 - protein, 461 aa, Glycine max
MANRPDPDIDDDFRELYKEYTGPLGTATTNMQERAKSNKRSNAGSDEEEEARDPNAVPTDFTSREAKVWEAKSKATERNWKKRKEEEMICKLCGESGHFTQGCPSTLGANRKSQDFFERIPARDKNVRALFTEKVLSKIEKDVGCKIKMDEKFIIVSGKDRLILAKGVDAVHKIREEGDQRGSSSSQMTQSRSPERSPVSARFQRSEPQRSHSGPRNTSQFQQRFGRQERAVEDRIRDDVQKFSRGSPQAYGNSGARGRSSQSRSPRHAPYTGNSYNSFDDRNQNMGAYRNEGWDSHRRESGIQPGHQFDYNASPQTLEELELEYKNEATELMKIRDREEDEENFKHREAIRDLREKYMSKVSLVRVTHAKQLEEFLQLDAQRRRQQVGQQMSSGYRGFKQQSFPEYDGSTANPPTYAGSNIPLESRNRFSGNMETYPNRPHDNFGEFHRRGDFAKAYNRY

SEQ ID NO: 985 - protein, 146 aa, Solanum lycopersicum
MPMRPTGGLKQDWDPIVLQKPKMKAQDLKDPKIVNQALRAGAQVQTVKKIDAGLNKKAATLAVNVRKLDEAAEPAALEKLPVGVRQAIQKARIEKKMSQADLAKKINERTQVVAEYENGKAVPNQLVLGKMENVLGVKLRGKIHKS

SEQ ID NO: 986 - protein, 281 aa, Solanum lycopersicum
MYRFSNTVIGFLNLFTLLASIPIIGAGLWMARSSTTCEKFLQTPLLFIGFIILIVSLAGFIGACFHVAWALWLYLFVMLFLIGALMGLTVFGFVVTSQGGGLDVPGKVYKEYHLQNYSPWLRKRIKDPQYWLTVRACILGSKTCANVITWTPYDYLTKDLTPIQSGCCKPPTACNYGLTTMTQEADCYQWNNDPNLLCYECDSCKAGVLEDVRRDWQKISVLNIVMLVLLIGIYSIGCCAFQNTKRAVSDYPHGENRMYKVRPRWDFYWWRWWHDRRHQLY

SEQ ID NO: 987 - protein, 162 aa, Solanum lycopersicum
MGKARIIGIGMDYSATSKIALKWAIDNLIEEGDTIIIIHVVSSKVEPTSKQLFEDTGSPLIPLDEFKQINVSKYYGLNPDKEVIDMLEPVAKLKKVTVVSKVYWGDAREKLCDAAESLKLDSLVIGGRGLGVLKRVLLGSVSNYVVQNATCPVTVVKTSPQK

SEQ ID NO: 988 - protein, 163 aa, Solanum lycopersicum
MEGGGRFVGVAVDFSACSNKALKWAIDNILRKGDHLILVTVRPEGHYEEGEMQLWEATGSPLIPLSEICDGHTMKRYGVNPDPETLQMITLAARQMEITVVMKIFWGDAREKLCEAIDKTPLSCLVIGNRGLGKIKRVIMGSVSNYVVNNATCPVTVVKNAED

SEQ ID NO: 989 - protein, 161 aa, Solanum lycopersicum
MATMGMTGSIGGYGAASASLFRLRNSAKKKTRNGKNGFRVSCVCSSSAVADPYKTLKIQPGASESEVRKAFRQLALKYHPDVCRGNNCGVQFHQINEAYDVVMSNLRGETRAELEMIEEYDDSNDESMRGMHEPDWDLWEEWMGWEGAGIRDYTSHVNPYI

SEQ ID NO: 990 - protein, 576 aa, Solanum lycopersicum
MLVSKCPLNHILFEPRISRGGFRWKASASNEVPVEKWKQDSIFIDRRGRFRQFDHKKVSRKRCGSLRGRGWKYGSGFVDGIFPVLSPIAQQILTFIKTEKDPERIWSSLDTLRPTNNTWDDLINVAVQLRLNKQWDLIILMCEWILCRSSFQADVICYNLLIEAYGQSSLVKKAESTYLALVDARCVPTEDTYALLLKSYSKCRMIEKAEAVFSEMRKNGLPSSALVYNAYIDGLMKGRNSQKALAIFDRMKRESCQPSTDTYTMLINLYGKENKSYMALKMFNEMKAQKCKPNICTYTALVNAFARSGLCEKAEEVFEELQEAGFEPDVYTYNALMEAYSRAGYPQGAAEIFSLMQHMGCEPDTASYNIMVDAYGRAGLHEDAQTVFDEMTRLGIAPTMKSYMLLISAYSRNSNVSKCEEIVNQMQKSGVKLDTFLLNSMLNLYGRLGQFAKMEELLTVIEAGPYVADISTYNILINAYGRSGFIVKMEEVFQSLPSKNLQPDVVTWTSRLGAYSKKKQYQRCLEIFEEMIDEGCYPDGGTAKVLLSSCSSEDQIEQVTTVIRSMHKNVKTVELV

SEQ ID NO: 991 - protein, 217 aa, Solanum lycopersicum
MTWTTVLIQILLHSFCDSGTGRSSQGDGEIGQMAIKLYTRSIVLIVVIAFLSVLPATLCIEDKCSACSAIAEELEHGLLKEKPRNHLDMRHRLDSKGQREGKLIDYRGSELRVVELLDDLCEKMQDYTLEKVDSSTNTWIKVSNWDLLKTNKQEARAHSKALSSFCGRLLEQTEDELAELIKKGSVQVGDVTKVLCEDLSNYCKGTSSSNKAVDDEL

SEQ ID NO: 992 - protein, 417 aa, Solanum lycopersicum
MASLVQFLPLFPFFFLVSFCVSHGPFLPKAIILPVNKDPSTFQYVTQLYMGVTHLAPIKLVVDLEGSFLWADCGLTSDSSSQKLVPCNSLKCSMAKPNGCTNDNKICGLKSENPFTRLAATGELAEDMFAVEFIDELKTGSVASIHQFLFSCTSSTLLQGLARGAKGMLGLGNSRIALPSQLSDTFGFQRKFAICLSSSNGAIISGESPYLSLLSHDVSRSMLYTPLISSRNGVSEEYYINVKSLKINGKKLSLNTTLLTMDGEGQGGTRISTISPFTTMKTSIYKTFVEAYERFGFSMGLTKVEPIAPFGLCFSTKVEEGLNVPSIDLVLQSEMVKWRIYESNSMVKVSDEVMCLGFLDGGANQKASIVIGGHQLEDNLLEFNLGTSMLGFTSSLSMVETSCSDFMFSKDSSPFDS

SEQ ID NO: 993 - protein, 165 aa, Solanum lycopersicum
MENLLGLMRVRIHRGINLAIRDVTTSDPYVVVRMGKQKLKTRVVKKNLNPEWNEELTLSITEPILPIKLHVYDKDIFSLDDKMGDAEVDIQPFIDAVRKRYKNIPSGTIITKIKPSRQNCFSEESSIVWENDQVVQNVFIRLRNVERGEIELQLQWIDIPGSKGV

SEQ ID NO: 994 - protein, 326 aa, Solanum lycopersicum
MASFFCSTKFLLLLFFLSAIPIAFIIHLETSSPTTHVYHYHSTGWLRECSKWDDANRRFIVSFFEGGLGVIPVEADYSPGDVLQEMPVVKDADLTGNASLGFTIDRERNRVLVAVADVLGNRYSALAAYDLTLWNRVFLTKLSGPEDEKAFADDVVVDTEGNAYITDAKADKIWKVGANGELKYTIKNSIFTPKEWYNKLVGLNGIVYHPNGYLLVAHTFSGNLFKIEIAKGDEVKLVKIDYGSLKFGDGMELLSPTKLVVAGNPTRLVESSDDWESGTIVGKAKGAIHRLSTAATVKEGTVYLNHMIGLGYPRKKHVLVEAVFSA

SEQ ID NO: 995 - protein, 355 aa, Solanum lycopersicum
MELIPTLPYDIGLECLIRVPYNNFSSLTSVSRNWKLQIELPEFWRRRKATGSTRQVILMAQARIDPRLKLGSFKYSAFSFYKLTLYEPESGNWAELPPVPGISDGLPMFCQLVGVGLNLVVMGGWNPLSWEPSNAVFVFSFVSATWRRGADMPGCRRSFFGCASDSERTVYVAGGHDEEKNALKSAMAYDVARDMWVPVPDMTSERDECKCSFFEGKFHVIGGYDTSMQGQFGTSAESFDPSTWQWDQVNEHFFESATCPRTCVEGGDGKLYLCRDGDVLALGKSTWQAVAAIPTELRSVAFVTAWRGKILMTGSMGFNEPHNTYVLDLKSYKWTKMDTPVYFSGHVQSGCCLEM

SEQ ID NO: 996 - protein, 188 aa, Solanum lycopersicum
MSKEGSRRGVKWSWTSAFVGAAAAAATVMTLSSKPRDPDFHLISIDLTSFKLNFPVVDAELILTVHVTNPNVTSINYSSTEMSIFYSGDHLGSARVKAGSQPPRSCQVLRLPARLSGLQLAHHGKEFVADVAKREMLLDATVDIEGFAKVMWWDHKFRVHVDSHVTVDPVFLDVIDQENKSALEVFVK

SEQ ID NO: 997 - protein, 482 aa, Solanum lycopersicum
MPGPTMESEFPVEPQSLKKLSFKSLKRSLDLFSPIHGHFPLPDPESKKVRTSYKLNVEYGGIKGSAAEPNAKAGVQHQAQPASAPSNTLALPGPENTRDEKTGNELALGPSIPGNGPTDVRFSGKSNAVVPSHSSSERNLSTAAIMERIPSRWPRPIWRAPWKNYRVISGHLGWVRSVAVDPSNTWFCTGSADRTIKIWDLASGRLKLTLTGHIEQVRGLAVSNKHTYMFSAGDDKLVKCWDLEQNKVIRSYHGHLSGVYCLALHPTIDILFTGGRDSVCRVWDIRSKMQIHALSGHDNTVCSVFTRPMDPQVITGSHDSTIKFWDLRYGKTMATLTHHKKSVRAMAQHPTEDCFASASADNIKKFSLPKGEFMHNMLSQQKTIVNAMAINNDGVMVTGGDNGSMWFWDWKSGHNFQQSQTIVQPGSLDSEAGIYALTYDVTGSRLISCEADKTIKMWKEDETATPETHPLHFKPPKDIRRF

SEQ ID NO: 998 - protein, 734 aa, Solanum lycopersicum
MELRCLQTLNIPATALAEKPFLCGHPITLIQTSTKRGPNSKNLKTLRFRTQISAKISSLEPQGTAKDVKSKDANLVFVAGATGRVGSRTVRELLKLGFKVRAGVRSAQRAQPLVKSVEQIKLENATDGGAKAIEKLEIVECDLEKSYQIRPALGDASIVICCIGASEKEIFDVTGPYRIDYLATKNLIDAATVAKVDHFILLTSLGTNKVGFPAAILNLFWGVLLWKRKAEEALLASGLPYTIVRPGGMERPTDSFKETHNITLSEEDTLFGGLVSNLQVAELMAVMAKNRSLSYCKVVEVVAETTAPLTPMEDLLAKIPPQRVEVSPPKETGDLQKSATPTSITSEIPDALLEKKPSETKLKAAAPLSPYTAYAELKPPTSPSPIPPGGHQAGASGAEDSKPTKKASSVVDYAFDKAELLTTRPSSPYAAYEDLKPPTSPSPNPPGGRQEGSSGAEDGEPTKAVSSVVDSTFDKVELLTTRPLSPYTAYEDLKPPTSPSPIPPGGRQEGATGAEDSEHTKAASSVVDSTFDKAELLTTRPLSPYTAYEDLKPPTSPIPIPPGGRQEGASGAEDSEHTKAASSVVDSTFDKAELLTTSYEDLKPPTSPSTNPPGGRQEGASGAENTKPTKEASSVYLFTFDKAELVTTRPLSPYTAYEDLKPPRSPSPRPSGLKSSATAEVTSAVTGGNDVAIDSANNFSKEDSSKSSAFCHSPYPAYEDFKPPSSPTPSFNKM

SEQ ID NO: 999 - protein, 576 aa, Solanum lycopersicum
MATPLKNTNRLSLAMERTGQWVFSQEIPTDVIVEVGEANFNLHKFMLVAKSNYIRKLILDTKESDVSRINLSDIPGGPEMFEKAAKFCYGVNFEITVHNVAALRCAAEYLQMTDKYCDNNLASRTEDFLAQVALTSLSGALVVLKSCENLLPLAHDLNIIQRCVDIAGAKACVEANFPSRSPPNWWTEELTILDVAFFERIIVAMKTRGAKALTIASAIITYTERSLRDLVRDHSGNNTRLMVPEDSDMRMHQRELLESIVTLLPAERAAFPINFLCCLLRTAIFLRAASSCKNELEKRISAILEHVTVDDLLVLSFSYDGERLFDLESVRRIISGFMEKEKSVAVFKGGDFGDVCTTAMQRVAKTVDAYLGEIATFGDLSISKFNGIAILVPKGARKADDDLYRAVDIYLKAHPHLDEIEREKVCSVMDPLKLSHEARVHASQNKRLPVQIVLHALYFDQLKIRSGAADDSNNNMPEAMATRNQLQADVSLVKENEVLRTELLKMKMYIADIQKTTNSSQGTSKGSLKKTTFFSSVSKTLGKFNPFKHGSKDTSSIVDDAALDLTKPRRRRFSIS

SEQ ID NO: 1000 - protein, 781 aa, Solanum lycopersicum
MRSVRMDSIGPPTKRLVELNRHSIQDGQNGVRDGITGDGQGLSEEDESRINEDVEGGNETQRDLLQVQAVLQTQQQQPPGPLVRWERFLPLRSLKVLLVENDDSTRHVVSALLRNCSYEVIAVGYALEAWRILEDLTNHVDLVLTEVAMPFLSGVGLLSKIMNHKTLKNVPVIMMSANDSMGIVFKCLSKGAVDFLVKPIRKNELKNLWQHVWRKCHSSSGSGSESGIQTQKSTKSKSVEMSGNNTDSNDEAENGSFDLDDRDGSDNGSGTQSSWSKRAIEVDSPQPMSPWNELADPPDSTCAQVIHSRPEALSATWVPANATRRCLNEKDELGNVRTVKDLNMGVANVPELEGLSGKVMDGLAASMKDKHLELDPKDNENMGRNLKLNKETREDDLKDKDVGYMGDITNTCTPQVESTANEVPNDPSKITNIKEIATYDSKDMPSLELSLKQLRDVGENGTGVQERNILRHSDLSAFSRYNAASTANQAPTGNVGSCSPVNNSSEVAKAESIHNLQSKSSSTPNQRSNGSSNNNDMGSSTNNFFIKPDTLIDKPINKPAVNAHSCSAFQPVQHGHTSSLQAMVPGTQDTAKAAVGQARAMHQKFQVQHHHHHYHHHHHHVLSLQQRQQLLNADASSLRNAVETAPDCGTSDMVGTPVEGNAANYGSASGSNNGSNGQNGSSGQNGSSTAVVAEGTNLVAENETGEKCEIGSGSGSATRSGDHSAQREAALIKFRQKRKERCFEKKVRYQSRKRLAEQRPRMRGQFVRQDADKSKSNNTNS

SEQ ID NO: 1001 - protein, 354 aa, Solanum lycopersicum
MIQNPKQLILSTFHIHTTVPKKKWNPFSMAISTSFCRPISSFNALTSPSLCYFKPLYNHLKLDPSLPLVKCCSSHIGQSPEHINGRQPDLSPIASFGVTMTNNGTSKPSYRWRRVLLKVSGEALAGDQAQNIDPKITMAIAREVAAVTRLGIEVAIVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDDNPKHNPNARLQDNLTYHDVISKELSVMDLTAITLCQENNIPVVVFNLNKTGNIAKAIKGERVGTLIGDTWNTEAVVS

SEQ ID NO: 1002 - protein, 185 aa, Solanum lycopersicum
METLICIQIPNLFITNSFPLSQKLPIHFHKRINRIPNLQRTTWKLNAEAKGFGNGKPEISKKGNRRNNNNNDDSDEKIPTEIWERIIGRILFYVGAPLIGGVILLQIFDLIKQQKLLDLPIWLPFLTTFITFGASALGAAYGTLSASWDPEKQGSFIGLEEAQKNWVDMWAEDGADEEEENRWIN

SEQ ID NO: 1003 - protein, 197 aa, Solanum lycopersicum
MASTGSLLCKCRVSSLMSISSFPLMQPITRPEITYSQRHVRVGTSSVLRNVSHNMSMKKVPRMITRASSEPSGSSDGALGQNKTPFGYTRKDVILIGVGVTLLGVGLKSGLEFLGFDPLQAGNVVQLVLVLGLTVGWISTYIFRVSNKEMTYAQQLRDYESKVMEKRLESLTEAELQVLLEQVEEEKTRLTSGEEVK

SEQ ID NO: 1004 - protein, 472 aa, Solanum lycopersicum
MDMKVLKWQFLHGSLVKRLILKGFLFVTVMIVVSFVQMTHMIQKSEPIMLNFGVCPLNFGSDEYMNVTGFFKPVSGLGISLFGASLMKRDDEKLTKDVFKELMEKDFLDLNANALCVGKKSSFAALVLRELGLLSAVGVDAHPYFSLVWRRFMYELDHENNSFDFVFSRDLDKVTVPALMVLEIERVLRPGGTGVMLVGSSSFYAGNLVKGNLIRSATPVSSFLKSSDVVHVCGVGTYTLVMFKKRSEIVQSLVHSVLPANCPSNVNNKPYLKHLEPLVEKKLGQFDTQISYLPKFMNISSRNKLVYINVGAGEFVESTLARTFKPHYPIPHHLFNVFVIDHNTSTLSLYVKNPGINFVYHPGLAVAGETTLSSVDTDEYLGAPLDREGFDFIHWFSETVKDGDYVVLMMNARAAELNILAELFQTGSICHVDELFLRCSAADCRNALCGDCMSLFKTLRRSGVFAHQWWGD

SEQ ID NO: 1005 - protein, 261 aa, Solanum lycopersicum
MASLSGLSEELGEIEGQISDIFRALSNGFQKLEKIKDSNRQSRQLEELTGKMRECKRLIKEFDREVKDLEYKSDADTTKMLSEKKQSMIKELNSYVALKKQYASNIENKRVDLFEGPGEGFAEENGLLASNMSNQQLMDQGNRMMDETDEAIERSKKVVHETVNVGTETAAALKAQTEQMSRIVNELDSIHFSIKKATQLVKELGRQVATDRCIMALLFLIVIGVIAIIIVKIVNPHNKDIRDIPGLAPPAPSRRLLAYPY

SEQ ID NO: 1006 - protein, 336 aa, Solanum lycopersicum
MEKVKSMEKKKLINELTQGKEFVNQLKNQIIGPLASPEECDLLIGKILSTLEKSLSILNLKALLLEGGINNINNSTSSCSSISFLGSSNNNISPKSEVFDSSREKLDKNMVSKKRKKTQQWINQTSISVNGLEGPCEDGFSWRKYGQKDILGASHPRAYYRCTHRNTQGCLATKQVQKSDANSTIFEVTYKGRHSCKVAQSEIFSLNNQKRQKCNKKQQEEMVIFNSATPNHNAENFNIITAKDEEVFTAFPFPPAPLHIENIIEENKFFPDSSELPLYLASPNDEFGMEHMILQSSDSDLTELISTPTSISNSSFGGEGVDYEPEITFDIEEFFI

SEQ ID NO: 1007 - protein, 285 aa, Solanum lycopersicum
MGSGHIFFDPSSCHGNMLFLGSGDPVFRGPRSTMMKMEDSSKRRPFFSSPEDLYDEEYYDEQSPEKKRRLTPEQVHLLEKSFETENKLEPERKTQLAKKLGLQPRQVAVWFQNRRARWKTKQLERDYDQLKSSYDSLLSDFDSVRKDNDKLKSEVVSLMEKLQGKVVGGAGGNEKSDILEVDAMTILQVKVKAEDRLSSGSGGSAVVDEHSPQLVDSGDSYFHTDHEEYPGPGGCNVPPPMDGLQSEEDDGSDDHGSCHGYFSNVFVAEEQHHEQGEEPIGWFWS

SEQ ID NO: 1008 - protein, 536 aa, Solanum lycopersicum
MDSAAMTSVCGKSALCSTPGLFLGRTNGIRSSQCSFIAGNRINFPRQTAQAHRVRTNSRKGHGALTVTCRAEKILVANRGEIAVRVIRTAHEMGIPCVAVYSTIDKDALHVKLADESVCIGEAPSNQSYLVIPNVLSAAISRGCTMLHPGYGFLSENASFVEMCREHGINFIGPNPDSIRVMGDKATARDTMKNAGVPTVPGSDGLLQSTEEGVKLAEEIGYPVMIKATAGGGGRGMRLAKEPNEFVKLLQQAKSEAAAAFGNDGVYLEKYIVNPRHIEFQVLADKYGNVVHFGERDCSIQRRNQKLLEEAPSPALTPELRKAMGDAAVAAAASIGYIGVGTIEFLLDERGSFYFMEMNTRIQVEHPVTEMISSVDLIEEQIRVAMGEKLRYKQEDIVLRGHSIECRINAEDAFKNFRPGPGRITSYLPAGGPFTRMDSHVYPDYVVPPSYDSLLGKLIVWAPTRERAIERMKRALDDTVITGVPTTIEYHKLILDIEDFKNGKVDTAFIPKHEEELAPPQQIVPAASKELINANA

SEQ ID NO: 1009 - protein, 291 aa, Solanum lycopersicum
MMTSRVIFTIPYFSFPSISNKSPYPKLIPDTSAPICYAICCSTSTPGLPVTTEILRNDTPLTGGAFDFENATTSLTKRVLASPKKVTIVRHGLSSWNEESRVQGSSNLSILSEKGTMQAERCKMALSDIHFDQCFSSPISRAKTTAEIIWKGKEEPLVFLDSLKEAHLFFLEGMKNEDAKRIYPKEYTTWREDPSKFCVDGVYPLQKLWGRAHEAWEEILLTPGEHFLVVTHKSILRALICTALGLGPERFRSVDINNGGLCVFKFNKEGEAMLQSLNMTAHMYTDHVYHY

SEQ ID NO: 1010 - protein, 375 aa, Solanum lycopersicum
MEAVRELYNRAKPFLAVIFLQFGLAGMDILTKVALNEGMSNYVFVVYRHAVATLVIAPFAIILDKKVRPKMTPSIFAKLVLLSLLEPVIDQNLYSIGLKYTTATFAAAMCNILPAITFIMAWIFRLEKVKLTSIRSQAKIVGTVATVAGAMIMTLVRGPIVELFWTTGNAGHNSQSGGLNLSHAIKGSIMITIGCFSWAAFMILQAITLRTYPAELSLTAWICLLGTTEGAIVAMVMERGKPAVWAINWDSKFLAAVYSGIFCSGLAYYIQGVIMKDRGPVFVTAFNPLSMVIVAVLSTIILREQLNLGRVLGAVVIVVGLYIVLWGKSKDHKSPSIDEQAIPTHETKIDKEPFSQTVTHINSSKGTTATEDEGI

SEQ ID NO: 1011 - protein, 381 aa, Solanum lycopersicum
MNTPALSLRHNHFLNGSSALVSGIRLPRSSSSPFRVRMSLQENGPSVAVVGVTGAVGQEFLSVLSDRNFPYRSLKLLASKRSAGKSMKFEERDYTVEELTEDSFDGIDIALFSAGGSISKKFGPLAAQKGTIVVDNSSAFRMDENVPLVIPEVNPEAMAHVKLGSGKGALIANPNCSTIICLMAVTPLHRRAKVKRMVVSTYQAASGAGAAAMEELVQQTREVLEGKEPTCNIFNQQYAFNLFSHNAPVQPNGYNEEEMKLVKETRKIWSDKDVKVTATCIRVPVMRAHAESVNLQFENPLDENTARDILKNAPGIVVVDDRASNRFPTPLEVSNKDDVAVGRVRRDVSQDGDYGLDIFVCGDQIRKGAALNAIQIAEMLL

SEQ ID NO: 1012 - protein, 314 aa, Solanum lycopersicum
MASSPPDQEQQPPQFPPLHYRTWVLKVSIHCPGCKRKVKKVLQSIEGVYTTDIDPQQQKVIVTGNVEAETLIKKLIRNGRSAELWPEPKPILKEKKPKKNENSEDDDDDHEDDEHNNNNNNEKPAEHGPPRHGVRFGGVETFTMDVKEVRPDERPPENIAVVERFPAPEQKAGGGGGAKKKKKKKKKKSSSGNNNANPNASAGSNGAPPGSESDAAKMGPNQMMDQANQGHSNQHPYPNPCDQHPHASYYVPQQHQSYIVSYNAAHPMVSSAPAYYYVPSSPYMQSDIYSKQQCTPLDSFEILSDENPHACYIM

SEQ ID NO: 1013 - protein, 1075 aa, Solanum lycopersicum
MAKKQNDSSRFSTNLTPSPQKDKPISSSSELALFYPQNEEPVPLIVFYPSSVRRRSSRFTTNKFSTSATEFMTKNRDTISPEKTVFLLPSPPTLAGKNTPAEGTRRSPRLVSLSARTTTAKEKGKKVNSRKSEGGIKQVELSRKRKPASCKMDEETRKSPRFNSDSSNGVQLALPEMSACGALAAGGRTGTKRELLALMMTTPANSSASRKRAARGSDSVNVGNNSRGSRRKDPVFAESPGTSVKITAESNSAGEKNLRSRKAQGSVNYNESKGSETKRIKSSAEKSVRKQKSNACFIGEPIDTEEAQQQWQWRYELKNRKTQRQGWKLNSGEEDEIILNVECHYAQAKVAGFIFNIGDCAFVKGEGKKKHIGRILEFFKTTEGEDYFRVQWFFRAEDTVLQGAASFHDPKRVFYSTLENDNLLDCIVSKVNVVELPTRHDLNKKDVPPAHFYYDMEYCVDYSTFRTLHNVKSSVSPSLVDVSYKPITTYPLEVSPSCEPMKVELSLLDLYAGCGGMSMGLCLGTKLSGLNLVTKWAVDFNKAACDSLKLNHPQTHVRNEGVENFLELLKRWEKLIKSYGCSDIKTSSNSELDDRDEGENNDDSQSGSNASSGEYEVLRFVDICYGDPNNDGKSGLHFKVRWKGYGPSEDTWEPIENLKNCGDSIKDFVRRGQQLKILPLPGDVDMICGGPPCQGISGYNRHRNTDDPLSDEKNRQIIIFMDVVEFLRPKYVLMENVADILRFDKASLGRYALSRLVHMRYQARLGTMAAGCYGLPQFRLRVFFWGALPSERLPPFPLPSHDVIVKYWPSPEFERNTVAYEEGQPRDLEEALVLRDAISDMPAVTWHETREERPYEMPPETEFQKYIRLSKHEILSCTSTGVKETKEPVLSDHRPCQLNEDDYLRVCLVPRRKGANFRDLPGVIVGGDNVARRDTKDPKVLPNGKPMVPDCAFNFEHGKSKRPFARLWWDETVATLVTFPNHRAQAILHPEQDRVLTIREYARLQGFPDFYRFTGTLKERYCQVGNAVAVPVGRALGYALGLAYQRLAGNEPLIKLPSNFSFLTPPIDDIVVLQT

SEQ ID NO: 1014 - protein, 337 aa, Solanum lycopersicum
METKVISSGIHHSTLPQSYIRPESDRPRLSEVVDCENVPIIDLGCGDQAQIIRQIGEACQTYGFFQVINHGVPKEVVEKMLGVAGEFFNLPVEEKLKLYSDDPSKTMRLSTSFNVKKETVHNWRDYLRLHCYPLEKYAPEWPSNPSSFREIVSRYCMEIRQLGFRLEEAIAESLGLEKECIKDVLGEQGQHMAINFYPPCPQPELTYGLPAHTDPNSLTILLQDLQVAGLQVLKDGKWLAVKPQPDAFVINLGDQLQAVSNGKYKSVWHRAIVNSDQARMSVASFLCPCDSAKISAPKLLTEDGSPAIYQDFTYAEYYNKFWSRNLDQQHCLELFKN

SEQ ID NO: 1015 - protein, 2210 aa, Solanum lycopersicum
MSIASSSVLQTKNNGVVMSSPVKSLVGHQLNAMPLGRVGVGLGRTRVTRSSVVKRTTGFEKKFYGAKLRASGPERLHLWQSDGPGRAPKLRVVVRSALSQVPEKPLGLYDPSFDKDSCGVGFVAELSGESSRKTVTDAIEMLVRMSHRGACGCETNTGDGAGILVGLPHDFYKEVTSEAGFEIPPPGQYAVGMFFLPTSDSRREQSKIVFTKVAESLGHTVLGWRPVPTDNSGLGKSALQTEPIIEQVFLTPTPRSKVDFERQMYILRRVAMVAIRAALNLQHGGVKDFYICSLSSRTVVYKGQLKPNQLKEYYFADLGNERFTSYMALVHSRFSTNTFPSWDRAQPMRVLGHNGEINTLRGNVNWMRAREGLLKCKELGLSKTEMKKLLPIVDASSSDSGAFDGVLELLLRAGRSLPEAVMMMIPEAWQNDKNMDPSRKALYEYFSALMEPWDGPALMSFTDGRYLGATLDRNGLRPGRFYVTYSGRVIMASEVGVVDIPPEDVSRKGRLNPGMMLLVDFENHVVVDDDALKKQYSLARPYGQWLKKQKIELKDIVESVNYSYRVPPPIAGVLPAVSDEDSMENMGLHGLLAPLKAFGYTTEALEMLLLPMAKDGVEALGSMGNDAPLAVMSNREKLTFEYFKQMFAQVTNPPIDPIREKIVTSMQCMVGPEGDLTETTEEQCHRLSLKGPLLSIEEMEAVKKMNYRGWRSKVLDITYSRDRGTKGLEETLDRICSEAHDAIQEGYTAIVLSDRGFSPKRVAVSSLLSIGAVHHHLVKKLERTRVALIVESAEPREVHHFCTLVGFGADAICPYLAVEAIWRLQVDGKIPPKSTGEFHSKDELVKKYFKASHYGMMKVLAKMGISTLASYKGAQIFEAVGLSSEVMERCFNGTPSRVEGATFEALAKDALNLHGLAFPSRALAPGSAEAVALPNPGDYHWRKGGEIHLNDPFAIAKLQEAAQSNSVAAYKEYSKRVQELNRQCNLRGLLKFKEGEVKVPLEEVEPASEIVKRFCTGAMSYGSISLEAHATLAIAMNKIGGKSNTGEGGEQPSRMEPLPNGTKNPKRSAIKQVASGRFGVSSYYLTNADELQIKMAQGAKPGEGGELPGHKVIGDIAVTRNSTAGVGLISPPPHHDIYSIEDLAQLIHDLKNANPGARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPILREKFAGEPEHVINFFFMLAEEVREIMSQLGFRTLTEMVGRSDMLEMDNDLVKNNDKLKNIDLSLLLRPAADIRPEAAQYCIQKQDHGLDMALDNNLIALSKAALERSLPVYIETPICNVNRAVGTMLSHEVTKRYHLAGLPADTIHIKLSGSAGQSLGAFLCPGITLELEGDSNDYVGKGLSGGKIVVYPPKGSKFDPKENIVIGNVALYGATSGEAYFNGMAAERFCVRNSGAKAVVEGVGDHGCEYMTGGTVVVLGKTGRNFAAGMSGGVAYVLDLHSTFHSHCNPELVDLDKVEEEEDIMTLKMMIQQHQRNTNSQLAKEVLADFDNLLPRFIKVFPRDYKRVLASMKKEEAYEAAKERAIKEAEEQEEEELKEKDAFEELKKLAAASKDESSQVEEEQTLKRPIQVAEAVKHRGFVAYERQGVSYRDPNVRMEDWKEVMEESKPGPLLTTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPSERTGRRVAIVGSGPSGLAAADQLNRLGHTVTVFERADRIGGLMMYGVPNMKTDKIDVVQRRVDLMEKEGVKFVVNANIGNDPAYSLDSLREDHDAIILAVGATKPRDLPVPGRELSGVHFAMEFLHANTKSLLDSNLQDGKYISAKGKKVVVIGGGDTGTDCIGTSIRHGCTSVVNLELLPQPPNTRAPGNPWPQWPRIFRVDYGHQEAAAKFGKDPRSYEVLTKRFIGDENGNVKGLEVIRVQWEKDASGRFQFKEVEGSEEIIGADLVMLAMGFLGPESTIADKLGLEKDNRSNFKADYGRFSTSVEGVFAAGDCRRGQSLVVWAISEGRQAAAQVDKFLMKDDEDSSADAASQQESVKKQPTVVT

SEQ ID NO: 1016 - protein, 778 aa, Solanum lycopersicum
MGIAKTGQGSCWLLVYMVFLLFNLSDEFLEPSQSEAIVKIKQLLNFPQDLSSWSDNTDFCNSEPNTALTLMCYEDNITQLHISGYNWFPNLPQGFSTDTLFSNLALLPNLKVLSLVSLGLRGTLPKKIGFLSSLEIVNISSNFFYGEIPGQISYLKSLQTLILDNNEFTGQVPEGVGLLHSLSVLSIKNNSFSGSLPNSLSNLQTLRILSISGNNFSGVVPNLHNLSNLQVLDLESNNLGPNFPNIPTKLVSLVLRKNKFSLGVPKELSSCYQLKKLDISSNEFVGPFSPTILSLPSLSYFDISGNKLTGKLLKNVTCSQDLSFVNLSSNYLTGELPDCLHPSSGSKIVLFSGNCLSNKEQWQHPYSFCHNEALAVSIEPHKRKVKGGNGKAVLASSMVGGFVGVVAIVGLAFVVVRREYVKQKASKAPQTRLILEKVSPAHTLKLLNDARYLSETRKLGLLGAPPYRTFVLDELREATNNFDISNLIGASSSGQIYKGRLTDGTVVAIRSIKMKRRHTVQSYTHQLGRISKIRYSHLVSTIGHCFECYQDDSSVSRICLVFEFVPNVTLRGVISEANSAQKFTWTQRMSAAIGIAKGIQFLHTGIVPGIFSNQLKITDVLLDQNFHVKISKYNLPLLIENKKMDAGPSSSGSKGNDGQRLKYEEKDDVYDFGVILLEIISGRTIDTKNDIDVSKDILIVSLTADEIARRNIIDPAVRKECSDSSLRTLMELCIKCLSDEPSQRPSVEDLIWNLQFAAQVQDPWNRDTYGNQESPGHV

SEQ ID NO: 1017 - protein, 477 aa, Solanum lycopersicum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQRHGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 1018 - protein, 68 aa, Phaseolus vulgaris
MAGLLGFRSLPPKAKNLVVAGSLTAFVFGAYFYTMRAVGGTDELQVAIDKFESHKTKNEGESNMSSKV

SEQ ID NO: 1019 - protein, 96 aa, Phaseolus vulgaris
MSLRRFFGFSDGEVMRSDAKPCSRLMRHTAGIYSVGGALGFWILCRLHYGPRITNPRSLRWAACGAVTVSSSTALLVRLFSPECEPQNIAAYDNKK

SEQ ID NO: 1020 - protein, 282 aa, Phaseolus vulgaris
MACRGCWECLLKLLNFILNLTGLAIVGYGIYLLVEFSKASDDDTPDISPVSDDSALIQLGRPILMAVSLSNSFFDNLPRAWFIYLFIGIGVVLFLISCFGCIGAATRNGCCLSCYSTLVVLLILIELGCAGFIFFDKNWKEEIPTDKTGDFDAIYEFLSENWNIVKWVALGIVIFEALLFLLALIVRAANRPAEYDSDEEFINPRQQVRQPLLNRPAAGPSAGLPASGTTDQRSSRNDAWSTRMREKYGLDTSEFTYNPSESSRFQQVNSQIAEEKSRCTIM

SEQ ID NO: 1021 - protein, 481 aa, Glycine max
MPVIAAKPNKNPSLYVPKLFLLCTLFSILSLALFLFLIFPTATTTTTLHPSLSPFSSSTINVYVADLPRSLNYALLHTYWSSFSDSRLPTDADHTTPPSSLHQTAKIPPYPENPLIKQYSAEYWITGDLMTPPQHRATSFAKRVLDPLLADVVFVPFFATLSAEMQLGANKGAFRKKHDNDDYKRQRQVMDAVKNTHAWNRSGGRDHVFVLTDPVAMWHVKDEIAPAVLLVVDFGGWYRLDSRGGSNCSESDVIPHTQVSVIKDVIVPYTHLLPRLDLSDNKERHQLLYFKGAKHRHRGGIIREKLWDLLVSEPGVIMEEGFPNATGREQSIKGMQTSEFCLHPAGDTPTSCRLFDAIQSLCIPVIVSDNIELPFEGMVDYAEFSVFAAVSDALKPSWLVSHLQSFSKEQKDRFRQNMARVQPIFVYDNGHPGGIGPIPADGAVNHIWKKVHQKLPMIKEAIIRERRKPPGVSVPRRCHCT

SEQ ID NO: 1022 - protein, 16 aa, Zea mays
MAKYNVVQKNKRQCNQ

SEQ ID NO: 1023 - protein, 16 aa, Zea mays
MKALASPAASFLPGIP

SEQ ID NO: 1024 - protein, 16 aa, Zea mays
MKHLHLSSSLPLLLHR

SEQ ID NO: 1025 - protein, 16 aa, Sorghum bicolor
MASATTSISSHPAALR

SEQ ID NO: 1026 - protein, 16 aa, Sorghum bicolor
MEAFLAGLFRAPPRAV

SEQ ID NO: 1027 - protein, 16 aa, Sorghum bicolor
MDKSMLGDLDGLPEED

SEQ ID NO: 1028 - protein, 16 aa, Zea mays
MESAMEKVWESGRRMS

SEQ ID NO: 1029 - protein, 394 aa, Gossypium hirsutum
MSSSPLFSMSTMKRDSFVMKTITSNKEFKFNVSNSFDKLPVTSPTLLLTGENSLKWGQNESLLRNRMQCCAVEVKNMPGYPMGKKFELDDVIEAQQFDRETLNAIFEVAKEMENIKKNSPGSQILKGYLMATLFYEPSTRTRLSFESAMKRLGGEVLTTENAREFSSAAKGETLEDTIRTVEGYSDIIVMRHFESGAAKRAAATAGIPIINAGDGPGQHPTQALLDVYTIEREIGKLDGIRVGLVGDLANGRTVRSLAYLLAEYQDVKIYFVSPDVVKMKDDIKKYLTRRGVEWEESGDLMEVASKCDVVYQTRIQRERFGERIDLYEEARGKYIVDENVLKVMQSHAVVMHPLPRLDEITVDVDADPRAAYFRQAKNGLYIRMALLKLLLVGW

SEQ ID NO: 1030 - protein, 160 aa, Arabidopsis thaliana
MSAKKIVLKSSDGESFEVEEAVALESQTIAHMVEDDCVDNGVPLPNVTSKILAKVIEYCKRHVEAAASKAEAVEGAATSDDDLKAWDADFMKIDQATLFELILAANYLNIKNLLDLTCQTVADMIKGKTPEEIRTTFNIKNDFTPEEEEEVRRENQWAFE

SEQ ID NO: 1031 - protein, 258 aa, Glycine max
MAISHETWAFIFGLLGNVISFMVFLAPLPTFYQIYKKKSSEGFQSLPYVVALFSSMLWIYYALVKKDASLLLITINSFGCVIETIYLAIFLVYAPSKTRLWTIKLLLMLNVFGFGGMLLSTLYLTTGSKRLSVIGWICLVFNISVFAAPLCIMKRVIKTRSVEFMPFSLSLSLTINAVMWFFYGLLLKDYYIALPNTLGFLFGIIQMVLYLVYRNAKPQTLEEPTKVQELNGHIIDVVKPNHATKNGHVPVIEIASSV

SEQ ID NO: 1032 - protein, 224 aa, Medicago truncatula
MVFWVFGYGSLVWNPGFDYDEKMLGFIKDYRRVFDLACIDHRGTPENPARTCTLEEKEGEICWGVAYCVRGGPEKEKLAMQYLERRECEYDQKTLVNFYKEGDSLHPALTGVIVFTSTPDKENNIYYLGPAPLEDMARQIATANGPCGNNRDYLFLLEKAMHNLGHEDDLVIELANEVRKVLGVVNVVLNEKKLVGPTQLPHQPHVPIPSLQLHPLPEPIALDS

SEQ ID NO: 1033 - protein, 542 aa, Brachypodium distachyon
MADTETPFLQQLTAGDTDEDEDPPPLAGVSDFRGRPVRRASSGGWRSALFVVVVEIAGSFAYFGVSANLITYLTGPLGQSNAAAAAAVNAWTGTGTLMPLLGAFVADSWLGRYRSIILACTLYVLGYGMITLASTLPALRPPPAGDPSPTQVAFFYGSLYLIAVAQGADKPCGVAFAADQFDPGHPGERAARGSLFNWWYFSMAAGITVAVAVMSYVQENVGWGVGFGAPCFVMLAAFAAFLAGSPTYRLLHTPDDAAKTSSSPFARLARSLLAAIKTKKKHQQQLEVEDESSEAARSVLRLMPIWAACLAYGVVNAQIMTLFNKQGRTLDRRVRIFDDLELPPAALQALGPATILLFVPIYDRLLVPALRPGALTPLRRVGTGMALSALTVCVAALVEARRLDTARQHGLVTVHAGGSTATVPMSWAWLVPQYVTIGVADVFAVVGMQEFFYDQMPGELRSLGLAMYLSVMGIGGFISSAMISVIDRVTSSGGGDSWFADDLNRGHLDYFYWLLAGLSAAELVMYLCLARSYVYSNRRLLR

SEQ ID NO: 1034 - protein, 534 aa, Sorghum bicolor
MCHRSELLSLVLYQPAMVDTVAGATDYRGQPASRAATGGWKPSVFVMAMEIAERFAYKGVAANLITYLTGPLGQPMARAAASIDAWKGVSQMLPLPLACVADAWLGRYRAIVLASLIFVVSMGSLSLSAALPALRGGHVAIFYVALYLVALGEGAHKPCAQAFAADQYDEKDPKESVARSSFFNWWYFGMCAGTAVTTMVSSYVQDNVGWGLGFGIPCIVIVASLALFLLGTRSYRFYTTTEASPFSRVGNALLALIHSWAPKHRTRKLGDGDEDNAVAVEEVKSVLRLLPIWASCIIYAIIFSQTSTFFTKQAATLDRRIGARFKVPPAALQTFISVSIVVFIPVYDRLFVPLARRYTGRPTGITMLQRVGAGLALSLVAVALSALVEMKRLRVATEAGLVNTPKAQLPMTLWWMVPQYILIGVADVFAMIGLQEFFYDQVPDAVRSLGLALFLSIFGVGHLLSSLLISVIDKTTARSGTSWFSNNLNRAHLDYFYWLLTGLCAVELVAFVLFSRVYAYKRKSGNDGGSGDLV

SEQ ID NO: 1035 - protein, 531 aa, Panicum virgatum
MSMDPADRMLADPLLLPLPAAAKQVLAGVTDYRGRPVTRGASGGWRSALFVVAVEIAGSFAYFGISANLITYLTGPLGQSNASAAAAVNAWSGTASLMPLLGAFLADAYLGRYRSIILACSLYVLGFGMLTLSSTVPPLRPAASSHLPSGSSRPPPQALQVAFFYVSLYLIALAQGADKPCGLAFAADQFDANHPAERASRASLFNWWFFCMAIGISVAVSVVGYIQDNVGWGVGFGVPCAIVLAAFAVFLMGTPTYRLYQHKKKQPPKEEEEEEQQQQQNKAMASSALRRLLPIWATSLAYGVVYAQIMTLFNKQGRTLDRRIVGAIQLPPAALQTLGPASILLFVPVYDCAIVPALRWATGNPSGLTMLQRVGAGMATSLAAVSVAALVEARRLATAREHGLVDQPGVTVPMTWAWMVPQYAMMGVADVLAVVGLQELFYDQMPDGLRSLGLALYLSVMGIGGFISSLLISIIDGITSRGGRDSWFADNLNRAHLDYFYWLLAGISALELVLYLGFARSYVYNHQHLAT

SEQ ID NO: 1036 - protein, 386 aa, Zea mays
MAAASLLEATRFLSTPHPRSRSRPLPFPPGSGLHPHLLRTPRLSTLRVHLHRPAPLGAQEPARPGALLAVDALRRSVLDSLAALKRPALALLLAGVLLAAASAGGPHAAALAASGGRVGGSAFSSRSSSPRSYGYSAPAPRGGYTAAPFYSPSPFVSVGPALGIGFGGSGFLVTLMGFAAFLYLAGFLSDSSGATSVLTETEKTTVLKLQVGLLGMARSFQKELDQIAEKADTSTPAGLSYVLTETTLALLRHPDCCISAYSSVDVKRSIDNGEKRFNQLSIEERGKFDEETLVNVNSIKRNKGGSQRSSGFSNEYIVITILVAAEGVHKVPVINSSNDLKTALQKMGAIPSRKILAVEVLWTPQNENDTLSERELLEDYPLLRPL

SEQ ID NO: 1037 - protein, 465 aa, Glycine max
MSSTTMLLLVVFMILCISCPSFQMVLFASNTHSFPNPIQQHPPPPQIYLNPFRQTVPPPTLPPTLPGQRLHSLLQPGPTGPSPAHNTLHGHRQRLSLGKPNASPPVNTTRSVAVSCKSPACSAAHNLASPSDLCAAARCPLESIETSDCANFKCPPFYYAYGDGSLIARLYRDTLSLSSLFLRNFTFGCAYTTLAEPTGVAGFGRGLLSLPAQLATLSPQLGNRFSYCLVSHSFDSERVRKPSPLILGRYEEEEEEEKVGGGVAEFVYTPMLENPKHPYFYTVGLIGISVGKRIVPAPEMLRRVNNRGDGGVVVDSGTTFTMLPAGFYNSVVDEFDRGVGRVNERARKIEEKTGLAPCYYLNSVAEVPVLTLRFAGGNSSVVLPRKNYFYEFLDGRDAAKGKRRVGCLMLMNGGDEAELSGGPGATLGNYQQQGFEVEYDLEEKRVGFARRQCASLWERLNRDKN

SEQ ID NO: 1038 - protein, 434 aa, Brassica juncea
TGEFTNYQNGVNNPTSRFTAYSDGGNGKAQSFKTYTHEANAGNGQSFTSYGKNGNGVPNEFASYGVSANVIGSGFSNYGEKGNAANDSFTSYGSDGNVPQNNFKNYGASGNAASDTFANYRDKSNVGDDSFSSYAKDSNSGTAKFTNYGQSFNPGSETFTGYGKGAEGHKISFKTYTPNSTFKDYAKNGVGFAKYNVSSTSATLGDGKTVNKWIEPGKFFREASLKEGTVIPMPDIKDKMPKRSFLPRSIISKLPFSTSKLAEINKIFHAGENSTMEKIISDAVTECERSPSVGETKRCVGSAEDMIDFATSVLGRSVVLRTTENVAGSKQKVVIGKVNGINGGKVTKAVSCHQSLYPYLMYYCHSVPKVRVYEADLLDLKSKTKINHGIAICHMDTSSWGPKHGAFLALGSKPGLIEVCHWIFENDMNWAIAD

SEQ ID NO: 1039 - protein, 194 aa, Brassica juncea
ARGNVALSVLMTAASTLSAVIMTPLLTAKLAKQYVAVDALGLVKSTLQVVLLPVLAGAFMNQYFQRLVKFVSPLMAPIAVGTVAILCGTAIGQNASAILASGKQVVMACVLLHLSGFLFGYLFSRLLRIDVASSRTVSIEVGMQNSVLGLVLAAEHFGNPLTAVPCAVSSVCHSIIGSVLAGVWRRSAPKQLED

SEQ ID NO: 1040 - protein, 137 aa, Brassica rapa
MGCICLINLTGTNIYRPVLTRTSNKPYITRGPSMAAIRAESVATEKLGIFVEKNPPESKLTQLGVRSWPKWGCPPSKFPWTYDAKETCFLLEGKVKVYPDGSDEGVEIEAGDFVVFPKGMSCTWDVSVAVDKHYQFE

SEQ ID NO: 1041 - protein, 325 aa, Phaseolus vulgaris
MKAVVITTPGGPEVLQLQEVEDPQLQDNEVLIGVHATALNRADTLQRKGFHPPPKGASPYLGLECSGTVLSVGKNVSNWKIGDQVCALLAGGGYAEKVAITAGQVLPIPPGVSLTDAASFPEVACTVWSTVFMTSRLSQGETLLIHGGSSGIGTFAIQIAKYRGARVFVTAGNEEKLAFCKSIGADVAINYKTEDFVARVKEETGGQGVDVILDCVGASYYQKNIDSLNLDGRLFIIGFQGGVTTQVDLRPLLAKRLTVQGAGLRNRSVESKALIISEVEKNVWPAIAEGKVKPVVYKSFPLAEAAEAHQLMESSEHFGKILLVP

SEQ ID NO: 1042 - protein, 1219 aa, Phaseolus vulgaris
ITLFHKQVGLADKINSIVRTLSGGMKRKLSLGIALIGNSKVIILDEPTSGMDPYSMRLTWQLIKKIKKGRIILLTTHSMDEADELGDRIAIMANGSLKCCGSSLFLKHHYGVGYTLTLVKSAPTASIASDIVYRHVPSATCVSEVGTEISFRLPMTSSSAFERMFREIEGCMKKPVLNMELSGNGEKENLGIESYGISVTTLEEVFLRVAGCDDDEVECFEENKHSLISDSVASLPTNDDPSTKISYLKTFGNYKRILGFMATMLGRACRLIFATFLSFISFLGMQCCSCCLITRSTFWQHFKALFIKRAISARRDHKTIIFQLIIPTLFLFVGLLFLKLKPHPDQQSLTLSTSHFNPLLSGGGGGGPIPFNLSFPITEKVAQNIMGGWIQKLKSSSYRFPNSEKELADAVEVAGPTLGPALLSMSEYLMSSFNESYQSRYGAIVMDDQSNDGSLGYTVLHNCSCQHAAPTFINLMNSAILRLATQDTNMTIRTRNHPLPTTQSQRLQRHDLDAFSAAVIVNIAFSFIPASFAVSIVKEREVKAKQQQLISGVSILSYWASTYIWDFVGFLFPASFAIVLFYIFGLEQFVGGVSLLPTILMLLEYGLAIASSTYCLTFFFFDHTMAQNVVLLIHFFTGLILMVISFIMGLMTSTMSTNSFLKNFFRISPGFCFADGLASLALLRQGMKDKTSDGVFDWNVTGASICYLAVESFSYFLLTLALEILPSINLTSFMVKKWWEKINIFRHDSPYLEPLLEPSSETVVMDFDEDVDVNTERNRVLSGSLDNSIIYLRNLRKVYFEEKHHGRKVAVDSLTFSVQEGECFGFLGTNGAGKTTTLSMLCGEESPSDGTAFIFGKDICSHPKAARRYIGYCPQFDALLEYLTVQEHLELYARIKGVPDFAMENVVMEKLAEFDLLKHANKPSFSLSGGNKRKLSVAIAMIGDPPIVILDEPSTGMDPIAKRFMWDVISRISTRRGKTAVILTTHSMNEAQALCTRIGIMVGGQLRCIGSPQHLKTRFGNHLELEVKPTEVSSVDLQTLCQAIQERLLEVPSHPRSLLNDLEICIGGTDSVTSAGNTSIAEISLTREMISLIGHWLGNEERVKTLISCTPVCDGASLEQLSEQLFRGGGIPLPVFSEWWLSKQKFSEIDSFILSSFRGARCQGCNGLSIRYQLPYNEDFSLADVFGLLERNRNTLGIAEYSISQSTLETIFNHFAANP

SEQ ID NO: 1043 - protein, 206 aa, Phaseolus vulgaris
MDSVCASSPPFQTGPSGHPRHFYLAVDRLHFKMQTVIELVDLVARRPSLPIVVCCSTRDDLDSLCSSLSALPFVSSSALYSDLAEDERAFLLEKFRQVTAQWNQRRVAITAGDEIGKDERSHMIIVTDACLPLLSSGELPLNAHLLINYELPAKKETYTRRLTTCLTADGIVINMVVGGEVVTLKSIEESSNIVMQEMPMRILDIL

SEQ ID NO: 1044 - protein, 166 aa, Phaseolus vulgaris
MAASVFNTPSFTLFVFLSLQLYLSFSSSSSPSIHDLLRSKGLPPGLLPEEVKSYTFSRPNGHLEVFLDAPCMTKYENRVLFEQVFTANLTYGSLIGVEGLQQEELFVWLPVKDIIVNDPSSGLILFDIGLAHKQFSLSLFEDPPHCKPEGGLRNHVRKEKGLEVLR

SEQ ID NO: 1045 - protein, 116 aa, Phaseolus vulgaris
MASDETQNKVIEPSSSDLLASAKLVANAAQSTLRNESDKVDKTKVAITAGDLLDAAGKYGKLDDQKGVGQYVDKAADYLHQYQDKAAAPSQPADSKPEESGGLGGLANLAGGFFKK

SEQ ID NO: 1046 - protein, 729 aa, Phaseolus vulgaris
MELKVLTQMQVTLLLLLIVLTRTGTAADDQDLLGCPNKCGDVSIPYPFGVGNVEVQNITLVGQMEMNFFVSSICKINISNGKNKSNTPTLQTASFTISSTDNKFVSIGCDTYGYLNSYVDQAKYSTGCLTRCDKNDPNVKNMQRNDGKCSGIGCCQVDIPPGMKNISIQASSFDDFKSFSGNSCSVSFVVKNGGYSFKMDHLKHIPFDKAPMVVDWTVGDGACNVSKNNDNYACTSNHSVCEDPPYANRNGYQCKCKQGFVGNPYLRTGCTDFLECTTGNHNCARDEYCHDIPGSFECLCPVGLTGKATNGGGGCQPKKEDDAFTKIVIGSGVGLIALFVGVSWLYLMHQKRRLLKLKEKFFQQNGGIILRQKLSARGETSQSATIFSVEELKKATNNFDESLIIGRGGFGTVFKGVLLNNEVVAIKKSKIMDSSQVEQFINEVIILSQINHRNVVKLFGCCLETEVPLLVYEFVENGTLFDYLHKQGQVPNVSWKTRLRIATEAAGALSYLHSEASIPIIHRDVKTANILLDESNTAKVSDFGASRLVPLDQTEIATIVQGTFGYLDPEYMQSGQLTEKSDVYSFGVVLVELLSGEEPFSSHKTEEKRSLTFHFLSSLEKDSLIDVLENDILDEENKQEIMEVAILAARCLKLRGEERPSMKEVTMELEGIRHMDKHPWTNTSQDFEESQYLLSEPQSTPEHGYSSGQQSTGFDSLRELELINFGNGR

SEQ ID NO: 1047 - protein, 414 aa, Phaseolus vulgaris
MKVLNGKGKYAQGNLNLLKSVVILLPFTLLILMLPFSLTINSSFSSPNEVYVSRSSYDFNVTEIKRCNVFSGEWVPYSKGAYYDNETCDLIIDQQNCMKFGRPDREFLKWRWKPDECELPLFDATLFLEIVRGKSMAFVGDSVGRNQMNSLLCLLNPVARPEDISSRYATDPIYFRRWFYADYNFTVVTLWSPFLVRSSDVHSSLTNLYLDKADESWSGEVKNFDFVIISAGQWFFRTALFYEKGQVVGCHKCEQRNITELSHYYGYRKAFRTALRTIVKMKGYKGVTFLRTFSPAHFENSEWNKGGSCERRKPYGKEEMKFDGYIFETYKVQVEEFRGARREGRKRGLKFLMLNTTEMMLRRPDGHPNNHVWGHEMKNTHSDCVHWCLPGPIDTWNELLFYQLKTHHKSFISS

SEQ ID NO: 1048 - protein, 283 aa, Phaseolus vulgaris
VAVIPGFMSCTCDHVGGCTAPGSRSSGEIAPVHFFGVYDGHGGSQVAKFCAKRMHDVIAEEWNREMADGAEWQRRWETVFANSFERTDNEILSDAVAPEMVGSTASVVVLSGCQIIASNCGDSRVVLCRRTQTIPLSVDQKPDRQDEFLRIEGEGGKVINWNGARVFGVLAMSRAIGDRYLRPWIIPVPEITFTARTDEDECLVLASDGLWDVMSNEEVGEVARHILRRRRRSLSGEETSPAQVVADSLTEIAYGRNSKDNISIIVVDLKSKRKRQQRPPLIS

SEQ ID NO: 1049 - protein, 393 aa, Phaseolus vulgaris
MKKQQTQKSEFEFCKACGINHDQGLRHKYFPNHKKSLSTFLSRFRKKLSDVRFFLNAPIPLNPQLASRNRFWCVFCDQDIHEHSSSFACANAIRHLASALHLKNLKHFFWKYGAAADQLDAFMFSDDDVTKGEKKCVARKDEANEGSRRTVVGPSSDDHIHNQLTSGNSNSFETNVYSHSVKSYPSNPVLPLPNYTNEYQISSSGLSGIANVATSSEARPDAKPIVFQDFLVERRSHSFPHDGRQSSSNGYSCDKQISSMPIESAEKKVYSEAPPPWIDTTEAVQMHSSSNKLGKSKMLNPNRVGAAWVEKRKIEMEKEKRGETIRNGRDASWLPNFGRVWQSGSRRESRKEFEREKQLQKLNVETESEMAIKIQPYVSKRMRMDSVGDNASG

SEQ ID NO: 1050 - protein, 324 aa, Phaseolus vulgaris
MPPVPISPVKVGHIDDVQELRKTKPRTIPQRFVRDMTERPTLSTTPLPPSNTHMPVIDFSKFTNGNKEEVLSEIFNLATACEEWGFFQVINHEIDLNLVERIENLSREFFMLPLEEKQKYPMAPGTVQGYGQAFVFSEDQKLDWCNMFALGLEPEYVRNPNLWPKRPERFRKLCYNLLKYIALGLDLKGDVFEKMFALTVLQQAKGGPVGLQILKDNTWVPIQPIPNALVINIGDTIEVLTNGKYRSVEHRAVAHEEKDRLSIVTFFAPSYDVELGPMPEFVDENHPCKYRTYNHGEYSKHYVTNKLQGKKTLDFAKIQTKNTN

SEQ ID NO: 1051 - protein, 380 aa, Phaseolus vulgaris
MTEHGVGPDLVTHNIILSAFKSGAQYLKALSYFELMKGTHIRPDTTTLNIIIHCLVKLQQYDKAIDIFNSMREKKSECTPDVVTFTSIIHLYSVCGQVDNCEAAFNMMLAEGLKPNIVSYNALIGAYAACGMDNEALLVFNEIKGNGFRPDVVSYTSLLNAYGRSQKPQKAREIFDMMKTNKLKPNLVSYNSLIDAYGSSGFLTDAIEVLREMEQDGIQPNVVSICTLLAACGRCSRKVKIDTVLTAAKMRGIKLNTVAYNSAIGSYMNVGEYDKAINLYKSMRKKKIKTNSVTYTVLISGCCKMSKYGEALSFMKEMMHLKLPLTKELYSSVICAYSKQGQIEEAESTFNLMKSSGCYPDVVTYTSMLDAYSAAGKIIF

SEQ ID NO: 1052 - protein, 470 aa, Brassica napus
MALAINVSSASSSVISTSSFPSSELKVSAPRIGSLRLSDRVNVSTASLSLSGKQSSSVKPLNVQSVAKESFVPSQAASMVTSEVTEKLDVVEVEDFEELAKSLETASPLEIMDKALEKFGNDIAIAFSGAEDVALIEYAHLTGRPFRVFSLDTGRLNPETYRLFDTVEKHYGIRIEYMFPDAVEVQALVRNKGLFSFYEDGHQECCRIRKVRPLRRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKENSNANAAANVNGTSSTVADIFKSENVVSLSRQGIENLMKLGNRKEAWIVVLYAPWCPFCQAMEGSFDELADKLGGSGVKVAKFRADGDQKEFAKRELQLGSFPTILVFPKNSSRPIKYPSEKRDVDSLTSFLNLVR

SEQ ID NO: 1053 - protein, 424 aa, Gossypium hirsutum
SPRTSRAPTHPASSEPSTNSTYLRGAPVPRPPSAPASKPSGNDTVPNTSAPSPSGSNPSIPDSKSSHQAAILVGSIGGGTFLLILIIIAYLLKTYKVSTVKPWATGLSGQLQKAFVTGVPKLKRSELEAACEDFSNVIGSTTIGTVFKGTLSNGVEIAVVSVPVESTKDWSKNLETQFRKKIDTLSKVNHKNFVNLLGYCEEDNPFTRMLVFEYAPNGTLFEHLHFKESEHLDWAMRLRIIMGMAYCLEHMHQLNPPVPHNNLSSSAVSLTEDYAAKISDPCFWNELTASDREGDRINLSDTTMASLESNVYTFGVLLFEIVTGRMPYLVDNGSSEDMASDYLRREQALVEMVDPTLNSFDKDQFDLIGEVIKSCIDPEPGHRPDMRGVSARLREITAITPDNAIPKLSPLWWAELEIMSSEAS

SEQ ID NO: 1054 - protein, 404 aa, Medicago truncatula
MACCDWNVLKESVSGLNEKAESGRRFEDAEEYAMVLFCVNRISHHFRDCELLHFGVGFRFHSFHLSFPRSLKPCLPGNAISVTNRSNENKCYSSKYSGGAGEIPLLFDSSFSQQEDDREIISDGISAVAGGIVALGKFDALHIGHRELAIQASRAGPPFLLSFVGMAKVFGWEHRAPIVAKCDRKRVLSSWFPYCGNMVPEEFEIEFSSVRHLSPRQFVEKLAKELRVRGVVAGENYRFGYKAAGDASELQKLCEEYEMEAYIIKSVMDKNQYSTNINSSIGSKERGQVSSTRVREALAVGDMRYVSELLGRQHRLVLMATDRETFSFSQYKVSAPKSCLLNLAPKEGLYEKCSLLLGQENVMLCRVIIDSKFVHIETDYGGSSDIFGTHDLQYLLIEFGDSST

SEQ ID NO: 1055 - protein, 146 aa, Solanum lycopersicum
MPMRPTGGLKQDWDPIVLQKPKMKAQDLKDPKIVNQALRAGAQVQTVKKFDAGLNKKAATLAVNVRKLDEAAEPAALEKLPVGVRQAIQKARIEKKMSQADLAKKINERTQVVAEYENGKAVPNQLVLGKMENVLGVKLRGKIHKS

SEQ ID NO: 1056 - protein, 417 aa, Solanum lycopersicum
MASLLQFLPLFPFFFLVSFCVSHGPFLPKAIILPVNKDPSTFQYVTQLYMGVTHLAPIKLVVDLEGSFLWADCGLTSDSSSQKLVPCNSLKCSMAKPNGCTNDNKICGLKSENPFTRLAATGELAEDMFAVEFIDELKTGSVASIHQFLFSCTSSTLLQGLARGAKGMLGLGNSRIALPSQLSDTFGFQRKFAICLSSSNGAIISGESPYLSLLSHDVSRSMLYTPLISSRNGVSEEYYINVKSLKINGKKLSLNTTLLTMDGEGQGGTRISTISPFTTMKTSIYKTFVEAYERFGFSMGLTKVEPIAPFGLCFSTKVEEGLNVPSIDLVLQSEMVKWRIYESNSMVKVSDEVMCLGFLDGGANQKASIVIGGHQLEDNLLEFNLGTSMLGFTSSLSMVETSCSDFMFSKDSSPFDS

SEQ ID NO: 1057 - protein, 326 aa, Solanum lycopersicum
MASFFCSTKFLLLLFFLSAIPIAFIIHLETSSPTTHVYHYHSTGWLRECSKWDDANRRFIVSFFEGGLGVIPVEADYSPGDVLQEMPVVKDADLTGNASLGFTIDRERNRVLVAVADVLGNRYSALAAYDLTSWNRVFLTKLSGPEDEKAFADDVVVDTEGNAYITDAKADKIWKVGANGELKYTIKNSIFTPKEWYNKLVGLNGIVYHPNGYLLVAHTFSGNLFKIEIAKGDKVKLVKIDNGSLKFGDGMELLSPTKLVVAGNPTRLVESSDDWESGTIVGKAKGAIHRLSTAATVKEGTVYLNHMIGLGYPRKKHVLVEAVFSA

SEQ ID NO: 1058 - protein, 482 aa, Solanum lycopersicum
MPGPTMESEFPVEPQSLKKLSFKSLKRSLDLFSPIHGHFPLPDPESKKVRTSYKLNVEYGGIKGSAAEPNAKAGVQHQAQPASAPSNTLALPGPENTRDEKTGNELALGPSIPANGPTDVRFSGKSNAVVPSHGSSERNLSTAAIMERIPSRWPRPIWRAPWKNYRVISGHLGWVRSVAVDPSNTWFCTGSADRTIKIWDLASGRLKLTLTGHIEQVRGLAVSNKHTYMFSAGDDKLVKCWDLEQNKVIRSYHGHLSGVYCLALHPTIDILFTGGRDSVCRVWDIRSKMQIHALSGHDNTVCSVFTRPMDPQVITGSHDSTIKFWDLRYGKTMATLTHHKKSVRAMAQHPTEDCFASASADNIKKFSLPKGEFMHNMLSQQKTIVNAMAINNDGVMVTGGDNGSMWFWDWKSGHNFQQSQTIVQPGSLDSEAGIYALTYDVTGSRLISCEADKTIKMWKEDETATPETHPLHFKPPKDIRRF

SEQ ID NO: 1059 - protein, 576 aa, Solanum lycopersicum
MATPLKNTNRLSLAMERTGQWVFSQEIPTDVIVEVGEANFNLHKFMLVAKSNYIRKLILDTKESDVSRINLSDIPGGPEMFEKAAKFCYGVNFEITVHNVAALRCAAEYLQMTDKYCDNNLASRTEDFLAQVALTSLSGALVVLKSCENLLPLAHDLNIIQRCVDIAGAKACVEANFPSRSPPNWWTEELTILDVAFFERIIVAMKTRGAKALTIASAIITYTERSLRDLVRDHSGNNTRLMVPEDSDMRMHQRELLESIVTLLPAERAAFPINFLCCLLRTAIFLRAASSCKNELEKRISAILEHVTVDDLLVLSFSYDGERLFDLESVRRIISGFMEKEKSVAVFKGGDFGDVCTTAMQRVAKTVDAYLGEIATFGDLSISKFNGIAILVPKGARKADDDLYRAVDIYLKAHPHLDEIEREKVCSVMDPLKLSHEARVHASQNKRLPVQIVLHALYFDQLKIRSGAADDTNNNMPEAMATRNQLQADVSLVKENEVLRTELLKMKMYIADIQKTTNSSQGTSKGSLKKTTFFSSVSKTLGKFNPFKHGSKDTSNIVDDAALDLTKPRRRRFSIS

SEQ ID NO: 1060 - protein, 786 aa, Solanum lycopersicum
MRSVRMDSIGPPTKRLVELNRHSIQDGQNGVRDGITGDGQGLSEEDESRINEDVEGGNETQRDLLQVQAVLQTQQQQPPGPLVRWERFLPLRSLKVLLVENDDSTRHVVSALLRNCSYEVIAVGYALEAWRILEDLTNHVDLVLTEVAMPFLSGVGLLSKIMNHKTLKNVPVIMMSANDSMGIVFKCLSKGAVDFLVKPIRKNELKNLWQHVWRKCHSSSGSGSESGIQTQKSTKSKSVEMSGNNTDSNDEAENGSFDLDDRDGSDNGSGTQSSWSKRAIEVDSPQPMSPWNELADPPDSTCAQVIHSRPEALSATWVPANATRRCLNEKDELGNVRTVKDLNMGVANVPELEGLSGKVMDGLAASMKDKHLELDPKDNENMGRNLKLNKETREDDLKDKDVGYMGDITNTCTPQVESTANEVPNDPSKITNIKEIATYDSKDMPSLELSLKQLRDVGENGTGVQERNILRHSDLSAFSRHVIHLYNAASTANQAPTGNVGSCSPVNNSSEVAKAESIHNLQSKSSSTPNQRSNGSSNNNDMGSSTNNFFIKPDTLIDKPINKPAVNAHSCSAFQPVQHGHTSSLQAMVPGTQDTAKAAVGQARAMHQKFQVQHHHHHYHHHHHHVLSLQQRQQLLNADASSLRNAVETAPDCGTSDMVGTPVEGNAANYGSASGSNNGSNGQNGSSGQNGSSTAVVAEGTNLVAENETGEKCEIGSGSGSATRSGDHSAQREAALIKFRQKRKERCFEKKVRYQSRKRLAEQRPRMRGQFVRQDADKSKSNNTNS

SEQ ID NO: 1061 - protein, 326 aa, Solanum lycopersicum
MAISTSFCRPISSFNALSSPSLCYFKPLYNHLKLDPSLPLVKCCSSHIGQSPEHINGRQPDLSPIASFGVTMTNNGTSKPSYRWRRVLLKVSGEALAGDQAQNIDPKITMAIAREVAAVTRLGIEVAIVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDDNPKHNPNARLQDNLTYHDVISKELSVMDLTAITLCQENNIPVVVFNLNKTGNIAKAIKGERVGTLIGDTWNTEAVVS

SEQ ID NO: 1062 - protein, 123 aa, Solanum lycopersicum
MELLDRIRHTPFGYTRKDVILIGVGVTLLGVGLKSGLEFLGFDPLQAGNVVQLVLVLGLTVGWISTYIFRVSNKEMTYAQQLRDYESKVMEKRLESLTEAELQVLLEQVEEEKTRLTSGEEVK

SEQ ID NO: 1063 - protein, 285 aa, Solanum lycopersicum
MGSGHIFFDPSSCHGNMLFLGSGDPVFRGPRSTMMKMEDSSKRRPFFSSPEDLYDEEYYDEQSPEKKRRLTPEQVHLLEKSFETENKLEPERKTQLAKKLGLQPRQVAVWFQNRRARWKTKQLERDYDQLKSSYDSLLSDFDSVRKDNDKLKSEVVSLMEKLQGKVVAVAGGNEKSDMLEVDAMTTLQVKVKAEDRLSSGSGGSAVVDEHSPQLVDSGDSYFHTDHEEYPGPGGCNVPPPMDGLQSEEDDGSDDHGSCHGYFSNVFVAEEQHHEQGEEPIGWFWS

SEQ ID NO: 1064 - protein, 183 aa, Solanum lycopersicum
MSSFGLVSTQTQRLIASMLLDTIFVEDFIAKSSMRLLQRHGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 1065 - protein, 16 aa, Zea mays
MESAMEKVWESGRRMS

SEQ ID NO: 1066 - protein, 16 aa, Zea mays
MEVVVAAKQKAKKHIH

SEQ ID NO: 1067 - protein, 367 aa, Brassica juncea
MASALNAAVSLTSPKSSALPATSCAIAPERIRFGKGAFYYKSNNVVTSCRRVVSVRAEVTTDTPPVKKVEKESKKNEEGVITNKYRPKEPYTGKVLLNTKITADDAPGETWHMVFSHQGEIPYREGQSVGVIADGIDKNGKPHKVRLYSIASSALGDLGNSETVSLCVKRLVYTNDAGEVVKGVCSNFLCDLKPGSDVKLTGPVGKEMLMPKDPNATVIMLATGTGIAPFRSFLWKMFFEKHDDYKFNGLAWLFLGVPTTSSLLYTEEFDKMKAKAPENFRVDYAISREETNDKGEKMYIQTRMAQYAPELWELLKKDNTFVYMCGLKGMEKGIDDIMVSLAANDGIDWFDYKKQLKKAEQWNVEVY

SEQ ID NO: 1068 - protein, 741 aa, Hordeum vulgare
MASRLLRLHHQLRRRRHHGTSPVPCRLLSSSSATEPPPPPQTVEKVLVANRGEIACRVMRTARRLGIATVAVYSDADRAALHVRAADEAVRLGPPPARESYLNAAAIVDAALRTGAKAIHPGYGFLSESADFAQLCESEGLTFIGPPPSAIRDMGDKSASKRIMGAAGVPLVPGYHGADQDIELLKLEADKIGYPVLIKPTHGGGGKGMRIVQGPDDFVDSVRSAQREAAASFGIDTLLIEKYITQPRHIEVQVFGDKHGNAIHLYERDCSLQRRHQKIIEEAPAPNVTTEFRTHIGEAAVSAAKAVGYYSAGTVEFIVDTLSGEFYFMEMNTRLQVEHPVTEMVVGQDLVEWQIRVANGERLPLSQEQVPLNGHAFEARIYAENVPRGFLPATGTLHHYQPVLSSPTVRVETGVEEGDAVSMHYDPMIAKLVVWGESRNAALVKLKNCLSNFQIAGLPTNVAFLQELAGHNAFERGLVDTHFIERYKDDFQSTSAKASGEAHDAAKLGAILAAACICKKDHSTSEESLRDKTLSVWYTRPPFRMHHSAKRLMEFELDEELEELSDELLKLLVTYKSDGGYFIETEDGSSPGFDVKVDGRSENDFRVEVGGVQTDVTLAFYSKDNSKHIHIWHGKHHHHYRQTVRAEHLLDDSSQPRQASEGRSHPKGSVLAPMAGLVVKVLLKDGVHVEDGQPVMVIEAMKMEHVVKAPRAGYIEGLKATAGQQVFDSSVLFTVKDKSTN

SEQ ID NO: 1069 - protein, 290 aa, Zea mays
MPSPAAAAAAPFHRIACARQHLPQTRLFFLPSRALLKSGCLTVPAPLRVHALRLPPTVPRAASHDAATGVRSPTSGGQMLVFVPPHPLIKHWVSVLRNEQTPCVIFKSAMAELGRLLIYEASRDWLPTITGEIETPVAVASVEFIDPREPVLVIPILRAGLALAELASSVLPATKTYHLGFRRDEETLQPSIYLNNLPDKIPEGTRVLVVDPMLATGGTMVAAIDLLIECGVTSKQIKVISAIASPPALQKLNNKFPGLHVYTGMIDPEVNEKGFIVPGLGDAGDRSFAT

SEQ ID NO: 1070 - protein, 537 aa, Zea mays
MGLSGATISAPLGCCVLRCGAVGGGKALKADAERWRRAGWSRRVGGPKVRCVATEKHDETAAVGAAVGVDFADEEDYRKGGGGELLYVQMQSTKPMESQSKIASKLSPISDENTVLDLVIIGCGPAGLSLASESAKKGLTVGLIGPDLPFTNNYGVWEDEFKDLGLESCIEHVWKDTIVYLDNNKPILIGRSYGRVHRDLLHEELLRRCYESGVTYLNSKVDKIIESPDGHRVVCCDKGREIICRLAIVASGAASGRLLEYEVGGPRVCVQTAYGVEVEVENNPYDPSLMVFMDYRDCFKEEFSHIEQENPTFLYAMPMSSTRVFFEETCLASKDAMSFDLLKKRLMYRLNAMGIRILKVYEEEWSYIPVGGSLPNTDQKNLAFGAAASMVHPATGYSVVRSLSEAPRYASVISDILGNRVPAEYMLGNSQNYSPSMLAWRTLWPQERKRQRSFFLFGLALIIQLNNEGIQTFFEAFFRVPRWMWRGFLGSTLSSVDLILFSFYMFAIAPNQLRMNLVRHLLSDPTGSSMIKTYLTL

SEQ ID NO: 1071 - protein, 527 aa, Solanum lycopersicum
MECVGAQNVGAMAVFTRPRLKPLVGRRVMPRKKQSFWRMSSMKVKCNSSSGSDSCVVDKEDFADEEDYIKAGGSQLVFVQMQQKKDMDQQSKLSDELRQISAGQTVLDLVVIGCGPAGLALAAESAKLGLNVGLVGPDLPFTNNYGVWEDEFKDLGLQACIEHVWRDTIVYLDDDEPILIGRAYGRVSRHFLHEELLKRCVEAGVLYLNSKVDRIVEATNGQSLVECEGDVVIPCRFVTVASGAASGKFLQYELGGPRVSVQTAYGVEVEVDNNPFDPSLMVFMDYRDYVRHDAQSLEAKYPTFLYAMPMSPTRVFFEETCLASKDAMPFDLLKKKLMLRLNTLGVRIKEIYEEEWSYIPVGGSLPNTEQKTLAFGAAASMVHPATGYSVVRSLSEAPKCASVLANILRQHYSKNMLTSSSIPSISTQAWNTLWPQERKRQRSFFLFGLALILQLDIEGIRSFFRAFFRVPKWMWQGFLGSSLSSADLMLFAFYMFIIAPNDMRKGLIRHLLSDPTGATLIRTYLTF

SEQ ID NO: 1072 - protein, 319 aa, Solanum lycopersicum
MEGVSYQRFPKIKVREVKDDFMKFELRDTDASIANALRRIMIAEVPTIAIDLVEIEVNSSVLNDEFISHRLGLVPLTSERAMSMRFSRDCDACDGDGQCEYCSVEFYLRVKCLSDQTLDVTSKDLLSSDHTVVPVDYSDASSSFDNTPNKGIIIVKLRRGQELRLRAIARKGIGKDHAKWSPAATVTFMYEPEIYINEDMMESLTLEEKTELVESSPTKVFGIDPENKQVIVVDPEAYTYDDEVLKKAEAMGKPGVVEIHAKEDSFIFTVETTGAVKSSQLVLNAIEVLKQKLDAVRLSDDTVEADDQFGELGAHMRGG

SEQ ID NO: 1073 - protein, 259 aa, Gossypium hirsutum
MLLRPVSSLCVQAKQGDNLICSLKGSPVTSSSSSALSFLPRKHGRALGVYASIGTNNHALTGVVFQPFEEVKKEELDIPIAPHLSLARQKFADACEAAINEQINVEYNVSYVYHSLYAYFDRDNVALKGFAKFFKESSEEEREHAEKLMEYQNKRGGRVKLHSILMPPSEFDHAEKGDALYGMELALSLEKLTNEKLLCLHNVAVQNNDAQMADFIESEYLAEQVEAIKKISEYVSQLRRVGKGHGVWHFDQMLLHEGA

SEQ ID NO: 1074 - protein, 740 aa, Brassica napus
MDDHESPLLSKEPSSSSSSSVVASSFKWILKVLMSVIFVAWIVFLFVYPGKLGDGILTNWRAVSSNTLFGTTGSMFLIFSGPILVISVLASLYLIISGEEKVFTKKKISKFPRFRLWTFPVLVDGPFGVVSAAEFLVIMIFSVFFLWAIYAYTMRDLDLLDLFHVLPEDRSMLLLEITGLRFGMIGLLCMVFLFLPISRGSILLRLVDIPFEHATKYHVWLGHITMAFFSFHGLCYVVAWTVQGRLLELLFEWKAIGIAVLPGVISLVAGLLMWVTSLQYVRKHYFELFFYTHQLYIVFVVFLALHVGDYLFSIVAGGIFLFILDRFLRFCQSRRTVDVISAKSFPCGTLELVLSKPPNMRYNALSFVFLQVRELSWLQWHPFSVSSSPLDGKHHVAVLIKVLGGWTAKLRDQLSKLYEAENQDQLLSPLSYPKITTCVEGPYGHESPYHLAYENLVLVAGGIGISPFFAILSDILQRKRDGKACLPKKVLVIWAIKNSDELSLLSSIDIPSLCPSFSQKINLEINIYVTRQSEPLLEDGMVHKMVNPSVKPRNNGCPMSVLVGTGDNIWAGLYLVSSTIGFVLMITLLDIFYINKFNITAWWYKGLLFVVCMVASVLIFGGLVVVFWNLWGEKAGDVEPNGHDKVTTNGGELHNPSAELKGLNTEDDIQSFITTRYGTRPDFKEIFESLNEKWGSVDVGVIVCGPASLQSTVAKEIRSHSIWRSTNHPLFHFNSHSFDL

SEQ ID NO: 1075 - protein, 260 aa, Gossypium hirsutum
MLLKAVPTFSSLNPQLENQGALFSSFSSSINHQLSSLRNGPGSLVVCAAKGANHKPLSGVVFQPFVEVKKELDLVPSVPQLSLARQKFTDDCEASINEQINVEYNVSYVYHAMFAYFDRDNVALKGLAKFFKESSLEEREHAEKFMEYQNKRGGKVKLQSIVMPLSEFDHAEKGDALYAMELALSLEKLTSEKLFNLRNVAVRNHAVQLTDFIEGEFLAEQVEAIKKISEYVAQLRRVGKGHGVWHFDQMLLREGEEAIA

SEQ ID NO: 1076 - protein, 569 aa, Physcomitrella patens
MAVSSLVFIAPTSSSCGCSGIQYRALNLAHTARGRGLESSSSLYFFGGKLQTWKFVENAAKWRNAAGSLRVRCDAGVALVEQRVEEEQKQRLSSDFTTVMKFGGSSVASAHRMREVAQLILSFPDERPVIVLSAMGKTTNNLLKAGEKAVSCGVEESGNIEELQVIRDLHKTTARELKVDESLVTELFEELEQLVMGIALMKELTLRTKDYLVSFGERLSTRLFTAYLNSIGTYARQYDAFDLGIITTDEFTNAEILEVTYPTVRERLLKDLKADADRGTPICVVTGFLGKGVETGCVTTLGRGGSDLTATALGKALGLREIQVWKDVDGVLTCDPRVYSNALPVPFLTFDEASELAYFGAQVLHPQSMRPARDANIPVRVKNSYNPQAPGTLITGERDMSEAEMTSIVLKKDVTMLDIQSTRMLGQVGFLAKVFTTFEHLGISVDVVATSEVSISLTLDPSKLWERELIEQELDKMKSELSKIANVQLLKKKSIISLISNVKQSSAVLEKVFRVFKKNDINVQMISQGASKVNISMVVDDDDAPKCVQELHKVFWPDADEATERNGHV

SEQ ID NO: 1077 - protein, 575 aa, Brassica napus
MAAAARVQCHNNTSFTGSPLPRRHRNSSTLHASPNRVNFTPLKWIGDGSSSCTRTVSGPPLKGGGTTTVRAAFEEEKKTDAVNEVAEEKRRFTCVMKFGGSSVATAERMREVADLVLTFPEESPVIVLSAMGKTTNNLLLAGEKAVSCGVSNASEIEELSVIKELHLRTVKELEIDLSVVSSFLEELEQLLKGIAMMKELTLRTRDYLVSFGECLSTRIFAAYLNKIGVKARQYDAFEIGFITTDDFTNGDILEATYPAVAKRLYDDWMHDPAVPVVTGFLGKGWKTCAVTTLGRGGSDLTATTIGKALGLQEIQVWKDVDGVLTCDPTIYKRATPVPYLTFDEAAELAYFGAQVLHPQSMRPAREGGIPVRVKNSYNPKAPGTIITKTRDMTKTVLTSIVLKRNVTMLDIASTRMLGQVGFLAKVFSIFEDLEISVDVVATSEVSISLTLDPSKLWSRELIQQELDHVVEELEKIAVVNLAKGRAIISLIGNVQHSSLILERAFHVLWTKGINVQMISQGASKVNISLIVNDAEAEGCVEALHKSFFESGDLSELLIQPRLGNGSPVRAMQVEN

SEQ ID NO: 1078 - protein, 489 aa, Brassica napus
MALIQQPVQGSSSLSANEIIQTIHCFSRRVASVSAMPTTCSTKSPKERKDKKTSGLISTRHQVDPKRELSRILRTDAAVKSIERKANSEKYNTLWPKAVLEALDDAIKENRWQSALKIFSLLRKQHWYEPRCKTYTKLLKLLGNCKQPEQASLLFELMLSEGLKPTIDVYTSLISVYGKCSLLEKAFATLEYMKSVSDCTPDVFTFTVFISCCCKLARFDLVNRVLLEMSYLGVRCSTVTYNTILDGYGKAGLFEEMENVLADMIEDEDSLPDVFTFNSIIGSYGNGGNIRKMESWYNRFQLMGVEPDITTFNVLILSFGKAGMYKKMSSVMDYMEKRFFSPTVVTYNIVIETFGKAGRIEKMEEVFRKMKYRGVKPNSITYCSLVDAYSKAGLVGKIDSVLRQVVNSDVVLDTVFFNCIINAYGEAGDLATMKELYIQMEERKCKPDKITFATMVKTYAAHGIFDAVRELEKQMISTCESSGKKRLMG

SEQ ID NO: 1079 - protein, 701 aa, Zea mays
MPVAALRPPPVAVGAGRRSARLQARFALRASSLEASAAVTVTVNGSAEAAVERKEKVQEDKDNEGLPVKEEQERGLEVLYDDGFGSVTVKDYFAAAKVLCRDDGGPPRWFSPVECGHPAVDQAPLLLFLPGMDGVGTGLILHHKSLGKVFEVRCLHIPVNDRTPFEGLVQIVENLIKHEHDLSPDRPIYLVGDSFGGSLALAVAARNPQIDLVLILVNPATSFAKTPLQPVLPLLESVPSEFHATVPYLLSFVMGDPLKMAAVSIENNLSPPETLQKLSDSLTSMLPLLSELSDIIPRDTLLWKLKLLKAGAAYANSRLHAVQAEVLLLASGKDNLLPSGEEADRLFKALKNCRVRYFKDNGHTLLLEDGVNLLTVIKGANMYRRGRQRDSVTDYLPPTLSEFRQTFDVDHRLFHLALSPVMMSTLKDGKIVRGLAGVPDKGPVLFVGYHALMGIELSPLYEEFLREKRTVVRGMAHPFLFGKKFESSRQEMSRFDTVSMYGGLPVTPINMYRLFQRNQFVLLYPGGVREALHRKGEEYKLFWPDQPEFVRMAARFGVTIIPFGCVGEDDVLELVLDYNDQKNIPGLREWIQSINKEAERVRDSVKGEDGNQDMYLPALLPKVPGRFYYLFGQPIEMKGMGNLVRDRKSANEVYLRIKSQVEEIMSYLKRKREEDPYRSLPQRALYQATWGASAQVPTFEP

SEQ ID NO: 1080 - protein, 173 aa, Glycine max
MTSCTSFASFLISSSSFPSLCFAQTHSITCKQRFPFPSVKGRRKFSTLSFSSTKRLVTRAAEYKFPDPIPEFADAETQKFKSHLLKKLSKKDMYGESIEEVVGICTEIFSTFLHSEYGGPGTLLVLPFVDMADALNEQGLPGGPQAARAAIKWAQDHVDKDWKEWTNGDNNKK

SEQ ID NO: 1081 - protein, 855 aa, Zea mays
MASPAGGESPAKPVLLHGDLDLWILEARLLPNMDMFSEHVRRCFAACRPPSSCGTKHPPPAAAGRRHHHHHRNIITSDPYVTLSVSGAVVARTAVIPNSQDPVWEERFAVPLAHRAADLEFQVKDNDTFGAQLIGTVAVPADRVVSGDEVEDWFPVIGTNGKPYKPDTALRLRFKFQPIADNPAYRHGIAGDPDHRGIQDSYFPLRHGGQLTLYQDAHVREGDLPEIDLDNGKTFQHNACWEDICHAILEAHHMIYIVGWSVYDKVRLVREPSPSRPLPEGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQARGNKRKITAFIGGLDLCDGRYDTPEHRLFKDLDTVFQNDYHNPTFSAGAKGPRQPWHDLHCRIDGPAAYDVLTNFEQRWRKATKWRDRFRRVSHWKDDALIKLERISWILSPSPNVPNNHPSLWVSKEEDHENWHVQVFRSIDSGSLKGFPSDCKAASKQNLVCRKNLVIDKSIHTAYVRAIRSAQHFIYIENQYFLGSSYAWPSYVNSGADNLVPIELALKIASKIKAGERFAVYVVIPMWPEGVPTAASVQEILFFQAQTMEMMYKIIADELKATDNKDMHPEDYLNFFCLGNREEPPSNGSPESEKSTDKSAAALATKYRRFMIYVHAKGMIVDDEYVILGSANINQRSLAGSRDTEIAMGAYQPHYAWSTKNGHPHGQVYGYRTSLWAEHLGTVDDRFKDPSSLECVRFVNQIAVENWQRFTAEEMSTLQGHLLKYPVKVEADGKISPLSDQECFPDVGGKILGAPTSLPDSLTM

SEQ ID NO: 1082 - protein, 1958 aa, Phaseolus vulgaris
MSSSRGGAGPSSEAPQPRRIIRTQTAGNLGESVIDSEVVPSSLVEIAPILRVANEVEKTHPRVAYLCRFYAFEKAHRLDPNSSGRGVRQFKTALLQRLERENDPTLKGRVKKSDAREMQSFYQHYYKKYIQALQNAADKADRAQLTKAYNTANVLFEVLKAVNMTQSMEVDREILETQDKVAEKTEILVPYNILPLDPDSANQAIMKFPEIQAAVYALRNTRGLPWPKDYKKKKDEDILDWLGSMFGFQKHNVANQREHLILLLANVHIRQFPKPDQQPKLDERALTEVMKKLFKNYKKWCKYLGRKSSLWLPTIQQEVQQRKLLYMGLYLLIWGEAANLRFMPECLCYIYHHMAFELYGMLAGNVSPMTGENVKPAYGGEEEAFLRKVVTPIYNVIAKEAARSKKGRSKHSQWRNYDDLNEYFWSADCFRLGWPMRADADFFCLPSENSFFDKSNDDKPPSRDRWVGKVNFVEIRSFWHIFRSFDRMWIFFILCLQAMIIVAWNGSGDPSVIFNGAVFKKVLSVFITAAILKFGQAVLDVILSWKAQWSMSLYVKLRYILKVVSAAAWVIVLSVTYAYTWDNPPGFAQTIKSWFGNGGSSAPSLFILAVVVYLSPNMLAAIFFLIPFIRRHLERSNYRVVMLMLWWSQPRLYVGRGMHESTFSLFKYTMFWVLLIITKLAFSYYIEIKPLVGPTKAIMSVKITTFQWHEFFPHARNNIGVVIALWSPIILVYFMDTQIWYAIFSTLFGGIYGAFRRLGEIRTLGMLRSRFESLPGAFNASLIPEEASEPKKKGLKATLSRRFPNISSNKGKEAARFAQLWNQIITSFRDEDLISDREMDLLLVPYWADTQLDLIQWPPFLLASKIPIALDMAKDSNGKDRELKKRIGLDTYMSCAVRECYASFKSIIKHLVQGERETKVIEYMFDEVDKHIESDKLIVEFRMSALPNLCKQFVQLIEYLLANDPKDRDLVVILFQDMLEVVTRDIMMEDQDQIFSLVDSTHGGTGHEGMLHLEPEPHHQLFASEGAIKFPIEPFTAAWTEKIKRLFLLLTTKESAMDVPSNLEARRRISFFSNSLFMDMPLAPKVRNMLSFSVLTPYYTEEVLFSLQDLDSPNEDGVSILFYLQKIFPDEWNNFIQRVKSTEEDIKGCESDELVEELRLWASYRGQTLTRTVRGMMYYRKALELQAFLDMAKDEDLMEGYKAVENSDDNSRGERSLWTQCQAVADMKFTYVVSCQQYGIDKRSGSRLAQDILRLMTRYPSLRVAYIDEVEEPVKDSKKKINKVYYSCLVKAMPKSNSASEPEQNLDQIIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTVGFYFSTLITVLTVYIFLYGRLYLVLSGLEEGLSTQKAIRDNKPLQVALASQSFVQIGVLMALPMLMEIGLERGFRTALSEFILMQLQLAPVFFTFSLGTKTHYFGRTLLHGGAKYRPTGRGFVVFHAKFADNYRLYSRSHFVKGIELMILLIVYQIFGHSYRSAVAYILITASMWFMVGTWLFAPFLFNPSGFEWQKIVDDWTDWNKWISNRGGIGVLPEKSWESWWEEEQEHLQYSGLRGIIVEILLSLRFFIYQYGLVYHLNITKKGQKSFLVYGISWLVIFVVLFVMKTVSVGRRKFSANFQLVFRLIKGMIFLTFVSILVILIALPHMTVQDIVVCILAFMPTGWGMLQIAQALKPLVRRAGFWGSVKTLARGYEIVMGLLLFTPVAFLAWFPFVSEFQTRMLFNQAFSRGLQISRILGGQRKERSSRNKE

SEQ ID NO: 1083 - protein, 760 aa, Phaseolus vulgaris
MWRLKIGDGGKNPYIFSTNNFVGRQIWEFDSEAGTDEERAQVEAARQHFYQNRFKLKACGDRLWRFQILREKKFKQKTRKVKIEDDEEITWEKATLTLKRTSHYLSALQTSDGHWPAHLGGSHFFIPIMVISIYSTGHLDFVLPKEYRKEILRYLYNHQNDDGGWGLHIEGPSTMYGTTLNYISMRLLGEGANGGHNNACVKARKWIHDHGSVTHVPSWGKFWLSVLGIVDWSGCNPLPPEFWILPTILPMHPAKMWYYCRHVYMPMSYIYGKRFVCPITPLIRELREELFIQPYDESIWKKARHKCAKEDLYYPHHWIQDLIWDSAYLVTEPLLTRWPFNKLIREKALQVAMKLIHYEDENTRYIDGGCVNKALSMLACWVEDPNGDAFKKHVARVPDYLWLSEDGMCIHGLSTQSWDAGFIVQALLATNLIDDVGPTLAKAHDFIKKSQVVENRSGDFKSMFHHISKGSWTFADRDHALQLSDGTAECMKCCLLLSMLPEEIVGEKLEPERLYDSVNFLLSLQSKNGGVTVWEPAIAQKWLEHLNPAEFLADIVIEHEYLECTGSTIQALVLFKKLYPNHRREEIDNFIVKAAQFIEDEQLPNGNWHGNWGVCFTYGAWFAVGGLAAAGKSYSNCVAIRKAVKFLLSIQNEDGGWGESYLSCPMKTYVPLEGNRSNVGQTAWALLALILSGQAERDPTPLHRAAKLLINSQLEDGDWPQQEALGVYKRSCLLHYPFYRTVFPLQALSEYRNNVLVPST

SEQ ID NO: 1084 - protein, 648 aa, Zea mays
MKRARSSEVFIGVGRLRARRGLAPFLAAAAFAYLLFVSVKLTYLGSAGPAPAFGRLDTTGAGEPAARARSSGGGAVSGYGRITGEILRRHEAFEERRKRLGQLGNFTELERVAAEAWALGAAAWEEASAFDGDVDYIASRDVAGEGTAKCPGSLALGAGETTAFLPCGLAAGSAVTVVGTARPARPEYVEALERSGTGNGTVLVAQFAVELRGLRATDGEEPPRILHLNPRLRGDWSSRPVLEMNTCFRMQWGRAQRCDSTPSGDDDLVDGLRKCEKWDWQDVVESKETKTSSWFNRFIGRAKKPEMRWPFPFSEGKMFVLTIQAGVEGYHINVGGRHIASFPHRMGFALEDATGLAVTGGINVHSVYATALPKAHPSFSLQQVLEMSERWKARTVPEEPIHLFIGILSATNHFAERMAIRKTWMQFPAIQSGNAVARFFVALSHRKEINAALKKEAEYFGDIVILPFIDRYELVVLKTVAICQYGVHNVTADYIMKCDDDTFVRLDIVLHQISTYNKTSPLYLGNLNLLHRPLRRGKWAVTYEEWPEAVYPPYANGPGYVISAGIARDVASRHTNHSLRLFKMEDVSMGMWVEDYNASAPVQYVHSWRFCQFGCVDNYFTAHYQSPRQMLCLWEKLSAGRAHCCNYR

SEQ ID NO: 1085 - protein, 1011 aa, Zea mays
MELALASAKPSPRAAGAFPPLIFSPLKPFPLLRFPPRRTAAAALRLRLRLRAAAADAGETSPGEEVFGARRELTGIQPLVEALPPAARTAAELAVAAAAVAAGYGIGLRAGGGSRAVAVAGAAVLCAASVAGAAAVNSVVPEVAAVGLHNYVAGHDDPTNLDNGEVEAIAKKYGVSTQDDAFKAELCDLYARYLYSVLPPGDEDLKGTEVQAIIKFKSALGLDDVDAANMHMEIGRRIYRERLETSDRDADMEQRRAFQKLIYVSNLVFGDASVFLLPWKRLFGVTDSQIDIAMRENAKNLYSVQLKSIGRGLDIGTLIEVRRAQLAYKLSDEIAAEMFREHAKQLVQENISSALDILKSRIPDSLTQAVEEVNIVIKFNSLLTTLSKHPEADNFARGLGPISLAGEDDHDRRADDFKILYKAYATEVLSDGIVDDKKLSPLNELRNIFGLGKREAEGILSDAKAHIYRRTLAKSFNTELASVPSKAAFLQTLCEKLQFDPELASKMHEEIYRQKLQQFVADGELSKEEVEALMAFQVRLCIPQETVDAAHTEICGQLFEKVVKEAIASVDGYNADRREAVRKAAQSLNLKTEAVMTIFSKAVRKLFLSYIQRAKEAGNRIETAKELKKLISFNIVVVTELLADIKGELSPVAETEASSAAAESEGEDGEHEWESLDTLRKTRPDKELKEKLRKSSQKEITLKDDIPLRDRAELYETYLMFCITGETTNVSFGTAISTKKDDSEFLMLKQLGDILGLTRKEAQDVHIKFAEKAFVQQAEVILADGKLTEAKADQLAKIQKQVGLPTEHAQKIIKGITTTKLSSAIEASVARGQIGIQQVRGLKEANFQLDSLIVEPQRESIYRKTVEELFSSGTGDFDEEEMYVKIPADLIISSEKAKSIVQDIAKVRLENSLVQAIALLRQKKRDDVLSSLNDMLACDAAVPASRPLSWPTPGELDDLFAIYLKSIPKPEKLSRLQYLLGISNEKANEMQYAASEGSLPVAAEEKEELAF

SEQ ID NO: 1086 - protein, 478 aa, Zea mays
MAELKRLSESRDLTRIERIGAHSHIRGLGLDSSMEARDTSEGMVGQLHARRASGLILQLIRQGKIAGRAVLLAGQPGTGKTALAMGIAKSLGAETPFASVAASELFSLDLSKTEALTQAFRRAIGVRIKEEAEIIEGEVVEISIDRPLSASGVGGSSVAPSGATAAGKSGRLTLKTTDMETVYELGGKMIEALGKEKVQSGDVIALDKASGKVTKLGRSIGRSRDYDAVGPHTKFVKCPDGELQKRKEVVHCVTLHEIDVINSRTQGFLALFTGDTGEIRAEVREQIDTKVAEWREEGKADIVPGVLFIDEVHMLDIECFSFLNRALENDMAPILVIATNRGITSIRGTNYRSPHGIPPDFLDRLLIITTHPYTEDEIRKILDIRCDEEDVEMSADAKVLLTKIGVETSLRYAINLITSAALACQRRKGKVVEMEDISRVYQLFLDVKRSTQYLMEYQSQYMFNEVPGQADGEDAMQS

SEQ ID NO: 1087 - protein, 211 aa, Zea mays
MGFAAFLYLAGFLSDSSGATSVLTETEKTTVLKLQVGLLGMARSFQKELDQIAEKADTSTPAGLSYVLTETTLALLRHPDCCISAYSSVDVKRSIDNGEKRFNQLSIEERGKFDEETLVNVNNIKRNKGGSQRSSGFSNEYIVITILVAAEGVHKVPVINSSNDLKTALQKMGAIPSRKILAVEVLWTPQNENDTLSERELLEDYPLLRPL

SEQ ID NO: 1088 - protein, 1638 aa, Medicago truncatula
MAPKSGKGKTNKAKTEKKKKEEKAVAPSLVDIIVVTPYDSQIVLKGISTDKILDVRKLLAVKVETCHFTNYSLSHEVKGQRLNDRVEVVTLKPCLLRMVEEDYNEESQATTHVRRLLDIIACTTKFGKPKRNIPGPDSSKPKKNGKAHNQNKSGLSPPVTPNGETRVGSPMSEPPASPISENVGMVAIHPTPKLSDFYEFFSFSNLTPPILHLKKCELKVEDDRGKGDYFQLQVKISNGKVIEVVASEKGFYSVGKLSLQSHTLVDLLQQLSRGFANAYGSLMKAFSDRNKFGNIPYGLRSNTWLVAPSIGESLSNFPALPAEDENWGGNGGGQGRNGEYERRPWATDFEILASLPSKTEEERVIRDRKAFLLHNQFVDTSIFKAVAAIQHVMESKSAINSSPGSVLHQDQVGDLSIVVERGGNGKFDSILNESSKHNDAVQKNLIKGLSADESVTVNDTSSLAVVVVHHCGYTATVKAIGNSNARKPKVQDIEIDDQLEGGANALNINSLRVLLHKSGADSSEVTLTSLSNFDDLDASKDLVRKVVEESIEKIKEEPSVSKRSIRWELGSSWMQHLQKQENSTDGSSNNKDGSDVEPAVKGLGKQFKLLKKREKKPSDLNAADSVEQNNDEPNNDEPSSLNELEKLLSPEAFLRLKESGSGLHMKSVDELINMAHKFYDEIALPKLVTDFGSLELSPVDGRTLTDFMHLRGLKMGSLGEVVKLSENLPHIQSLCIHEMITRAFKHLLKAVIASVDNAADLPSVIASTLNFLLGGCQTEDTDQTLGDDHHLKIHWLRMFLSKRFGWALKDEFQHLRKLSILRGLCHKVGLELLPRDYDMESPKPFGKYDIISLVPVCKHVGCSSIDGRNLLESSKIALDKGKLEDAVSYGTKALAKMMTVCGPYHRNTASAYSLLAVVLYHTGDFNQATIYQQKALDINERELGLDHPDTMKSYGDLSVFYYRLQHIELALKYVNRALFLLHFTCGLSHPNTAATYINVAMMEEGMGNVHVALRYLHEALKCNKRLLGADHIQTAASYHAIAIALSLMEAYSLSVQHEQTTLKILQAKLGAEDLRTQDAAAWLEYFESKAIEQQEAAKNGTPKTDTSIASKGHLSVSDLLDFISPDNDSKGNDAQRKQRRPKILPISDNNSQEHDDTPIVDDVVIVDNAKDAAIAVEGKIEETKGKHGTEEPKKIVDLSMHKPVVTVEAVYETSSDEGWQEANSKGRSGNAANRKSGRRQRPLLSKLTVNGSDNHMYKEASYRNDTTLHQKAAPKVASAMLSPSRKSKTPKALSSKISSTPASLSSLASKSISYKEVAAAPPGTVLKPLLEKTETEKVNDENEMPKNEGSVETSNADTVPQKVEKEPSDADTDPQQDESEQDNSSSELEKVSPSSDQAKSSETNGSKLSAAAKPFSPGTLSASRHLNPVPLASIYDANVSQGILVEPVLPPAAARVPCGPRSPLYYRTNYTFRMKHSSTKIREISGSGGPKIMNPHAPEFVPRSASQIEISEKNSTSKNSLSESEKSEIARQILLSFLVKSVHQNADAVDEPKVSEGKVESFENSSDEVAKDSAVIKIMYGTDEKNKAVVNSSDDSEEQDNLDGEGFVVVTNRRKSRQKTTNGVAELYNQPSICASVR

SEQ ID NO: 1089 - protein, 528 aa, Oryza sativa
MADDSASPSPSSASPLQHHREALKSSVRNTAASRRREQAIAIGKERREALIRAKRVCRAPISGSDEAEMEEGDMVVDEEKACLEAKTAHAVEELKSALSIQGKGVQKKKIEALRDLRRLLSQPEVPLVDTAIKAGAVPLLVQYLSFGSSDEQLLEAAWCLTNIAAGEPEETKSLLPALPLLIAHLGEKSSTLVAEQCAWAIGNVAGEGAELRSTLLAQGALRPLTRLMFSNKGSTARTAAWAMSNLIKGPDPKAANELITIDGVLNAIIASLEKEDEELATEVAWVVVYLSALSDRGISLIVRSSVPQLLIGRLFSSENLQLLIPVLRGLGNLIAADDYMVDSVLTVGNNIIDQALSGLIKCLKSDNRVLRKESSWALSNIAAGSFEHKKLIFASEATPVLIRLVTSAQFDIRREAAYTLGNLCVVPTGNCELPKIIVEHLVAIVDGGALPGFIHLVRSADVDTAGLGLQFLELVMRGYPNKQGPKLVEMEDGIEAMERFQFHENEQMRNMANGLVDEYFGEDYGLDE

SEQ ID NO: 1090 - protein, 236 aa, Sorghum bicolor
MAPRDLLLLLLAAVLLPSSSTAADPDAVQDYCVPETGAGARGRAVPVDLSLLPSYPCRSPANLTAADFASAAVRAAGNFSADTGFAGVSVTPATFPALHTLGMSFARADLSAAGGVNPPHYHPRATETALVLSGRVYAGFVDTGGRVFAKVLEKGEVMVFPRAMVHFQMNVGDEPATVYGSFNSENPGIVRIPATVFGSGIKEGVLERAFGLSPEELRRLEKRFGPPKTKTAEMDD

SEQ ID NO: 1091 - protein, 636 aa, Triticum aestivum
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYVRKDILFAQETAENIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLIDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFNKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 1092 - protein, 1845 aa, Glycine max
MAPRNSRGKPKGEKKKKEEKVLPVVIDITVKLLDETHVLKGISTDRIIDVRRLLSVNTETCYITNFSLSHEVRGPRLKDTVDVSALKPCLLTLVEEDYDEDRAVAHVRRLLDIVACTTSFGPSSLPPPKNDSGTVPKSGKPEAPPAKQSAKDAEAAAATVDIEGEISHSCPKLENFYEFFSLSHLTAPIQYVKRGSRRRVEEILEEDYLFSLDVKVCNGKVVHVEACRKGFYSVGKQRILCHNLVDLLRQLSRAFDNAFDDLLKAFSERNKFGNLPYGFRANTWLVPPVAAQSPSYFPPLPVEDEMWGGNGGGLGRDGKYDLVPWANEFSFIASMPCKTAEERQVRDRKAFLLHSLFVDVAIFRAIKAIKHVMEEPNFSCSVVENNIIYTERVGDLNINVLKDGSVASCKIDTKIDGVEATGVNQKDLLERNLMKGITADENTAAHDITTLGVINVRYCGYVVVVKVEGGVNENVDSPSQQNIELFDQPEGGANALNINSLRLLLHNTTSPENNKPVSQIQTFESEELGASHAFVEKLIKESLAKLEEEEPGIDYFVRWELGACWVQHLQDQNNTEKDKKPSSEKAKNEMKVEGLGKPLKALKNYKKKSDSSNNNSATEYSKFNREAESSPLPSIESQHETTEAENELVLKGMLSDEAFTRLKESGTGLHCKSMHDLIELSRKYYTDVALPKLVADFGSLELSPVDGRTLTDFMHTRGLRMHSLGHVVKLSEKLSHVQSLCIHEMIVRAFKHILRAVISAVDKEKMASSIAGALNLLLGVPENRESDKSREVHPLVWKWLELFLKKRFDWDLNKLNYKDVKKFAILRGLCHKVGIELVPRDFDMDSPIPFQKSDIVSLVPVHKQAACSSADGRQLLESSKTALDKGKLEDAVTYGTKALANLVAVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQRLLGADHIQTAASYHAIAIALSLMEAYPLSVQHEQTTLQILRAKLGSDDLRTQDAAAWLEYFESKAFEQQEAARNGTRKPDASIASKGHLSVSDLLDYINPNTKGRDAAAKRRSQITKVRATSYQNTGMSSSDESSKEIPKEASDEEVQISEPVGSADSEKESNSGPDLEQAILKQISDEKLQIYDEIFSEAHAEGEDGWQSVQRPRSAGSYGRRLKQRRAALGKVYSYHKNVEVGTESPFVRSPNPNSRYYFLKKRTISHGSYTDDHTTNITQGNKFGRKVVKAVTYRVKSMPSTSKPCANETLENGDKLLSSLPEPDPIDANPVKNSKVSLGKSPSYKEVALAPPGTISKFQVYNPQSDISVSSEHDSGKHEEEVEANRNVDVDPTLIEVNDTVKEKNNDSLSDSVDDSLDDTGVAIEGKEETELIVAVQDNCMSAEGQSGDVEAQGAVDSSILIHAVDDHVDSYKQELDTSNSSGSLEPSANTNPISQGGEDLRVNVSPSSQSRTGGIPYKKLSASAAPFNPSPAIARAAPIAMNMTLPSGPRAVPAIGPWPVNMNVHPGPTTVLPAVAPMCSSPHHAYPSPPTTPNMMQPLPFMYPPFTQPQSVSPSNFPVTNSAFHANHFTYLNPTISKFGPSAVWPGCHPVEFPLPVPIVEPIPDPISESQALCHGLESPSSASVLPEDIDNIGDSNQVVKTLSSEISEDEAVRSGSESIKENGNMNFHGSENAGNKQHQNIASNGNSSSSGTNMDGEKTFSILFRGRRNRKQTLRMPISLLTRPNGSQSFKVIYNRVVRGSHAPKSMNLSSSKDCTATS

SEQ ID NO: 1093 - protein, 16 aa, Zea mays
MGMAGEKFQLGTVGAL

SEQ ID NO: 1094 - protein, 397 aa, Brassica juncea
MASSVISLSLTTPLKANSFSKYNLTPLPSLRRISCCSTREITLKPRLALPDTCKQRRSVELLTRCGVSSNDFPAEKEKKRSFGEWVEFLGEAVSTAFPVWVSLGCLLGLVKPSAFNWVTPDLTIIGLTITMLGMGMTLTLDDLRGALKMPKELFAGFVLQYSVMPLSAFLVSKLLNLPSHYAAGLILVGCCPGGTASNIVTYIARGNVALSVLMTAASTVSAVIMTPLLTAKLAKQYVAVDALGLVKSTLQVVLLPVLAGAFMNQYFQRVVKFVTPLMAPIAVGTVAILCGTAIGQNASAILASGKQVVMACVLLHLSGFLFGYLFSRLLRIDVASSRTVSIEVGMQNSVLGLVLAAEHFGNPLTAVPCAVSSVCHSIIGSVLAGVWRRSAPKQLED

SEQ ID NO: 1095 - protein, 1637 aa, Phaseolus vulgaris
MVLFTEGVTNSVKAVGFSFLTSDELLRSSRVKITNPILLNPLLNPVSGGLYDPALGPLDDKSLCKSCGQGSKHCPGHFGHIELVSPVYNPLMFNILSSILQRTCFSCHHFHASRKEVEMRTSQFELIMKGDIIRAKSLDSIISDESNHSGDGDESQGVEQLGENWSSLQFSEAMSVLRKFLLRKYKKCQNCGVVNPRISKPTFGWFHMNVLSDDEARANTMRALESETINDDMSLGGGETTEEEDITSTGTAKRDKRKKGKLSSKLAAQNKLSGSLLPSQVKGILELLWENEARLCSYISDIQDQGFGKKAGHSMFFLENIFVPPIKFRPPTKGGDDVMEHPQTVLLTKVLQGNISLGDAHINKLDPSKVLSRWMDLQQSVNLLFDNKTSGQGEVAAGICQLLEKKEGIFRQKMMGKRVNFACRSVISPDPYLAVNEIGIPPYFALRLSYPERVTPWNVTMLRNAILNGPQSHPGATHYTDQQATVKLPPNGKLLSFISRKLPSSRGVILDHGKISDQEFEGKIVYRHLKDGDVVLVNRQPTLHKPSIMAHVVRVLKGEKTVRMHYANCSTYNADFDGDEINVHFPQDEISRAEAYNIVNANNQYVKPTSGDPIRALIQDHIVSAALLTKKDTFITYEVFIQLLYSSGVSMTGLGSFSGKHGQKVFMTNSEFEMFLFPPAIWKPEPLWTGKQVISALLYYITRDSPPFTVEKNAKIPSNFFKTQVRDGKRHTRDKSRNKVEPDDEDKLLIYKNDLVRGVVDKAQFGDYGIIHTVQELYGSKVAGNLLSALSRLFTTFLQMHGFTCGVDDLMITEEKDVERMDQLRSCEEIGDIVHREFIGVMNSDNIDPITLQLNIEKKIRSNGEAALTYLDRKMTSNLNSRTSSGILKDLLSDGILKPSGKNCISLMTTSGAKGSMVNFQQISSHLGQQELEGKRVPRMVSGKTLPCFAPWDCSPRAGGFIIDRFLTGLHPQEYYFHCMAGREGLVDTAVKTSRSGYLQRCLMKNLECLKVCYDHTVRDADGSIIQFHYGEDGVDVHHTSFINKFEALSTNKELVYGNCCRQLDRSSPYINKLPDALKEKAENFFRDSLKQRNLGSLKRAEFLKLMEHKYVSCLAQPGESVGVLASQSVGEPATQMTLNTFHLAGRGEMNVTLGIPRLQEIVMAAARDIKTPFMTCPLRSNKSMEEAICLADKLKKITVADIIKSMKVSVVPVSVLGGQVCSIYKLVMKLYKPKQYPKYSDITLEDWEDTLRISFVRELEDAIENHMALLSKISGIKKFKTDPQSHSNSSEDAHGNGSESETKGKSNDDDDDDDVVEDTEGYEDLGSDAQKRKRQGTDEVDYEDGPEEETHDGVLSEEIENDEDNVDDNMTLDASDSEGLDELSESKSIFEKDSLKREKKKSRPTTRKYDRAVFVKAKGMHFQIHFKFTGEPDILLAEIALRSAKKVCIQNSGRVGECKAVTCKESGVMYYGEDSRKRDDIPASVKEKIPALQTSGVHFKTFWELQDDLDVRYIYSNNVHAMLNAYGVEAARETIIREVQNVFKSYGISVNIRHLTLIADFMTHSGGYRPMNRNGSIADCTSPFIKMCFETASKFIVEAAYHGQVDNLETPSSRICLGLPVKMGTGCHDLIQKLEI

SEQ ID NO: 1096 - protein, 232 aa, Phaseolus vulgaris
MVSSSNSWMKEYNEALKLADDISGMISEQSSFPASGPEIQRHSTAIRRKITILGTRLDSLQSLLSKFPGKQPISEKETNRRKDMLASLRSRVNQMASTLNMSNFSNRDSLLGPEGKPDAMARTVGMDNNGLVGFQRQLMKEQDEGLEQLEETIASTKHIALAVNEELGLHTRLIDGLDQHVDVTDSRLRRVQKNLAVLNKRTKGGCSCLCMLLSVVGIVLLVIVIWLLVKYL

SEQ ID NO: 1097 - protein, 1070 aa, Phaseolus vulgaris
MECNKDEAVRAKQIAENKMQAGDYEGGLKFATKAQRLFPDIQNIVQILAVCDVHCAARKKLSEFDMDWYGILQTQQSADEATIKKQYRKLALLLHPDKNKSAGAEAAFKLIGEANRMLSDQCKRALYDSKIGISVGNTAAKVAPSHPNGNAGNYQNIFNSQPHAWNPYHQFENQTFWTCCSHCNTRYQYYKTILNQTLRCQQCSKSFTAHDMGNHNVPPTYWSPFNNHKESAKHASSKEASKSNGGKSHGVEEEGVSMSKCTAGVGAYSKVANSRNGHVAAGVTKAGVKVFKAKESQASTKVGCKRARQSASNDNNKAGNGKGMKDTKDQENTVDPHRKTSRKKQHVLYPETDKAGDFGSSPRRPRHHESFTTPKVEEKEVPVTGGLFSNLNPAYRATGVGGQNGETINKASEPHEETILRNKAKVEQTNVQGREVLNSDLNDRKSKANYCSPSKSNLPPNAEISCPDPDFSDFERDKAEDCFAVNQLWAIFDNDDGMPRFYALVKKVYSPFRLRITWLEADSDGLGEIRWHEAGLPIACGKFRLGDSQRTSDRFMFSHQMHCIKGSDTSTYLIYPKKGETWAIFRHWDLGWSSNPEKHLEYQFEYVEVLSDFDENVGIEVAYLGKLEGFVSLFLHTVLNSISLFCISPHEMYRFSHRIPSYKMTGAERKGVPSGSFELDPAGLPTCLFEVGDTGVAKMDGVNCSHREYSNSKVEQAKSSDSIHKSKLQESIDSERAAQILRRSPRSSQKSMVNGQASTRQFTVRKDDINIEHRGYSPPEGNAASSQTNARKVKTPQKQEKNSYDGETLKTRKLPRDLSKKDALGDASERTRCKLTANQSKNSKNVKSTNIPQLVGESVSDFKKDKTEKMFQCGQIWAIYGDRDHMPNTYAQIKKIEFTPSFRVQVSMLEPCPVPSVKRAISCGTFEVKKSKLQILSPSAFSHQLKVEPLVNNRYEIYPRKGEVWFLYEDQNYELTSSKHGRGKCNIVEVLADSEKSIQVVVLSPHNNSQTIFKAPRIQRSKTGVIEVLREEVGRFSHQIPAFQHRDNVHLMGCWELDPSSVPGSFVPIN

SEQ ID NO: 1098 - protein, 300 aa, Phaseolus vulgaris
MAMASNHLRNLTRISVHRILHHRFQPLLNAARFFSDSASSLPQPQPNQQSSPPSSLKDYELAKFAAIADSWWDSEGPFKPLHVMNPTRLAFIRSALCRHFKKDPYSAKPLEGLKIADVGCGGGILSEPLARLGATVTGVDAVEKNIKIAQLHAGLDPVTSTIEFCCTTAEKLVEEGRTFDAVMALEVIEHVANPADFCRSLSALTVPDGATVISTINRSMRAYATAIVAAEYILRWLPRGTHQWSSFLTPEELVLILQRAGINVEEMAGFVYNPVTGRWSLSDDISVNFIAFATKSNSTE

SEQ ID NO: 1099 - protein, 395 aa, Phaseolus vulgaris
MASLSSFAPLVFLLLVIGCTARPFYPLPSKGDGGSRKPLQTLRPYNIAHRGSNGEIPEATHPAYTRAIEEGADFIETDILSSKDGVLICFHDATLDDTTDIANYAEFANRKRTYEVQGKNITGFFTVDFTLKELKSLRVRQRYTYRDQQFNGKFQIITFEEFITIALQAPRVVGIYPEIKYPVYINQHVKWSDGKIFEDKFVDTLQKYGFKGSYLSKNWLRQPIFIQSFAPTSLVYIANKTDLPKILLIDDIDIPTQDTNQSYWEITSDEYLNYIKQYVVGIGPWKDTLVPVAKNYMRTPTDLVSRAHAHNLQVHPYTYRNENSFLHFNFSQDPYMEYDYWINKIGIDGLFTDFTGSLHHFQEWTSKHQDDDSDNDDNTASKLLHKIAMLLASYK

SEQ ID NO: 1100 - protein, 325 aa, Phaseolus vulgaris
MKAVVITTPGGPEMLQLQEVEDPQLQDNEVLIGVHATALNRADALQRKGFHPPPKGASPYLGLECSGTVLSVGKNVSNWKIGDRVCALLAGGGYAEKVAVPAGQVLPIPQGVSLTDAASFPEVACTVWSTVFMTSRLSQGETLLIHGGSSGIGTFAIQIAKYRGARVFVTAGNEEKLGFCKSIGADVAINYKTEDFVARVKEETGGQGVDVILDCVGASYYQKNIDSLNLDGRLFIIGFQGGVTTQIDLRPLLAKRLTVQGAGLRNRSVENKALIISEVEKNVWPAIAEGKVKPVVYKSFPLAEAAEAHQLMESSEHFGKILLVP

SEQ ID NO: 1101 - protein, 377 aa, Phaseolus vulgaris
MQAVSNARRVSRLFLSPHLRASGAPHYTAVSPFSGLAQHVYRRVTTDPIHCFLSKAFCSSGVDTVEEAPSGDVKELYEKMLDSVKVKRSMPPNAWLWSMISNCKHQHDIRLLFDILQNLRIFRLSNLRIHDNFNCNLCREVTKACVHAGALDFGKKALWKHNVYGLTPSIASAHYLLLYAKDHNDTKLLVEVMKLLKKNDLPLQPGTADIVFSICYNTDDWVLISKYAERFVKAGVKLRQTSFETWMQFAAKRGDTKSLWKIENLRSDTMKQHTLATGFSCAKGLLLERKPSDAVAVIQVLNQTLSDTKKSGIKGELQKLVSEWPLEVIKHQKDEDRKALAASLKSDIPIMVSELLSMGLEANVSLEDLNRKEGIPQ

SEQ ID NO: 1102 - protein, 202 aa, Phaseolus vulgaris
MSSYLGAGVSTGTVPVNHDTNGKMFDRRIRITELVLRCVILGLGVLAAVLVGTDSQVKEFFSIQKTAKFTDMKALVFLVVANGLAAGFSLLQGLHCIICVVRGRTLLSKPLAWVIFSGDQVMAYVTVAAVAAAGQSGMLAKVGQPELQWMELCNMYGKFCNQVGEGIASAFGVSLSMVVLSCISAFSLFRLYGGNRMKNVYC

SEQ ID NO: 1103 - protein, 364 aa, Phaseolus vulgaris
MLRFLLLLFLLGLGARVESHEESGPWSCDSDSEIRAEANFKPGVITLDGRADDWKDIDGSYFPLLPALDPDAENEFKGGKMSVKSVHDGRDIFFLLQVDGDYAYSKGESNKCPSVALMFQIGDGASYHNMGGCEEHSTSCTNKTCKGHEVDIMHFSIGSAIPGRLYGGNPLDNRDGNGGDRFGHLVDLYSWNPHCRYLDGTGPPGSANDSSAQNDWKGAWWHSSFTVHSGFVEDQSPYADNGKKGTYFFEFSRPLRTMDHLQQDVQFNIGGSSKMSVAFWYPLDGQPWHGSGHYSVNCDWVPIDISIGGSLTGNSVDAASSSSWNVASAFSVILSVAALCVSVFVSYRVFNPKSVSFTPLENNL

SEQ ID NO: 1104 - protein, 474 aa, Phaseolus vulgaris
MALKFLNKKGWHTGSLRNIENVWKAEQKHEAEQKKLEELRKQIQEERDRTEFRLLQEKAGLVPHQERLEFLYDSGLSVGKSSNSEGFKVLEQLPKSDAADAPGSSASKEGASVPGALFEEKPQSANDTWRKLHSDPLLMIRQREQEELAKIKNNPVKMAMIKKSIEGTEDKEKAHKKEKRKKHRSSKSKHKKQSDSEDDPTEGRKRSDNGNIYKNHNKAQSDSGYQSDERENTRKDHYEDKKYRERSPGHQQRQRKGKDYNEGADDRNYSRSKSERSVRNSQSNPGYESTEVEKRRMNHYEDRKYRERSPSHQQRQRNDKDYKEDAGDRNYNRSKSERYGSEDQSNIDAPKSGGGRFSETSSNRYSSSHEHGYKRRNVAPKLSEEERAAKLRQMQLAAEVHEEQRWKRIKKAEESDAREAVQNNNASGNNFLDSTQKSVYGADKGGSASIAESVRRRTYYSQGRSGGEGNAFRR

SEQ ID NO: 1105 - protein, 219 aa, Phaseolus vulgaris
MATSTMDVLHFHHTPFYCEENVYLLCKKLCSDGIAKAEGSDLFVVFISNEKKQIPLWNQKASKRADGVILWDYHVICIQIKQGDVPPLVWDLDSTLPFPSPLPSYVSETIRPSFQLFSDYNRLFRVVHAPIFLRSFASDRRHMKDSGGKWVEEPPPHEPIVAEDGTVHNLNEYINMSVADAITDVTISSVKDVIFTQKNGVVIKDNQLEEFICQLSSLE

SEQ ID NO: 1106 - protein, 1114 aa, Phaseolus vulgaris
MDPEVQQSQVAAILGADPAAFQTLISHLMSSSNEQRSHAEALFNLCKQTDPNNLSLKLAHLLHSSPHHEGRAMSAILLRKQLTRDDSYLWPRLSPQTQSSLKSLLLSSIQTENSKSISKKLCDTISELASGILPDNDWPELLPFMFQCVSSDSPKLQESAFLIFAQLSQYIGDSLTPHIKHLHDIFLQCLTNPSVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFAILMKMLLDIEDVPAWHSAETEDEDAGETSNYSVGQECLDRLSISLGGNTIVPVASEQLPAYLAAPEWQKRHAALIALAQIAEGCSKVMIKNLEQVVAMVLNSFPDQHPRVRWAAINAIGQLSTDLGPDLQVKYHQGVLPALAGAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQLETDDPTTSYMLQAWARLCKCLGQDFLPYMEFVMPPLLQSASLKPDVTITSADSDNDIEDSDDESMETITLGDKRIGIKTSVLEEKATACNMLCCYADELKEGFFPWIDQVAGILVPLLKFYFHEEVRKAAVSAMPELLRSAKLAIEKGQSQGRDLSYLKFLTDSIIPSLVEALHKEPDTEICASMLDSLNECLQISGVLLDESQVRSVVDEIKQVITASSSRKRERAERTQAEDFDAEEGELIKEENEQEEEVFDQVGEILGTLIKTFKASFLPFFDELSSYLTPMWGRDKTPEERRIAICIFDDVAEQCREAAIKYYDTYLPFLLEACNDETPDVRQAAVYGLGVCAEFGGSVFKPLVGEALSRLNAVIQHPNALHSDNVMAYDNAVSALGKICQFHRDSIDSAQVVPAWLNCLPIKGDLIEAKVVHDQLCLMAERSDSELLGPNNQYLPKIVSVFAEVLCAGKDLATEQTAGRMINLLRQLQQTLPPSTFASTWSSLQPQQQIALQSILSS

SEQ ID NO: 1107 - protein, 125 aa, Phaseolus vulgaris
MAYLRFLHAPLPQPQLTLGFPSPPQFLSIAPPLNFSLSSSSFRCKVFRRLKVNQRLLTVFATNPNSVDGKSPKEGSEVNKTSNAAQGPPLLTILAGLFVLFVVCWSIWSIIAWLISLIVTAPAPK

SEQ ID NO: 1108 - protein, 376 aa, Phaseolus vulgaris
MAAESSRRSGKRPFVEEDDESSKEPPAKRVRFPKGKKVKPGDEVVDKGNVEEGEVDIMNPRVAAKAAKERANQRNQFTAELLSEGTGGIGIDFSVAEVTYEDSENFVDDGIQIEPFNLDKEREEGYFDAAGNFVEYVRENEIKDAWLDNIEVDPKYSALKSVPTNDEDEEPPDLSSEDIGIMKRRIANVLESGETVLQALRRLKGNSDRKAKMSAEAKIIFDQLTEDAMKLMEDGEYNVYHEKREVFVREAEGYERLSQAKEGTSNQHLASGEASGDGDDDFDMFANDDEQDTSKPSTNENNAVSQSSSDAINSAGALQNDYVYDESSGYYYSSSLGYYYDPNTGLYFSAASGQWYSFNEETNTYEEVDEVPSNVN

SEQ ID NO: 1109 - protein, 138 aa, Phaseolus vulgaris
MDDLFDSSLNLEDTHYKEGYDEGHSHGLVAGKEEARQVGLKVGFEIGEELGFYKGCVDIWTSALRLDPTCFSSRAKIVVGQMEELIEKYPLMDPENVQVQEIMDSLRVKFKMVCSSLHVKLEYNGYPKSSTEANDIQF

SEQ ID NO: 1110 - protein, 713 aa, Phaseolus vulgaris
MTMPRVSANPSPSCLVSMASTVRAYALPIILFAGAMFYQLFIIPNAFPPSHYDVLQIESYSSIDKVQEAYEKLESKLNSAEEAFDIHKFLKIRYAYELLTDPLWKRDYDTFGIDEQLHIVESGSKRYAGKHISELDFPLLQARSGFVDHSSKVITSSDFQYIFPDVKPWLIQLFSSGSENCAQFSKSWNKIASLLDVVANTGVVELGEKELAIYLADKSSTGKPFFRNGVPSLIVIPAGCRSPKCMTRFNGELSVDKVTNWFATTIVDLPQINYYSRESLVPNFLGKTSHHKVKVLFFSTFGERAAPFIRQAAKDYWAFASFAFILWREEESSYWLGAFGVHSAPAIVFLKDPGVKPVVHHGSVNNSIFLQLMENNKQQELRQLRSVTSMELGCDPHGYSRAGYDTMIWYCAIVVGRPSLELNKMRETMCRVQETFFKHSQVDASSDNQSLTPAVDAFKRRRLTFAWLDGEKQKDYCQFYIGQAGSDHTCGQRRSVTDIPRLFVIRYLRNGSAVDLRTEQKTDWKSSLVQDLISDSDLAGQFVAGYKGEDDVSQITAWLANIISDGDSRELPFFTLRTPKLVPDDTEPIWSITAQNIPLKNLKQSILGSLSGLSIYREDPRVGPFLLLGALISLGTIWLRRSQQQVQPSEQNQPNSNQPSESNQPTQPSSKDERKQMPRDRVRSRSNKKPTPSMTDFEPSDAYQVPLSDSDSQ

SEQ ID NO: 1111 - protein, 630 aa, Phaseolus vulgaris
MAAARLTSFVAVSSAAVVSMSTFSDRAYADSSFRIPFFSSSPSNAPAPPNQSSDSSSEPPVPEEPNKSGFDPESLERGAKALREINSSSYSKQVFDLMRKQEQTRLAELDAEKVHYELIQSQGDIERQRKMAEEQRNLIQEQAQRQAQVLRYEDELARKRMQTDHEAQRLHNVELVKMQEESSVRKERARQSTEEQIQSQQRQTDRERAEIERETIRVKAMAEAEGRVHEAKLTEDHNRRMLIERLQGERDKWLAAINTTFGHIEGGLRALLTDRDKLLMTVGGATALAAGVYTTREGAKVTWGYINRILGQPSLIRESSMAKFPGSKIISQAKNKLLNSSTLAGTEKPIGSKNGLENVILHPSLKKRIENLARATSNTKAHQAPFRNMLFYGPPGTGKTMVAREIAKRSGLDYAMMTGGDVAPLAAQAVTKIHDIFDWAKKSRKGLLLFIDEADAFLCERNSTHMSESQRSALNALLFRTGDQSRDIVLVLATNRPGDLDSAVTDRIDEVIEFPLPGEEERLKLLKLYVNKYLCDDNNGTKGGFLPKKQPQQITIEDLSEDVFREAAKKTEGFSGREIAKLVASVQAAVYGRPDCMLDSQLFREIVDYKVVEHHQRLKLAAEGGQPGQI

SEQ ID NO: 1112 - protein, 167 aa, Phaseolus vulgaris
MAASVFNTPSFTLFVFLSLQLYLSFSSSSSSSPSIHDLLRSKGLPPGLLPEEVKSYTFSHNGHLEVFLDAPCMTKYENRVLFEQVFTANLTYGSLIGVEGLQQEELFVWLPVKDIIVNDPSSGLILFDIGLAHKQFSLSLFEDPPHCKPEGGLRNHVRKEKGLEVLR

SEQ ID NO: 1113 - protein, 422 aa, Phaseolus vulgaris
MMSVTGKAIDFAGKNLVSCGCSSNASFDRYTVRNYAKVNSKGCGRGHGVCKLFCCTRRNTQCRVSSMKTAEPTVNGGSQAIESLTKGSYLKGYSESPISPATFFEVVADDLLTLNKNLQSIVGAENPVLMSAAEQIFSAGGKRMRPALVFLVARATAELFGLKELTVKHRRLAEIIEMIHTASLIHDDVLDESDLRRGKKTVHQIFGTRVAVLAGDFMFAQSSWYLANLENIEVIKLISQVIKDFASGEIKQASSLFDCDVQLEEYLIKSYYKTASLIAASTKGAAIFSGADRSITEKMYEYGRNLGLSFQVVDDILDFTQSAEQLGKPSGNDLAKGNLTAPVIFALEKEPKLRDIIESEFSEVGSLDEAINLVKSCGSIERAQELAREKADIAIQSLQCLPQSVYRLALEDMVAYNLQRIA

SEQ ID NO: 1114 - protein, 164 aa, Phaseolus vulgaris
MAQKTENEETEFKVPETITLCVNNCGVTGNPATNNMCQNCFSAFTASTATTSSAASAGISSPSARSVASARPQKRSFPEEPSSAADPPSSDQNAPSEAKRVVNRCSGCRRKVGLTGFRCRCGDLFCAEHRYSDRHDCSYDYKAAGREAIARENPVVRAAKIVKV

SEQ ID NO: 1115 - protein, 250 aa, Phaseolus vulgaris
MALLVHAPEISVALQIAPNPNPRLSKVHSFKPQTKGKTIGSARGVRVSCKVKDCAVLDESVNSYGQFSAPVKPGSKQSKEKEEEKQNYHVNVGYAIRTLREDFPDLFYRELSFDIYRDDIVFKDPMNTFIGIENYKSIFWALRFHGKVFFKALWVDISSVWQPVENVIMVRWTVHGIPRVLWESRGRFDGTSEYKLDKQGKIFEHRVDNIATNSPPRFKVLSVAELIQSIGCPSTARPTYFETSSHPERT

SEQ ID NO: 1116 - protein, 132 aa, Phaseolus vulgaris
MLTVEREERRIVAVVPLVQRTKRTKKKKKKNKKNKKKQQFMDVWRNIIFPVRRVWLALSARLKARKNGAGLLKLQDDVQTCGYEDVQVMWEMLQRTESDVVENHHKRKQLPFWRIFVWSNHSEVSSESANHT

SEQ ID NO: 1117 - protein, 1028 aa, Phaseolus vulgaris
MVSDSYSKMISDVTIRSMMKNGEYCGEDLGVLRERKLARLRSGSAPPTVEGSLTAVGGLFEGSPAAVGYGGIRGFGSEEELRADPNYANYYYSNVNLNPRLPPPLASKEDWRFVQRLRGGSKVGGVGDRRMASDDGGIEGGHSNSLFSVHPAGFGVKEEGGLKHRKGGAEWSGEDGLIGLPALGLGSRQQRSIAELFHDERNNASSASKHPHNLPSSNLFDDIAEKSETRVAYVHQELNALRSGGNKQGISAAQNFVGSGPQSYASALGASLSRSSTPDSQLLPRAASPCLPPIGDGRSSSADKKISNGQNLLNAVSSNLNDSADLASALASMNLSTKDIIDDEKHSQSSRHNELDYTHSFKQQPYLNSPDSLAYQRHSATQSHLKLNKGSSFGLDLNKSPGYADEQLEPHKAGGVSVNTHLKGPSTPTFTNRGSSPAHYQNVEDISYPNYGMTGYSVNPSSPSMMASQLGSGNLPPFFENAAVAASALGLNAMDSRALGRGVALGPLLAATELQNSSRLGSHAAGSTQQLPLMDPLYLQYLRSGDVASAAQIAALKESVINRECTDLLGLQKAYVESLIAPQNSHFNVPYLSKSATLSPNSFGNPSYGLATSYPGSPLAGSLFPNSLYGPGSPMNQSERNMRLSGMRNAAGGFMGAWHSDTVGGLEENFPSSLLDEFKSNKTKCFELSEIAGHVVEFSADQYGSRFIQQKLETASMDEKNMVFHEIMPQALSLMTDVFGNYVIQKFFEHGTAAQIRELADQLTGHVLTLSLQMYGCRVIQKAIEVVDMDQQTKMVTELDGHIMRCVRDQNGNHVIQKCIECVPEDAIHFIVSTFYDQVVTLSTHPYGCRVIQRVLEYCHDLKTQQIMMDEILLSVCMLAQDQYGNYVVQHVLEHGKPYERSAIIKELTGQIVQMSQQKFASNVIEKCLSFGTPTERQVLVNEMLGSTYENEPLQIMMKDQFANYVVQKVLETCDDQQLELILNRIKVHLNALKKYTYGKHIVARVEKLVAAGERRISILTLNPAQMV

SEQ ID NO: 1118 - protein, 386 aa, Phaseolus vulgaris
MESSAAMDVEEQPSPNPTNVKRFGLKNSIQTNFGDDYVFQIVPKDDWSAMAVSLSTNAVKLYSPMAGQYFGECKGHTATINQILFSGTSHHQVLCSCSSDGTVRAWDTRTFQQVSCINAGSSQEVFSFSLGGTSGNLVAAGCKSQILFWDWRNMKQIACLEDSHVEDVTQVHFVPNEQGKLISASVDGLICTFDTTGDINDDDHLDSVINMGTSIAKVGIFGESYQKLWCLTHIETLGIWNWKDGRNEGNFSDARTLASESWNLDHVDYFIDCHYYRESEKLWVIGGTNAGTMGYFPVNYKGVATIGAAEAILEGGHTSVVRSVLPMSKIHSNSPTQGIFGWTGGEDGRLCCWLSDHSSESNRSWISSTLITRPEKTRKKNRHQPY

SEQ ID NO: 1119 - protein, 402 aa, Phaseolus vulgaris
MALQGSMSFAAFTLFLVLTTVSHGRNINPPVYGICSSSVILHGYKCQEHEVTTNDGYILSVQRIPEGRANGSGSRTRKQPVIIQHGVLVDGMTWLLNPPEQDLPLILADNGFDVWIANSRGTRFSRRHISLDPSSPAFWNWSWDELVSYDLPAIFNYVFTQTQQKINYVGHSLGTLTALASFSEGKLVNQLKSAALLSPIAYLSHMNTALGVIAAKSFVGEVTTLFGLAEFNPKGLPVDAFLKSLCAYPGIDCYDLITELTGKNCCLNSSTVDIFLRNEPQSTSTKNMVHLAQTVRRGVLTKFNYVRPDYNIMHYGDVFPPIYNLSNIPHDLPLFISYGGRDALSDARDVQNLLDNLKFHDVDKLSVQFIKEYAHADYVMGFNAKDFVYNAVISFFNHQVNT

SEQ ID NO: 1120 - protein, 305 aa, Phaseolus vulgaris
MGFSVAASLGTHIALRNTHEARIKCHFLYKRQESNIIGFKFSKPKALQRKISLSKQEFSDLDERKSPDEVREEIKKCYELINRLGRGAVYLGSSRMGPSHSHYVQTQELAKEIANLLDCTSWSGAGPGLMDAVTQGAMLAGKPVGGFKIGKEAGEWTASNFHPYLPSENYLTCRFFSARKHGLVDAVVRNNSFDKTAVVALPGGIGTLDEVFEMMALIQLERIGSKFPVPLLLMNYDSFYSKLLDFLNDCEGWGTVSKGEVASLWKVCNSNSEALAYLEEFYGISSIDKSKSVTKFCSTYESPSS

SEQ ID NO: 1121 - protein, 249 aa, Phaseolus vulgaris
MLTLNHNAISSSFSTVPFHANYALSTPTQFLFSSNLNYSFATTATRKFKSFQLKAGFWESIKSGLMKNNSMQVIDPPSIDEEDEEPLPQEFVLVEKTEPDGTIEQIVFSSGGDIDVYDLQALCDKVGWPRRPLSKLAAALKNSYIVASLHSIRKSPGSEGEEQKRLIGMARATSDHAFNATIWDVLVDPSYQGQGLGKALIEKLIRALLQRDIGNITLFADSQVVEFYRNLGFEADPEGIKGMFWYPNH

SEQ ID NO: 1122 - protein, 1029 aa, Phaseolus vulgaris
MESVNDLIQEAKLRTLWWALCIFAVSYFLTHTSKSMWMNLPMSIIFVAGLRILFNRVEFRWKVQEPKPLTYLSHLEKKQLSLKDSRLTSLPPPAKWKRKIDSPAVEAAMREFIDKILKDFVVDLWYSDITPDKEFPEQIRAIIMDVLAEISGRVKEINLVDLLTRDVVDLIGDHLELFRRNQAAIGVDVMKTLSSEERDDRLKFHLLNSKELHPALISPESEYKVLQQLMSAVLATVLRQREAQCPVIRSIARELLTCLVMQPIMNLASPGYINELIEALILLLNDDDTEGMGSNQSTNVAGHHHGHSVVSEGGHNNLTPSNKNPSLNQGTEMILAKTSDQGGTSLQGNNLHQESSQARPADWARMLEVATQRRTEILMPENLENMWTKGRNYKRKENKIIKVGFQDLPAKSPSTDSLPPRKLAQETSASKRGKYEDAEGNSPLPKFNALGSDPLQNVATAKISESSQNPEKELSFAKDLATDGYESPLKRSNSASSLGILTNKGGSIISEFYNPELERHSEGFRGKSSSDMVVRKERPLVSKLRCRVLGAYFEKIGSTCFAVYSIAVTDAQNKTWFVKRRFRNFERLHRHLKDIPNYTLHLPPKRIFSSNTDDAFVHQRCVQLDKYLQDLLSIANVAEQHEVWDFFSVTSKNYSFGKSPSVMKTLAVNVDDAMDDIVRQFKGVSDGLRRKVVGSSSLMSEGSVTSSTTWNLSLNSDEIDKIIPRQGTSESVLSSDEEGEKNNNFDDENIVSEVAQVSGLHFDNALILKGYSSPLNNRDEESNNLDFDRKHDMVVEARVGNDVPATNFILIPDNLEDPVGGPPEWSPPNVSVPILVLVDNIFQLKKRGWIRRQVYWMSKQILQLVMEDAIDDWLLRQIHWLRREETVAQGIRWVQDVLWPDGTFFLRVGIPRMISSDDDQMPSQTTSRSGGSNIKKSESGSFEEQLEAARRASDIKKLLFDGAPTTLVSLIGHKQYRRCARDVYYFSQSNTCVKQLAYAILELVLVSIFPEMRNVVLSVHQHVKSSSSI

SEQ ID NO: 1123 - protein, 630 aa, Phaseolus vulgaris
MSEEKMSEKDSTEAQQNPNLEDCLKLLKGERDEQRLAGLLLVTNFCKAHDHSSLRRVYDAVGPRFLYRLLRTGLGSSLNENRDAYLSLSITVLAAFCRVPDIASSDDMLFNIPLVLEVIPTLSGSSLLQECYEFLYLVSAASENGITRFCESGGIKVLASQMTVLQDGSYLMEVSFKLLQLILGRMSLDIIQSNDLSDIPVIVAAIARQFAVLHNSLKFEALHLLNVILTSKDSSQLREALQLLPQESWSHNIRTGIMAVLQNRVAPAERLQALILAESMVSMHGEDWLVSQVNTNDARDPASADMCLLLVLEQSRVEIAVLLNELAYLKYEAPQDTSATSEAIFSKRHNVAVAYSLVEKIIKLISNVEENGGNLLDEGTLTKVILQLNETIAVVLEYLEDAKEHGQKKGDDLLASVRIIGSYLAEAPLACKEKVQDLLGYMLYIEGEDEQRPFYSVCFLLPLLSQITMKIEGCKALASCKGIEAVLDCFNKLVGSNAFLEDNGCIFLACDTILNLLLKKDKVHTMLDESASVSLLKALAYWTDNTDETSSMMMASSICALVFEYTSEEALLNRPDFNYSTLRSLYVLIARCLTSSEQDTKEDMDLSEIVSSGFSRWAHRYPRIREAVKN

SEQ ID NO: 1124 - protein, 368 aa, Phaseolus vulgaris
MEVSQVLCMNGGVGDASYANNSLVQQKVISLTKPIREEAITSLYCSKLPKSLAIADLGCSSGPNTLYVVSELIETVEKLCRQLNHKSPEYKVFLNDLPGNDFNNIFKSIDSFKEKLQNEMEGGPCYFSGVPGSFYGRVFPSRSLHFVHSSYSLQWLSKVPEGVDNNKENIYLGRTSPSSVVRAYYDQFQRDFSLFLKCRAEELVEGGRMALTFLGRRHEDPCSKDGCYIWELMASALNDMVSQGMIKEEQVDSFNIPQYTPSPSEVKLEVLKEGSFSINRLEVSEVNWNALDDWNALEFESERFESVGDGGYNVAQCMRAVAEPMLVSHFGEDIIEEVFTRYQQILADRMAKEKTKFFNVTILLTRKT

SEQ ID NO: 1125 - protein, 1199 aa, Phaseolus vulgaris
MSSSSSSMAAPSEKWIDRLQFSSLFWPPPPDGQQRKDQIAAYVEYFIQFTSEQFTDDIAELIRNRYPSKEILLFDDVLATFVLHHPEHGHAVVLPIISCIIDGTLVYDKASPPFASFISSVCPKVENEYSEQWALACGEILRILTHYNRPIYKIERQYGETERSSSGSHATTSEPIDGKSVHNSLTNQEKKPIRPLSPWITDILLASPVGIRSDYFRWCSGVMGKYAAGELKPPSTASSRGSGKHPQLVPSTPRWAVANGAGVILSVCDDEVARNETATLTAAAVPALLLPPPTTALDEHLVAGLPALEPYARLFHRYYAIATPSATQRLLLGLLEAPPSWAPDALDAAVQLVELLRAAEDYASGIRLPRNWMHLHFLRAIGTAMSMRAGIAADAAAALLFRILSQPALLFPPLRHVDGVEVQHEPLGGYISSYKKQIEVPAAEASIEATAQGIASMLCAHGPEVEWRICTIWEAAYGLIPTSSSAVDLPEIIVATPLQPPILSWNLYIPLLKVLEYLPRGSPSEACLMKIFAATVEAILQRTFPPESTREQSRKSKYLSIIGSASKNLAVAELRTMVHSLFLESCASVELASRLLFVVLTVCVSHEAQFSGSKRPRGEDNYPAEEIIEDLQTSENQKKSKNRKMKKQGPVAAFDSYVLAAVCALACELQLFPLISRGSNNLVSNNAQVIAKPAKLNGSSHRQNGSSHIRQNGSSHIRQNGSSHDLRNGLDSAVRHTHRILAILEALFSLKPSSVGTPWSYSSNEIVAAAMVAAHVSELFRRSKACMHALSVLIRCKWDNEIHSRASSLYNLIDIHSKAVASIVNKAEPLEATLIHAPIWRDSRIYCGNKRQNQCESNCFDPGQTSIIPSADSFPSKPVHTSKKTPCSNEAAGCTLGKGVSGFPLDASDLANFLTMDRHIGLNCNAQIFLRSMLAEKQELCFSVVSLLWHKLIASPETQPCAESTSAQQGWRQVVDALCNVVSASPTKAATAVVLQAERELQPWIAKDDDLGQKMWRINQRIVKLIVELMRNDESAESLVIVASSSDLLLRATDGMLVDGEACTLPQLELLEATARAVQPVLEFGESGLAVADGLSNLLKCRLSATIRCLSHPSAHVRALSISVLRDILHTGSIRYNLKPRRINGTHNPSYQYFNSDAIDWQADIEKCLTWEAHSRLSTRLPINFLDTAAKELGCNISM

SEQ ID NO: 1126 - protein, 296 aa, Phaseolus vulgaris
MIDLSTLNPAQITVMGSAFCVMLSMHFTSQLLSQHLFYWKNPKEQKAILIIILMAPLYATVSFVGLLDIRGSKEFFTFLESVKECYEALVIAKFLALMYSYLNISISGNVVPDEIKGREIHHSFPMTLFQPHTVHLNYRNLKLLKYWTWQFVVIRPVCSILMISLQLLGLYPTWLSWTFTIILNISVSLALYSLVVFYHVFAKELAPHTPLAKFLCIKGIVFFCFWQGMLLEVLAKFGVIQSRHLRLDVEHIEEAMQNILVCVEMVIFSVLQQYAYHPAPYSGEVEKMLRQNKKND

SEQ ID NO: 1127 - protein, 179 aa, Phaseolus vulgaris
MKNSEVYHERQKLQFCLVHSLNSLFQQKDAFTREKLNGISERLALEDSTTETWTPFSVLFKPHHNVFTGNYDINVLIAALEEKGKSVVWHDRRKGASCIDLDAPVLMGIVINVSVTRFGGIWKSRHWIALRKIDGVWFNLDSDLPAPQPFIDAHKVREFLDFTLAQGGEILIVLNEKQS

SEQ ID NO: 1128 - protein, 459 aa, Phaseolus vulgaris
MHNSGGGGGSGGVCHLVAMPFPGRGHINPMMNLCKILASRRPKEILITFVVTEEWLGFIGSDPKPEAIRLAAIPNVVPNERHKAANFPAFYEAVMTNMEAPFDRLLDRLEPPPTAILGCVELRWPIALANRRNIPVAAFWTMSASFYSMLHHLDVFAQQRRLNVDKDTLDGEVENIPGISSAHLADLRTVLHENDQRVLQLALECISKVPKANYLLLTTVHELEAETIESLKAIFPFPIYPIGPAIPYLDLGENPSSVNNDHNPDYIKWLDSQPPESVLYISLGSFLSVSSAQMDQIVEALNSSNVRYLWVARADASWLKDKCGDKGVVVPWCDQLKVLSHSSVGGFWSHCGWNSTLEALFAGVPMLTFPLFLDQVPNSSQIVDEWRNGCKVEQEKLDIEEIVAKEKIEKLVKRFMDHESQEGKQIRGRAREIRATCLKAIGTGGSSDGNLDAFIRDIS

SEQ ID NO: 1129 - protein, 194 aa, Phaseolus vulgaris
MSILKKRSKEVLIYSITESKISNIFSALIIFLGSLGLLLVAISSYLGMDLFLFSEEISNFPFIPQGATMAFYGIGGLFISFYLWWILLWNIGGGFDIFDKKNKKVCFIRWGFPGKNRRIILKIPMNEIQSIRIIAGVQERGILTRTLTYESIVYMETIEQGFIPLTRIEDNLTPPEIANKAGKLAFFLGVPLLY

SEQ ID NO: 1130 - protein, 519 aa, Phaseolus vulgaris
MADQKNENPNRGSVNVESAKGRNKLPNFLLSVRLKYVKLGYHYVISNAMYLMLIPLLGIASAHLTTLSIKDFLQLWENLKFNLVSVTVCSSLMVFLATLYFMTRPRGVYLVDFACYKPHVDCTCTRETFVEKSGLTGSFSEENLSFQKKILERSGLGQKTYLPPAVLSLPPNPCMAEARKEAEEVMFGAIDQLLAKTGVKAKDIGILVVNCSLFNPTPSLSAMIVNHYKLRGNVLSYNLGGMGCSAGLISIDLAKQLLQVHPNSYALVVSMENITLNWYFGNNRSMLVSNCLFRMGGAAILLSNRSGDRRRAKYQLVHTVRTHKGAEDKSYGCVFQEEDETKRVGVALSKDLMAVAGEALKTNITTLGPLVLPMSEQLLFFGTLVARKVLKMKIKPYIPDFKLAFEHFCIHAGGRAVLDELEKNLELSEWHMEPSRMTLHRFGNTSSSSLWYELAYTEGKGRIKKGDRTWQIAFGSGFKCNSAVWRALRTINPAKEKNPWMDEIHHFPVHVPKVAPIAS

SEQ ID NO: 1131 - protein, 366 aa, Phaseolus vulgaris
MPPVPISPVKVGHIDDVQELRKTKPRTIPQRFVRDMTERPTLSTTPLPPSNTHMPVIDFSKLTNGNKEDVLSEIFNLATACEEWGFFQVINHEIDLNLVERIENLSREFFMLPLEEKQKYPMAPGTVQGYGQAFVFSEDQKLDWCNMFALGLEPEYVRNPNLWPKRPERFSETVEEYSGKIRKLCYNLLKYIALGLDLKGDVFEKMFGVSVQAIRMNYYPPCSRPDLVLGLSPHSDGSALTVLQQAKGGPVGLQILKDNTWVPIQPIPNALVINIGDTIEVLTNGKYRSVEHRAVAHEEKDRLSIVTFFAPSYDVELGPMPEFVDENHPCKYRTYNHGEYSKHYVTNKLQGKKTLDFAKIQTKNTN

SEQ ID NO: 1132 - protein, 751 aa, Phaseolus vulgaris
MVSIGSKALVSRSSMGDHDSESPKQAKSKRRKHKKGGAAHEFDSNPKHTNSNSNSNSNTFTSPPQLSRVRKQLDPETTQYFSEIANLFETEGVELEERSLICANALQETKGKEFEIASDYIVSHTLETILQGCDVDHLCDFLHSSANDFPYIAMDRSGSHVAETAIKSLAVHLQHDEARPLVEEALTVICKVIAANSVDVMCNCYGSHVLRTLLCLCRGVPLDKSAYYLSKSTTLLAERLNSKEFSKKDDETNFEPGFPNLLKVLVSDMLKHAKKRIKTLQVDQFSSLVFQTVLRVLAGDDEELLHVIPFLLGCKDKYNAEESFINTKVVADLKNLLKESKFSHLMEVILEVSPEALFNELFTKVFRSSLFELSSHQHGNFVVQALISYSSNQDLMELIWEELGPNLEDLFKMGRSGVIASLVAASERLHVNERKCCQVLADAVCPPDDSPKGIVPRLMFLDSCFSYEDKSNWSWQSGARMNVMGSLILQTVFRFRSEYIQPYITSITSMEATHVLEAVGDSRGSHVIEAFLCSGASGKQKRRLVIKLKGHFGEVALNSSGAFTIDKCFTASNLSLREAIVSEVLAVRSDLSKTKQGSYLIRKLDIDGFAANPDHWRSKQVSKESTYNDFYTMFGSNDTKLTKNDSFLSDTLNNKSNPKAVKEMRKEIDQSLGSGASFLSFQKNPKKEKHKSKKNAYISGDDDESSNRKKRSKKEKVESGFDTAATAATGKTLKKRRRDDLSEASQKKVKA

SEQ ID NO: 1133 - protein, 470 aa, Brassica napus
MALAINVSSASSSVISTSSFPSSELKVSAPRIGSLRLSDRVNVSTASLSLSGKQSSSVKPLNVQSVAKESFVPSQAASMVTSEVTEKLDVVEVEDFEELAKSLETASPLEIMDKALEKFGNDIAIAFSGAEDVALIEYAHLTGRPFRVFSLDTGRLNPETYRLFDTVEKHYGIRIEYMFPDAVEVQALVRNKGLFSFYEDGHQECCRIRKVRPLKRALKGLRAWITGQRKDQSPGTRSEIPVVQVDPVFEGLDGGAGSLVKWNPVANVEGNDVWNFLRTMDVPVNTLHAAGYVSIGCEPCTRAVLPGQHEREGRWWWEDAKAKECGLHKGNIKENSNANAAANVNGTSSTVADIFKSENVVSLSRQGIENLMKLGNRKEAWIVVLYAPWCPFCQAMEGSFDELADKLGGSGVKVAKFRADGDQKEFAKRELQLGSFPTILVFPKNSSRPIKYPSEKRDVDSLTSFLNLVR

SEQ ID NO: 1134 - protein, 616 aa, Gossypium hirsutum
MMMKKNWKFVRLRQEFRVGVLLLLLCQSLACWSLNEEGFALLRLRERVVNDPFGALWAWKEENGEINHCSWFGVECCDGKVIALNLKDLCLEGTLAPELGTLIHIKSIILRNNSFTGTIPEGISKLKELEVLDLGYNNFNESLPSGLSNDLSLTIQNSDRSEGAVLRRLLQETANTSAKSPKAPPLNYSMPPSPRTSRAPTHPASSEPSTNSTYLRGAPVPRPPSAPASKPSGNDTVPNTSAPSPSGSNPSIPDSKSSHQAAILVGSIGGGTFLLILIIIAYLLKTYKVSTVKPWATGLSGQLQKAFVTGVPKLKRSELEAACEDFSNVIGSTTIGTVFKGTLSNGVEIAVVSVPVESTKDWSKNLETQFRKKIDTLSKVNHKNFVNLLGYCEEDNPFTRMLVFEYAPNGTLFEHLHFKESEHLDWAMRLRIIMGMAYCLEHMHQLNPPVPHNNLSSSAVSLTEDYAAKISDPCFWNELTASDREGDRINLSDTTMASLESNVYTFGVLLFEIVTGRMPYLVDNGSSEDMASDYLRREQALVEMVDPTLNSFDKDQFDLIGEVIKSCIDPEPGHRPDMRGVSARLREITAITPDNAIPKLSPLWWAELEIMSSEAS

SEQ ID NO: 1135 - protein, 443 aa, Gossypium hirsutum
MAAYRLLIFSLFLALVFTKIGADASTEPLLEPDAADSSALKMELDQLKSKIRLLESNVEEKIRELKTKDEMIKQKDKIIEEKSDSMASLRSELSSLQKKGTSDAEERVGKAHAKALELQKQVDKLKTELEAKLKDKDYLESRATKAENNLNELNLQLENLQKINKEQENKLAKTERALKIAEEELIKAKFEATSKANELMEVHSAWLPPWLATQLIRGQAFIQTHWNQHGKPNMDMVIQKALERKALAKKWAEPHMEAIKTKWVPAAKDQWVAVTTYAEPHVQSLTAKTVEIYEVSKATITPHIIKVQETVDPYFQEAKKFSKPYIDQVATLAKPHVDKISVVMKPYTKEVVKAYGRFLESATTYHQQVQASVQETLKKHELTRPLATKELEWFSASALLALPIIILFRIFSAIFCKKTKKRVRHTNAVHHGRRKGKRGHTDK

SEQ ID NO: 1136 - protein, 201 aa, Unknown
  Sequence found in Organisms: Gossypium hirsutum, Gossypium raimondii
MASTFSYNSFGFLLILVAFSSLINISSAGRQIAPKTSIEFIRTSCSSTTYPKLCYESLLTQASMIQTSPQLIAHAALNVTLSTAKSTSAMMVKLAKSQGLKPTEVGAMQDCVEELEDTIDELRKSISEMGQIKGSNFGLMINDIQTWVSAALTDENTCADGFGGKNMNGSIKTAVRSKIVTIAHLTSNALALVNSYASFHG

SEQ ID NO: 1137 - protein, 264 aa, Gossypium hirsutum
MNNLEECKADNPQHLQQEEMAASAGAMDGLAASAFRSVLQRVHQTAERCGCESQRIRVVAVSKTKPVSVIRQVYDAGHRCFGENYVQEIVEKAPQLPDDIEWHFIGNLQSNKVKPLIAGVPNLAMVETVDDEKIANHLNRVVGSFERKPLKVLVQVNTSGEESKSGVEPSGCVELVKHVSLNCPNLQFCGLMTIGMPDYTSTPENFKTLANCRSEVCKALGIPEEQCELSMGMSSDFELAIEMGSTNVRVGSTIFGAREYPKKN

SEQ ID NO: 1138 - protein, 386 aa, Gossypium hirsutum
MTTTKKNMLPPGLVNNLQEVLLSRKGGNSNTNNDEQQQKPDAVTDSTETSTSASDENDNSKPVVLVTNGEGIYSLGLVYLVQALVRSGLYNVHVCAPQSDKSVSSHSVTVRETITVTPAEIDGATAYEVSGTPVDCVSLALSGALFSWSKPLLVISGINRGSSCGHHMFYSGVVGGAREALVSGVPSLSISLNWKREESQESDFKDAVAVCLPLITAAIRDIEKGVFPKSCFLSIEIPTSPSANKGFKLTKQSMWRSAPNWLAVSANRHPSSAAHFMSNQQSLGLQLAQLSRDASAAGAARRVSAQRQNVEVESVGAVKSDTNKVKKYFRLEFINKEQEEAEEDLDFKALDNGFVAVTPFSLCPQIEVDIQTAASDWISGALQVEQ

SEQ ID NO: 1139 - protein, 211 aa, Gossypium hirsutum
MAISHVPYYLSKLPSPLFNCRLAAKRISEFSMENPQHPEGKEACESNPTNVKRVSDDIMPHLLNLYGSRVTPRDFEIYAADASFEDPLMCAHGVKQIKSSFYSLSKVFSESRIVEYSINEKEISAGKHEILVDNKQQYKFLGRNIDMISLIRLFVKDGKVVRHEDWWDKKPLRNRETVKLPCVGRMIELTRRGSMFVTHALMGFGKDPPTG

SEQ ID NO: 1140 - protein, 137 aa, Gossypium hirsutum
MAAEEGKTADAQFFHLLSNLLHQVEALTNQEEVELRSKIEALGLEVTKVPSMSTHSLDELEIARELDKLSAKLDGVDEMISSAMAADPQVRSLLSGTADLWMPVITANADERHNLAASISTDNNPLGNNEDDIKPDN

SEQ ID NO: 1141 - protein, 1137 aa, Medicago truncatula
MSSLSRELVFLILQFLDEEKFKETVHKLEQESGFFFNMKYFEDEVHNGNWDEVEKYLSGFTKVDDNRYSMKIFFEIRKQKYLEALDKHDRSKAVEILVKDLKVFATFNEELFKEITQLLTLENFRENEQLSKYGDTKSARAIMLVELKKLIEANPLFRDKLQFPNLKNSRLRTLINQSLNWQHQLCKNPRPNPDIKTLFVDHSCGQPNGARAPSPANSPLLGSLPKAGGFPPLGAHGPFQPNPAAVPTQLAGWMSNPTTVAHAAVSGAGAIGLGAPSMPGALKHPRTPPINPSVDYPSGDSDHVAKRTRPMGITDEVNLPVNVLSGTFPGHGHSQAFNAPDDLPLPKTVMRTLNQGSSPMSMDFHPVQQSLLLVGTNVGDIALWEVGSREKLVSRNFKVWDLSACSMPFQAALVKDPSVSVNRVIWSPDGALFGVAYSRHIVQIYSYHNGDDVRQHLEIDAHVGGVNDLAFSHPNKQLCVITCGDDKTIKVWDAVSGTKQYTFEGHEAPVYSVCPHYKENIQFIFSTALDGKIKAWLYDNLGSRVDYDAPGRWCTTMAYSADGTRLFSCGTSKDGESSIVEWNESEGAVKRTYQGFRKRSMGVVQFDTTKNRFLAAGDDFSIKFWDMDNIQLLTTVDADGGLPASPRIRFNKDGTLLAVSANDNGIKIVANADGIRLLRTLENNSMYDASRAAELAKPTINSMSSAAAATSAALAERASSVAAIAGMNGDTRSMGDVKPRISEEANDKSKIWKLTEINEPSHCRSLKLPENVRVNKISRLIYTNSGNAILALASNAIHLLWKWPRNDRNSSGKANASVPAQLWQPSSGILMTNDIADSNPEDSVPCFALSKNDSYVMSASGGKISLFNMMTFKTMTTFMPPPPAATFLAFHPQDNNIIAIGMDDSSIQIYNVRVDEVKSKLKGHTKRITGLAFSHVLNVLVSSGADAQICVWNTDGWEKQKTRFLQLPPGRTPSAQSDTRVQFHQDQIQFLVVHETQLAIFEATKLECLKQWAPRDSSAPISHATFSCDSQLIYASFLDATVCVFNASNLRLRCRINPPAYLPASVSNSNVQPLVIAAHPHEANQFAVGLSDGGVHVFEPLESEGKWGVPPPNENGSSSNNVAVATSVGLSSDQAQR

SEQ ID NO: 1142 - protein, 622 aa, Medicago truncatula
MVEEAPPSSLISLCIDHLANQLLFGEDEVIAIIPVIYELPSHLLDDLISRLTPHALYHFHLHTPFQDVNEEDFSRDDSTNNKRKRSRDWNLNTAWQKLFELRWPDLINQIQPTDWQKAYWEAHLQNCLDEAAEIALISPFKGRLADINISESILRHIGFVRLAEHEYDIYSKLSYHCLQFGSHVSCLRLQNILCSAETTRLLRECKLQSMVVRCIRSVEQVNGLCRLITQHSRTLTSLEFIHCTLYENFLNTLLDSVVRKSVHKYALQKHGLQHLSIVSSSFGQCTGSLPTGLQSLLSSARSMCSLKLCGSRLGRNFAKALFVTLLSVSSCISVLDLSENEISGCLSHFNRRLPSDLRESHVGIGESLQLLRVLNLRGNNLRKDDAENLGYAFAYMPNLEDLDISDNPIEDEGLRYLIPYFAGTSEMCSRLACLKLEACDLSCGGVNHLLDSLPVLNGTLKSLSIAENCLGSKVAGPLGRFLSTPIEVLDASGIDLLPSGFLELQNMLTIEEELSLVTINISKNRGGIQTARFLSKLLPQAPRLVDVNAASNCMPIESLSIISSALKFAKAAGNVLNLDLTGHEWDYTPELTSLCTEFVHNGKPILMLPVSSATAAPIDHDP

SEQ ID NO: 1143 - protein, 292 aa, Glycine max
MRKKLDTRFPAARIKKIMQADEDVGKIALAVPVLVSKALELFLQDLCDRTYEVTLQRGAKTMNSLHLKHCVQSYSVFDFLRDIVSRVPDYGHGHGHGHSEAGADDRALPKRRKAVGDDGNDSDEEAKRSKMRELGHTGTPGRGRGRGRGRGRGRGARTIERDICHQQVESEPCTSILQSSNDIPNTSVPIDNGLQSKELPKENFVISEESTQSFRNIDLNANLNENEDKNAGTAVPASLPEPTSMDTAMEIKHEEIPGWSLSDVDKMGIDTMQLANLGSRLEEDEEDYDEEG

SEQ ID NO: 1144 - protein, 338 aa, Glycine max
MAGNPATTSSSALSPEKFNFNFSPDNPSRITLTSDQVNHCTQALNILKEKLHAPNVITQEFAHLQANRITPSEMRRRCTVAYDDVNLRKNRYTDVLPFDKNRVVLKSSTDYRPEAQGYINASLVSTSSAGNVSQFIATQGPLQHTYEDFWEMIIQYHCPAIIMLTRLVDNYKMAKCGDYFQAEDRPREVGNISIIGKWENTTETSLVLRHLEVNHREVEDAPLSVLHIQYPEWPDHGVPKDTFAVREILKRLYHLPPNFGPIVVHCSAGIGRTGTYCTIHNTIQRIVAGDMSAVDIAKTIAMFRSQRIGMVQTQDQYIFCYNAIIDELEDLVSQQQSE

SEQ ID NO: 1145 - protein, 125 aa, Glycine max
MAGRFRELMKKYGKVALGVHLSVSTASITGLYVAIRNNVDVESILEKFHMGTVSEGQNPNPNHSDGAAAPPKNRTAQLAASAGGAFTLAILCNKALFPVRVPITVALTPPIARFLARRKIIKSGV

SEQ ID NO: 1146 - protein, 461 aa, Glycine max
MANRPDPDIDDDFRELYKEYTGPLGTATTNMQERAKSNKRSNAGSDEEEEARDPNAVPTDFTSREAKVWEAKSKATERNWKKRKEEEMICKLCGESGHFTQGCPSTLGANRKSQDFFERIPARDKNVRALFTEKVLSKIEKDVGCKIKMDEKFIIVSGKDRLILAKGVDAVHKIREEGDQRGSSSSQMTQSRSPERSPVSARFQRSEPQRSHSGPRNTSQFQQRFGRQERAVEDRIRDDVQKFSRGSPQAYGNSGARGRSSQSRSPRHAPYTGNSYNSFDDRNQNMGAYRNEGWDSHRRESGIQPGHQFDYNASPQTLEELELEYKNEATELMKIRDREEDEENFKHREAIRDLREKYMSKVSLVRVTHAKQLEEFLQLDAQRRRQQVSQQMSSGYRGFKQQSFPEYDGSTANPPTYAGSNIPLESRNRFSGNMETYPNRPHDNFGEFHRRGDFAKAYNRY

SEQ ID NO: 1147 - protein, 417 aa, Solanum lycopersicum
MASLVQFLPLFPFFFLVSFCVSHGPFLPKAIILPVNKDPSTFQYVTQLYMGATHRAPIKLVVDLEGSFLWADCGLTSDSSSQKLVPCNSLKCSMAKPNGCTNDNKICGLKSENPFTRLAATGELAEDMFAVEFIDELKTGSVASIHQFLFSCTSSTLLQGLARGAKGMLGLGNSRIALPSQLSDTFGFQRKFAICLSSSNGAIISGESPYLSLLSHDVSRSMLYTPLISSRNGVSEEYYINVKSLKINGKKLSLNTTLLTMDGEGQGGTRISTISPFTTMKTSIYKTFVEAYERFGFSMGLTKVEPIAPFGLCFSTKLEEGLNVPSVDLVLQSEMVKWRIYESNSMVKVSDEVMCLGFLDGGANQKASIVIGGHQLEDNLLEFNLGTSMLGFTSSLSMVETSCSDFMFSKDSSPFDS

SEQ ID NO: 1148 - protein, 165 aa, Solanum lycopersicum
MENLLGLMRVRIHRGINLAIRDVTTSDPYVVVRMGKQKLKTRVVKKNLNPEWNEELTLSITEPILPIKLHVYDKDIFSLDDKMGDAEVDIQPFIDAARKRYKNIPSGTIITKIKPSRQNCFSEESSIVWENDQVVQNVFIRLRNVERGEIELQLQWIDIPGSKGV

SEQ ID NO: 1149 - protein, 482 aa, Solanum lycopersicum
MPGPTMESEFPVEPQSLKKLSFKSLKRSLDLFSPIHGHFPLPDPESKKVRTSYKLNVEYGGIKGSAAEPNAKAGVQHQAQPASAPSNTLALPGPENTRDEKTGNELALGPSIPGNGPTDVRFSGKSNAVVPSHGSSERNLSTAAIMERIPSRWPRPIWRAPWKNYRVISGHLGWVRSVAVDPSNTWFCTGSADRTIKIWDLASGRLKLTLTGHIEQVRGLAVSNKHTYMFSAGDDKLVKCWDLEQNKVIRSYHGHLSGVYCLALHPTIDILFTGGRDSVCRVWDIRSKMQIHALSGHDNTVCSVFTRPMDPQVITGSHDSTIKFWDLRYGKTMATLTHHKKSVRAMAQHPTEDCFASASADNIKKFSLPKGEFMHNMLSQQKTIVNAMAINNDGVMVTGGDNGSMWFWDWKSGHNFQQSQTIVQPGSLDSEAGIYALTYDVTGSRLISCEADKTIKMWKEDETATPETHPLHFKPPKDIRRF

SEQ ID NO: 1150 - protein, 354 aa, Solanum lycopersicum
MIQNPKQLILSTFHIHTTVPKKKWNPFSMAISTSFCRPISSFNALSSPSLCYFKPLYNHLKLDPSLPLVKCCSSHIGQSPEHINGRQPDLSPIASFGVTMTNNGTSKPSYRWRRVLLKVSGEALAGDQAQNIDPKITMAIAREVAAVTRLGIEVAIVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVYDDNPKHNPNARLQDNLTYHDVISKELSVMDLTAITLCQENNIPVVVFNLNKTGNIAKAIKGERVGTLIGDTWNTEAVVS

SEQ ID NO: 1151 - protein, 472 aa, Solanum lycopersicum
MDMKVLKWQFIHGSLVKRLIVKGFLFVTVMIVVSFVQMTHMIQKSEPIMLNFGVCPLNFGSNEYMNVTGFVKPVSGLGISLFGASLMKRDDEKLTKDVFKELMEKDFLDLNANALCVGKKSSFAALVLRELGLLSAVGVDAHPYFSLVWRRFMYELDHENNSFDFVFSRDLDKVTVPALMVLEIERVLRPGGTGVMLVGSSSFYAGNLVKGNLIRSATPVSSFLKSSDVVHVCGVGTYTLVMFKKRSEIVQSLVHSVLPANCPSNVNNKPYLKHLEPLVEKKLGQFETQISYLPKFMNISSRNKLVYINVGAGEFVESTLARTFKPHYPIPHHLFNVFVIDHNTSTLSLYVKNPGINFVYHPGLAVAGETTLSSVDTDEYLGAPLDHEGFDFIHWFSETVKDGDYVILMMNARAPELNILAELFQTGSICHVDELFLRCSAADCRNALCGDCMSLFKTLRRSGVFAHQWWGD

SEQ ID NO: 1152 - protein, 1075 aa, Solanum lycopersicum
MAKKQNDSSRFSTNLTPSPQKDKPISSSSELALFYPQNEEPVPLIVFYPSSVRRRSSRFTTNKFSTSATEFMTKNRDTISPEKTVFLLPSPPTLAGKKTPAEVTRRSPRLVSLSARTTTAKEKGKKVNSRKSEGGIKQVELSRKRKPASCKMDEETRKSPRFNSDSSNGVQLALPEMSACGALSAGGRTGTKRELLALMTTTPANSSASRKRAARGSDSVNVGNNSRGSRRKDPVFAESPGTSVKITAESNSAGEKNLRSRKAQGSVNYNESKGSETKRIKSSAEKSVRKQKSNACFIGEPIDTEEAQQQWQWRYELKNRKTQRQGWKLNSGEEDEIILNVECHYAQAKVAGFIFNIGDCAFVKGEGKKKHIGRILEFFKTTEGEDYFRVQWFFRAEDTVLQGAASFHDPKRVFYSTLENDNLLDCIVSKVNVVELPTRHDLNKKDVPPAHFYYDMEYCVDYSTFRTLHNVKSSVSPSLVDVSYKPITTYPLEVSPSCEPMKVELSLLDLYAGCGGMSMGLCLGTKLSGLNLVTKWAVDFNKAACDSLKLNHPQTHVRNEGVENFLELLKRWEKLIKSYGCSDIKTSSNIELDDRDEGENNDDSQSGSNASSGEYEVLRFVDICYGDPNNDGKSGLHFKVRWKGYGPSEDTWEPIENLKNCGDSIKDFVRRGQQLKILPLPGDVDMICGGPPCQGISGYNRHRNTDDPLSDEKNRQIIIFMDVVEFLRPKYVLMENVADILRFDKASLGRYALSRLVHMRYQARLGTMAAGCYGLPQFRLRVFFWGALPSERLPPFPLPSHDVIVKYWPSPEFERNTVAYEEGQPRDLEEALVLRDAISDMPAVTWHETREERPYEMPPETEFQKYIRLSKHEILSCTSTGVKETKEPVLSDHRPCQLNEDDYLRVCLVPRRKGANFRDLPGVIVGGDNVARRDTKDPKVLPNGKPMVPDCAFNFEHGKSKRPFARLWWDETVATLVTFPNHRAQAILHPEQDRVLTIREYARLQGFPDFYRFTGTLKERYCQVGNAVAVPVGRALGYALGLAYQRLAGNEPLIKLPSNFSFLTPPIDDIVVLQT

SEQ ID NO: 1153 - protein, 2210 aa, Solanum lycopersicum
MSIASSSVLQSKNNGVVMSSPVKSLVGHQLNAMPLGRVGVGLGRTRVTRSSVVKRTTGFEKKFYGAKLRASGPERLHLWQSDGPGRAPKLRVVVRSALSQVPEKPLGLYDPSFDKDSCGVGFVAELSGESSRKTVADAIEMLVRMSHRGACGCETNTGDGAGILVGLPHDFYKEVTSEAGFEIPPPGQYAVGMFFLPTSDSRREQSKIVFTKVAESLGHTVLGWRPVPTDNSGLGKSALQTEPIIEQVFLTPTPRSKVDFERQMYILRRVAMVAIRAALNLQHGGVKDFYVCSLSSRTVVYKGQLKPNQLKEYYFADLGNERFTSYMALVHSRFSTNTFPSWDRAQPMRVLGHNGEINTLRGNVNWMRAREGLLKCKELGLSKTEMKKLLPIVDASSSDSGAFDGVLELLLRAGRSLPEAVMMMIPEAWQNDKNMDPSRKALYEYFSALMEPWDGPALMSFTDGRYLGATLDRNGLRPGRFYVTYSGRVIMASEVGVVDIPPEDVSRKGRLNPGMMLLVDFENHVVVDDDALKKQYSLARPYGQWLKKQKIELKDIVESVNYSYRVPPPIAGVLPAVSDEDSMENMGLHGLLAPLKAFGYTTEALEMLLLPMAKDGVEALGSMGNDAPLAVMSNREKLTFEYFKQMFAQVTNPPIDPIREKIVTSMQCMVGPEGDLTETTEEQCHRLSLKGPLLSIEEMEAVKKMNYRGWRSKVLDITYSRDRGTKGLEETLDRICSEAHDAIQEGYTAIVLSDRGFSPKRVAVSSLLAIGAVHHHLVKKLERTRVALIVESAEPREVHHFCTLVGFGADAICPYLAVEAIWRLQVDGKIPPKSTGEFHSKDELVKKYFKASHYGMMKVLAKMGISTLASYKGAQIFEAVGLSSEVMERCFNGTPSRVEGATFEALAKDALNLHGLAFPSRALAPGSAEAVALPNPGDYHWRKGGEIHLNDPFAIAKLQEAAQSNSVAAYKEYSKRVQELNRQCNLRGLLKFKEGEVKVPLEEVEPASEIVKRFCTGAMSYGSISLEAHATLAIAMNKIGGKSNTGEGGEQPSRMEPLPNGTKNPKRSAIKQVASGRFGVSSYYLTNADELQIKMAQGAKPGEGGELPGHKVIGDIAVTRNSTAGVGLISPPPHHDIYSIEDLAQLIHDLKNANPGARVSVKLVSEAGVGVIASGVVKGHADHVLISGHDGGTGASRWTGIKSAGLPWELGLAETHQTLVANDLRGRTVLQTDGQLKTGRDVAIAALLGAEEFGFSTAPLITLGCIMMRKCHKNTCPVGIATQDPILREKFAGEPEHVINFFFMLAEEVREIMSQLGFRALTEMVGRSDMLEMDNDLVKNNDKLKNIDLSLLLRPAADIRPEAAQYCIQKQDHGLDMALDNNLIALSKAALERSLPVYIETPICNVNRAVGTMLSHEVTKRYHLAGLPTDTIHIKLSGSAGQSLGAFLCPGITLELEGDSNDYVGKGLSGGKIVVYPPKGSKFDPKENIVIGNVALYGATSGEAYFNGMAAERFCVRNSGAKAVVEGVGDHGCEYMTGGTVVVLGKTGRNFAAGMSGGVAYVLDLHSTFHSHCNPELVDLDKVEEEEDIMTLKMMIQQHQRNTNSQLAKEVLADFDNLLPRFIKVFPRDYKRVLASMKKEEAYEAAKERAIKEAEEQEEEELKEKDAFEELKKLAAASKDESSQVEEEQTLKRPIQVAEAVKHRGFVAYERQGVSYRDPNVRMEDWKEVMEESKPGPLLTTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPSERTGRRVAIVGSGPSGLAAADQLNRLGHTVTVFERADRIGGLMMYGVPNMKTDKIDVVQRRVDLMEKEGVKFVVNANIGNDPAYSLDSLREDHDAIILAVGATKPRDLPVPGRELSGVHFAMEFLHANTKSLLDSNLQDGKYISAKGKKVVVIGGGDTGTDCIGTSIRHGCTSVVNLELLPQPPNTRAPGNPWPQWPRIFRVDYGHQEAAVKFGKDPRSYEVLTKRFIGDENGNVKGLEVIRVQWEKDASGRFQFKEVEGSEEIIGADLVMLAMGFLGPESTIADKLGLEKDNRSNFKADYGRFSTSVEGVFAAGDCRRGQSLVVWAISEGRQAAAQVDKFLMKDDEDSSADAASQQESVKKQPTVVT

SEQ ID NO: 1154 - protein, 16 aa, Zea mays
MAKYNVVQKNKRQCNQ

SEQ ID NO: 1155 - protein, 16 aa, Zea mays
MKALASPAASFLPGIP

SEQ ID NO: 1156 - protein, 16 aa, Zea mays
MKHLHLSSSLPLLLHR

SEQ ID NO: 1157 - DNA, 1604 bp, Oryza sativa
gccgctactagtaggtgctagtctcgcctcgagcccaaatccagcctgctcgcgtcggccgatcgatcgatcataccacgggccgattcgtggctcgcgccgcgcggctggggtctaagctagggtttacgctcgcgaaaaaaaaaaagaaaagtgttgagcgaataatttgctcctagacctttgctgcttctcccctgtcgataaagccgaccacactgctcgcgtccccccgcgccgttcttttcggagattccgctcgcgcgcgccgccgccgccgcagccgcccgccggggagcccgggacgaggatggaggtcgtcgtggcgaggcagccgaaggcgaagaagcagataaacctcttctactgctccgagtgcgaggagctcgcgctcaaggtcgccgctagctccgacgccatccatctccagtccatcaactggaggagcttcgacgacgggttccccaacctgttcatcaacaacgcgcacgacatccgggggcagcacgtggcgttcctggcgtcgttcagctcgccgtcggtcatcttcgagcagatctccgtcatcttcgcgctgcccaagctgttcatcgcctccttcacgctcgtgctgcctttcttccccacgggctccttcgagcgcgtcgaggaggagggcgacgtcgccaccgcgttcaccctcgcgcgcatcctctccatgattcccaagtcccggggcggcccgaccagcgtcgtcatctacgacatccacgcgctccaggagaggttctacttcggggacgacgtcctcccctgcttcgagaccgggattccgctcctgctgcagcgcctccggcagctccccgatgctgacaatatcaccattgccttcccggatgatggggcgtggaagcgtttccacaagctattgctcaacttcccaatggttgtctgcgcaaaggttcgggaaggtgacaagaggatagttcgaattaaggaggggaatcctgaaggccggcatgtggttattgttgatgatttagtgcaatctgggggaactcttagagaatgtcagaaagttttggctgctcatggtgctgcaaaagttagtgcttacgtgactcatgctgtttttcccaagcagtcgtatgagcgcttcactcacactaattccgctgggtcagctgacaagtttgcgtatttctggatcactgactcctgccctcaaacagtgaaagccatcaaccaacaacctccatttgaggtgttgagccttgctggttcgattgcggatgcccttcaaatatgaactttgtttttggtaatgggctactcccatttttcctaaatgttagagttcactttcagctccagtaaaaacaaataatgtggagtgagttatcttaattatggctttggcctgacgtcttcataaacatctcaatatgtgatggtaaaataaggcatttgatgctcatctgttccttcttgagcaaagcgcacacaatcactgctttatttcctgacatgtatactactggaggctgagcacatctgcacaagtgctcgttttttgtcttgctcccgaaaaaagcgcttatttctgtcttaatattgatatgact

SEQ ID NO: 1158 - DNA, 1422 bp, Theobroma cacao
tcaagaaaataaaaatgtaaagtaaagaaagggctggcggtcgcagtcgactcctgttctcggttttcctttaaaatcttcgtctctctatctaaactctaaagtctccttcttcttttttgattctgagaagctaaacaagagaaaacaaggaagaacaaaaatggagaacaacaacaacatgggagagttgaaggcccagaatcagaataagaagcacgttcgtttgttttactgtatggaatgtgaagagcttgccgctaaagttgctgctcaatcccaactcattacccttcaatctatcaactggaggaattttgatgatggatttccaaatcttttcataaataatgcacatgatatccgaggccagcatgttgcctttcttgcatccttcagctccccatctgtcatttttgaacagctttctgtcatatacaatctgccgcgattgtttgttgcttccttcacattggtgctgccattctttccaactggctcctttgagagaatggaagaagaaggagatgtagcaactgcatttaccatggcaaggattttgtcaaatattcccatatcaagaggtggtcctacaagtttagtcatttacgacatccatgctctgcaggaaagattttattttggagaccatgtgttgccattatttgagactgggattcctcttctaaagcaacgccttcaccagcttcctgacgctgaaaagatagttgttgcatttccggatgatggagcttggaaacgatttcacaagctgttggatcattttccaatggttatctgcacaaaggttcgtgagggtgacaagaggatagttcggctcaaggagggaaatcctgctggttgtcatgtggtgatagttgatgacttagtgcaatctggaggcactcttattgaatgccagaaagttttggtagcgcatggtgcagcaaaggttagtgcttatgtcacccatggtgtttttcctaagcgctcctgggagcgatttacacctaagaatgatgaagggtcagagaagggatttgccttcttttggatcacggattcttgcccacacactgtgaaagccataggaaacagagctccttttgaagttctgagtcttgcaggatccattgctgatgctttacaaatttaaggagatattacatatcaactcttttctcagacaagtctgtagatttctttaagcagtcatcattttaattttaactttcttctctctatataaaatttctcaactccaaaattgctaaaaattatctgttaagactcttgattgaagcactacatgtgaggcacacaagtgcaacaaattcttcaaattacaacaataccagcatagagaataaatattctgccattacaaagatgaatcaggctatagtattattgcaaacatgt

SEQ ID NO: 1159 - DNA, 2665 bp, Sorghum bicolor
gagagcgcgtccatctccctcctccctccctcgccgcgccgcgcttccttctcgactcccatgtcccgtcttctcctcccaatttcacgcctccgcttataaataccggcattccggggcacccggcctcgacaagcccaccacgccgcccccccactccacccgcctagggctccgcgccgtccccgaggacaggaggacgcgggcattgccgatccaaacgcgccgccgcgtcaacttttcccgccaactcacctccgccgccgcgtgaactcgcctccgccgccgctccgaaactgattatggatctgctaaggcatcccttcaagggagttgtcactgatatcaaaggaagggccacttggtacaagcatgattgggttgcaggagtccactctggctttaggatattggcacctaccatgtatatcttctttgcctctgctcttcctgtcattgccttcggagcacaactgagcacagcaacaaatggtatactcacaacagttgaaacattggcatcgactgcgatatgtggcatcatacattcaattcttggagggcagcctttactgattgttggagttgctgaaccaactattatcatgtacacttatctctacaactttgccaagaatcaacaagctctgggtgagaagctatatttggcgtgggctggatgggtctgcatctggactgccatcatgttgtttcttttggcaatgttcaatgcttccaacgttattagcagatttacaagggttgcaggagaactttttggcatgttaatcactgttctgttcttgcaagaagctatcaagggaatgattagcgaatttagtgtgcccgaagatgctgacagcagttcaccaatataccaattccagtggctgtatgtcaatggcctacttggtgtcatattttcaattggcttgctgtatactgcattgaggaccaggcgggcaaggtcatggctatatggcataaggcggcttagaagctttatagctgattacggcgtcccacttatggtgattgtgtggacagcattgtcgtatacactgccaggcaagctgccttcaggagtccccaggaggcttttctctccacttccctgggagtcaagttcacagggacactggaccatagcaagggatttgttttccgtccctccagcgtatatacttgcagccattctgcctgctttgatggttgcaggactttacttctttgatcatagcgtagcttcacagttggcacagcaaaaggagtataatttgaagaagccttctgcctaccactatgacattttggtccttggaatcatggtcctgctgtgcggtttgcttggcatccctccatctaatggagtccttcctcagtctcccatgcacacaaaaagtcttgctgtccttaagaggcagttgctaagcaaaaagatggttgatactgccaaggatagcatagggagaagtgctaccactttggaaatatatggcaagatggaagaaattttcatcgaaatggatagcgaacagaatactggttctgttgacaaggagttgaagaactttaaggatgctgttctgcaagaaggcaatgaagaagggaaattggctagagaatttgaccctcggaaacatatagaagcccacttgccggttcgagtgaatgaacagagattgagtaatctgctgcaatccatattggttggtggttgtgttggagctatgccagttatcaggatgataccaacatcggttctctggggttactttgcctacatggccattgacagtctaccagggaatcagttctgggagaggatacagcttttgttcgttgcagaaagccgactctacaaggttcttgaaggtccccatgcatcttttgtggagtcagtggttcccaaaacaataaccatcttcacgatctttcagttggtttacctcctaatatgctttggaataacatggataccgatagccgggatcctgttcccagtgcctttctttctaatgattctcatcaggcagtatctcctccccaaattttttgatcccatcgtcttgagggaactcgatgcagctgagtatgaagaacttgatgggatcgcccttgaacacaatctggaagatgaagtatctgaggtagcaagctgtcctagccgtcctgatgcagagatattggatgaactcacaaccaatcggggagaggtaaaacacagaacttcaagcctgcgtgaagaaagaccaattcaggttgctacaaatgcggttcagccaagcctgtgaagacataaagtgttttttttttctgtagagggatgatcctcaagctgcattccgttgatgtgaatactgttgctatgtaatgtactgctactactactgctagtgttgtacttgggtttttgacccaaacgcatctgtggggaaggtgtaatttgtaagaactggtgtttatagcgtagactacataggagcgacaggaaggggaagggccgaaagggaacgaggtagaataattatcaatgcagagtctcatatttgttgaatagactgtagtaaccaagtccttcagtacatgatcatcaatgcagagtctcatatttgttgagtttacatttagcttgctctcttggactgcaatcgcgtcagtaaag

SEQ ID NO: 1160 - DNA, 2890 bp, Setaria italica
ctgcgcttggcttctccttctccccctcccccatgtctcgtctcctcccaatttgacgcgttcatttataaataccggcattcacgggactcgagcagcccaccacgccgcggccccgaccgccgcctccgcctccctccgcccgcctagggatccgcgcccgcgtttgaggagaggagggcccagcattgccgatcgatccacacgcgcctcctccccgcgccgactagcgcgccgcgcccgcccgccccgccgccgccctgcaaccgattatggatctactaaggaatcccttcaagggagtcatcgctgatatcaaaggaagggcagcttggtacaggcatgattgggttgcaggactccgttctggatttaggatattggcgcctaccatgtatatcttctttgcctctgcacttcctgtcattgccttcggagaacaactgagcacggcaacaaatggtatactcacaacagtagaaacattggcatctacggcgatatgtggcatcatacattcaattcttggagggcagcctttgttgattgttggagttgccgaaccaactattatcatgtacacttatctctacaactttgccaagaagcagcaaggcctgggagagcagctatatttggcgtgggctggatgggtctgcatctggactgccatcatgttgtttcttttagcaatgttcaatgcttccaacgttattagcagatttacaagggttgcaggagaactttttgggatgttaatcactgttttgtttttgcaagaagcaatcaaggggatcataaatgaatttagtgtgcctgaagatgcagatagcagctcgccaatataccaattccagtggctgtatgtcaatggcctacttggtgtcatattttccattggtttgctgttcactgcattgagaaccaggcgagcaaggtcatggctttatggagtagggtggcttagaagcttcatagctgactacggtgtcccacttatggtaattgtgtggacagcattgtcatataccctcccaagcaaggtgccatcaggagtccccaggaggcttttctctccacttccctgggagtcaagttcgctgggacactggaccatagtgaaggatttgttttctgtccctccggcatatatatttgcagccattctgcctgctctgatggttgcaggactttacttctttgatcatagcgtagcttcacagttggcgcagcaaaatgagtataatttgaagaaaccttctgcctaccattatgacattttggtccttggaatcatggtcctgctctgcggtttgattggcatccctccatcaaatggagtccttcctcagtctcccatgcacacgaggagtcttgctatccttaagagacagttgctaagcaaaaagatggtcgatactgccaaggagagcatagggaaaagtgctactagtttggaaatatatggcaagatgcaagaagttttcatcgaaatggatagcgaacagaatactgattctgttgacaaggagttgaagaactttaaggatgctgttcttcaagaaggtgatgaagaggggaaattggctggagaatttgaccctcggaaacatatagaagcccacttgcctgttcgagtgaatgaacagagactgagtaatctgctgcaatccatattggttggtggttgtgttggagctatgccagtcatcaggatgataccaacatcggttctctggggttactttgcctacatggccattgacagtctaccagggaatcagttctgggagaggatgcaacttttgttcattgcagaaagccgacactacaaggttcttgaaggtcctcatgcatcttttgtggagtcggtgcctcccagaacaataaccatcttcacagtatttcagttggtttacctcctgatatgcttcggcataacatggataccgatagcgggtatcctgttcccagtgcctttcttccttatgatactcatcaggcagtatctcctgccaaagttttttgatccaatcgtattgagggaactggacgcagctgagtatgaagaacttgatggcgtcccccacgaacacactctggaggatgaagtatccgaggcaggaagctgcattagccgtcgagatgctgagatattggatgagctcacaaccaaccgcggagagctaaagcacagaacttcaagcctgcgcgaagaaagatcggttcaggttccgtcaaatgccgttcagccaagactctgaagataggaaagtgttttatctgtagagtgatgatcctcaagctgcggtccgttgaggtgaatactgttgctacgtaatgtaccactagtggtgttgtacttgggcttttaacccaaacgcatctgtatggaaggtgtaatttgtaagaacatgcagttagcgtaactaggagtgattggaaagacagaagggatatgaaagggaaatggctgaacgggaacgtagtagaatcatatcattagttaaatagactgtacggcaagaccttactttgttgtgtggctcacagattatcaatgcagcgagtcattgttatcaagttgcattagcttgatctcttcgactgtacaatcgtgtcagtatttgtgaactcttgattttgtgcacaaagtgcgcgtgaatgtgaagattgattttgtgcataaagtgcgcctggttgtgaagattatagacaacgaagaacctagctctttttttttagatctaacgaagaacctagctgaaaagtgctctcgggatttctgcaggctgccgaaaagagaatcgcgcgacgacacaatgggccgtcgccccgcgcacggtagcctctcccgcggcccagcaccaatccaccatattatcggctc

SEQ ID NO: 1161 - DNA, 2538 bp, Brachypodium distachyon
ccaaccgcgccgctcgtaacacacccgccgccgcctagggttctccgctcccgcgccgaggagaagccggcattgccgatccgacccgccgttccccctgccgccgccgcccttaaccgtcgatggatttactaaggaaccccttcaagggagtcgtcgccgatgtcaaagggagagcatcttggtacaaggacgactgggttgctgggctccgtgctggtttcaggatattggcccctaccatgtatatcttttttgcctctgcactccccgtcatcgcctttggagagcagctgagcagagaaacaaatggtatgctgagcacagttgaaacattggcatccaccgcgatatgtggggtaatacattcgattcttggagggcagccattgttgattgttggagttgcagaacctaccattatcatgtatacgtatctctacaactttgccaaggaggaggcaggtttgggagaacagctatatttggcttgggctggatgggtctgtatttggactgctatcatgttgttttttctggcaatgttcaatgcttccaatgtgattagcagatttacaagggttgcaggagaactatttgggatgttgatcactgttctgttcctgcaacaagcaatcaagggaattgtaagtgagttcagtttgcctaaagcggctgaaattgttgaccgcagttcactgatatatgatttccagtggatatacgtcaatggcctgcttggtgtcattttttcaattggcttgctatacactgcattgaagagtaggcgggcaaggtcatggctgtatggcataggatgccttagaagcttcattgccgattatggtgtcccgctaatggtgattgtgtggacagcattatcgtacacactaccaagcaaagtcccttcaggagtgcctcggaggctcttcagtccacttccctgggagtcaagttcactgggacattggaccgtagcaaaggatctgttttctgtccctccggcatttatatttgcagccatcgtgcctgctttgatggttgcagggctttatttctttgaccacagtgtagcttcacagttggcgcagcaaaaggagttcaatttgaagaagccttctgcctaccattacgacattttggtacttgggttcatggtactactatgtggtttgattggcatccctccatcaaatggagtacttcctcagtccccaatgcatacaagaagccttgctgtcctcaagggtcagttgatgcgcaacaagatgctccaaactgccaaagagggcatgacgaaccgtgctagcagtttggaaatatatggcaagatgcaggaagttttcatccaaatggatagagaaaagaatactgattctgttgacaaggagttgaagagtttgaaggatgctgtgctgagagaaggcgacgaagaaggaaaattggctggagaatttgatccaagaaaacatatcgaagcccatttgcccgttcgggtaaatgaacagagactgagtaacttgctgcaatccttactggttggtggctgtgttggggctatgccagttatcaagatgataccgacttctgtcctctggggttactttgcttacatggcaattgatagcctacctggtaaccaattttgggaaaggataaagcttctgttcatcggatcaacccgacgctacaaggtcctggaaggtccacatgcatctttcgtggagtcagtgccttcaaaaacaatatctgtcttcacgatcttccagctggtctatctcttgatatgcttcggcacaacatggataccaatagcagggatcctcttcccagtgcctttctttctcatgattctcatcaggcagcacctactcccaaagtttttcgatcccaatcacttgagggaactagacgctgcagagtatgaagaacttgaaggggtccagaacgaacacacgctggaggaagatggctctatttcaggaagctgtgacagcaggaacgatgccgagattctggatgaactcacaacaaaccgtggagagctaaagcacagatccgtaagccaccgtgaagaaaggcaccttcaggtgcattcaaacgccgttcagccaagcgtgtgaagataggaaaatacctccagtactgtagctttccagcttattctatcagaagtgtagaatatatccccagctagcagttcattgctgatggaacatgatattgtcgattaatttgtataatactgtagcaaaagttttgcgcccataagccatgattaattgtgtgtggtaagtaagatcgggcgattagcagaagacaatatataaggggcaacacggtgaaaaaaatataggatatgaaaagcggaactgtgcgctaggatagtacagtgtatgagtttgcgatggaagattagcacgttaggtaacgctgcgaatccgttgttctgtgaactgtaagttgccggttgtacttaggtggttctgtttgactgcaacaaaattgatatttttatgagaagcagtaaattaactt

SEQ ID NO: 1162 - DNA, 2497 bp, Oryza sativa
gcgtctccgccaccaccctctaactctagggtttcgctcccgcgccgtcgagcggccagcattgccgccgccgccgccacgcgcgccatcgatttgctcgacgactgatcttctgtttagtctcgagctaagtacagctgatggatctactaaggactccctttaagggagtcgtcgctgatatcgaaggccgagtagcttggtacaagcatgactgggttgctggattccgctctggcttcaggatattggcacctaccatgtatatcttctttgcctctgccctcccagtcatcgccttcggagcgcaactgagcagagaaacaaatggtatactcaccacagtagaaacactggcatctactgcattatgtggcatcatacattcaattcttggagggcagcctctgttgatagttggagttgcagagccaactataatcatgtacacgtatctctacaactttgccaagaaccagcaagctctgggggaacgactgtatttagcatgggctggatgggtctgcatctggactgcgctcatgttgtttcttctggcaatgttcaatgcttctaatgttattagcaggtttacaagggttgcaggagaactttttgggatgttgattactgttctgttcctgcaacaagccattaaaggaattatagaagaattcaaggtgcctagagatgcagaccatagttcacctatatatcaattccagtggctgtatgtcaacggcctgcttggtgttatcttttcaattgggctgttatacactgcattaaggtcaagaagggcaaggtcatgggtgtatggtcaagggtggctcagaggcttcattgctgattatggtgtcccacttatggtgattgtttggacagcattctcgtacacgttaccaaaggatgttccttcaggagttcctaggaggctgttcagtccacttccctgggagtcgagttcactgcaacattggacggtagcaaaagatctgttttcagttcctccagcatacatatttgctgccattctgccggctttgatggttgcaggactttacttctttgatcatagcgtggcttcacaattggcgcaacaaaaagagtttaacttgaagaaaccctctgcctaccattatgacattttggtcctcggattcatggtcctgctttgtggtttgatcggcatccctccatctaatggagtacttcctcagtctccgatgcatacaagaagccttgcagtccttaaggggcagctgctacgcaaaaagatggttcaaactgccaacgaaggcctgatgaatcgtgctagcagtttggaaatctatggcaagattcaaggggttttcatcgagatggactgcgaaaaaaatactgattctgttgacaaggagttaaagagcttgaaggatgctattctgcaagaagttgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggctattgacagtctacctggcaaccagttttgggaaaggttaagacttatattcatcccatcaagccgacgctacaaggttcttgagggtccccatgcctctttcatggaatcagtgccttcaaaaacaattattgtcttcacgatcttccagttggtttacctcttgatatgcttcggcattacgtggataccaatagcagggatcctgttcccgctgccattcttccttatgattcttatcaggcagcatgtcctcccaaagttttttgagccaaatgaccttcgggaattggacgcagctgagtatgaagagcttgaaggtgtccaccacgatcacacgctggaggatggtgaatctgattcaggaagctgtggcagccgtgacgacgctgagatatttgatgagctgacaactaaccgtggagagctaaagcacagaacttccagccaccgtgaagaaaggcacctgcaggtgcattcaaacgccattcaacccaggtgtggagatactgaaaactggtccgagtgctaatgaatttctgcttattctgtcggatgagtatattataggcgtatatagcacttcctcaagcagcggtccgttgtattatatacataatacattcatactttcatatacatcgtactgtagctggagatcggccgtacgatatgacatgcttgtacgttgtcaacttgtcacattgtgcatgcagtaaacagaagcaactggattttactgaaggtctgtaaggctgtgtgacatgtagatttcaatgttctctagcctgtgaattgttgctcctagattgttctgtttgattgtaaaattgcatggcaatcaatatggaatatagatgtggagtttgg

SEQ ID NO: 1163 - DNA, 2426 bp, Oryza sativa
ggtttgaggagccaaccccgccccgcgccgccccgccgcggccgcgtcgtctcctccgccacctccacgtctagggttcccctccgccgtcagcattgcccgccggagcttctggttagtattgagtggaattcagctgatggaactactaaagattccctttaagggtgtcgtcgctgatatcgaaggccgagcagcttggtacaagcatgattggcttgagggattccactctggcttcaggatattggcacctactatgtatatattttttgcctctgccctcccagtcatagccttcggaacgcaactgagcagagaaacaaatggtatactcaccacagtagaaacactggcatctactgcaatatgtggcatcatccattccattcttggagggcagcctctgttgatagttggagttgcagagccaactataatcatgtacacgtatctctacaactttgccaagaaccagcaagctctgggggaacgactgtatttagcatgggctggatgggtctgcatctggactgcgatcatgttgtttcttctggcaatgttcaatgcttctaatgttattagcaggtttacaagggttgcaggagaacttttcgggatgttgatcactgttctgttcctgcaacaagctattaaaggaattatagaagaattcaaggtacctggaggtgtcgaccatagttcacctatatatcgattccagtggttgtatgtcaacggcctacttggtgtaatcttttcaattgggctgttatacactgcattaaggtcaagaagggcaaggtcatgggtgtatggtcaagggtggctcagaggcttcatttctgattatggtgtcccacttatggtgattgtttggacagcattatcgtacgcattaccaaaggatgttccttcaggagttcctaggaggctgttcagtccacttccctgggagtcaagttcactgcatcactggaccatagcaaaggacctgttttctgttcccccagcatacatatttgctgccattctgccagctttgatgattgcaggactttacttctttgatcatagcgtggcttcacaattggcgcaacaaaaggagtttaacttgaagaagccctctgcttaccattatgacattttggtcctcggattcatggtcctgctttgtggtttgattggcatccctccatctaatggagtacttcctcagtccccgatgcatacaagaagccttgctgtccttaaggggcagctgctacgcaaaaagatggttcaaactgccaacgaaggcctgatgaatcgtgctagcagtttggaaatctatggcaagatgcaaggggttttcattgagatggactgtgaaaaaaatactgattctgttgacaaggagttaaagagcttgaaggatgctatgctgcaagaaggtgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggccattgacagtctacctggcaaccagttttgggaaagaataagacttatattcatcccatcaagccgacgctacaaggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggaggatggtgcatctgattcagaaagctgtggcagccgtgacgatgccgagatattagatgagctgacaactaaccgtggagagctaaagcacagaactttcaaccaccgtgaagaaaggcacccgcaggcgcatacaaaagccgttcagcccaggtgtggagatacagaaaactggtccgagtgctaaagaatttcggcttactgtcggatgggtatacgataggcatatatagcacttcctcatacattcctactttcctatacatcgcactgtagcaggagatcggcggccgtatgatatgatatgcttgtcagttgtcacattgtgcatggagtaaacagaagcaactggattttacgatgttctctagcctgtgaaatgttgctccttgattgttctgttcgattgtaaaattgcatggcaaatcagatgtggggagtagcacttcatgttt

SEQ ID NO: 1164 - DNA, 1530 bp, Arabidopsis lyrata
gttacccacatttctttcattctatcctaaatcctcatcactcaacctgagctcacaaaactaaacaaacaaaagagcttaggcggagaagaagagggaaccaaaaacaccaaacaaacaacaatggctgtctcaactatctactcaacacaagctcttaattcaactcatttcttaacctcttcttcctcttccaaacaagtcttcctctaccgtcgtcaaccacaaaccaaccggagattcaacacactcatcacttgcgcacaagaaaccatcgtgatcggactagctgccgactctggctgcggcaaaagtacctttatgcggaggctcaccagcgtctttggtggcgctgctaagcctccaaaaggcgggaaccctgattccaacacactcatcagcgacacgaccactgtgatctgtcttgacgattaccattccttggacaggtacggtcgcaaagagcaaaaagtcaccgctttggacccacgagctaatgactttgatctcatgtatgagcaagtcaaagctcttaagagtggtgttgccgttgagaaaccgatatataaccatgtcactggacttcttgacccgcctgagcttattcagcctcctaagattcttgtcatcgaaggtcttcacccaatgtttgatgagagagtaagagacttactagacttcagtatctacttagacattagcaacgaagtcaaattcgcttggaaaattcagagggacatggctgaaagaggtcacagtttggagagcatcaaagcgagtattgaagcccgaaagcccgacttcgatgcattcatcgacccgcaaaagcagtatgcggatgcggtcattgaagtgcttcctacgacgctgatcccagacgacaacgaagggaaagtgttgagagtgagactaataatgaaggaaggagttaagtacttcagcccggtttatctgtttgatgaaggttcaacaatctcgtggatcccttgcggccgcaaactcacttgctcgtaccctggcatcaagttcaactacgaacctgattcatacttcgaccatgaggtatcggttttggagatggatggacagtttgatagactggacgagctgatttacgtggagagtcacttgagcaacctctcgaccaaattctacggcgaagtcactcaacaaatgctcaaacatgctgacttcccgggtagcaacaacgggactggtctattccaaaccattgttggattgaagatcagagacctctatgagcagctcattgccaacaaagccactgctcgtgcagaagctaaagcctaaaacaaacaaagagaagccaaatagaacgcgtcgataaatccatccgcagtttcttcttttcttatttctttctttctttatgcgttgtttaccgcggattttcatggcgaaaaggacggtcttgcttgttttgtaatttgtgtggagataaaaagaaaaagcctgtaatgtagagaagtgaatagcagagcaataacagttcagtttatagaacgcctt

SEQ ID NO: 1165 - DNA, 1715 bp, Arabidopsis lyrata
acaaccacattaaaccaaaacaaaacaaaataaaactcattttcctctctgcaaattgccatctgtttttcctatagacccattgtcctcctctcatttctctctttccccatttaatctttattcaaaaaaaaaaaaaaaaccacatctttatatcaccacacaaaaacccataaaatcaaaaatcgttacccacatttctttcattctatcctaaatcctcatcactcaacctgagctcacaaaactaaacaaacaaaagagcttaggcggagaagaagagggaaccaaaaacaccaaacaaacaacaatggctgtctcaactatctactcaacacaagctcttaattcaactcatttcttaacctcttcttcctcttccaaacaagtcttcctctaccgtcgtcaaccacaaaccaaccggagattcaacacactcatcacttgcgcacaagaaaccatcgtgatcggactagctgccgactctggctgcggcaaaagtacctttatgcggaggctcaccagcgtctttggtggcgctgctaagcctccaaaaggcgggaaccctgattccaacacactcatcagcgacacgaccactgtgatctgtcttgacgattaccattccttggacaggtacggtcgcaaagagcaaaaagtcaccgctttggacccacgagctaatgactttgatctcatgtatgagcaagtcaaagctcttaagagtggtgttgccgttgagaaaccgatatataaccatgtcactggacttcttgacccgcctgagcttattcagcctcctaagattcttgtcatcgaaggtcttcacccaatgtttgatgagagagtaagagacttactagacttcagtatctacttagacattagcaacgaagtcaaattcgcttggaaaattcagagggacatggctgaaagaggtcacagtttggagagcatcaaagcgagtattgaagcccgaaagcccgacttcgatgcattcatcgacccgcaaaagcagtatgcggatgcggtcattgaagtgcttcctacgacgctgatcccagatgacaacgaagggaaagtgttgagagtgagactaataatgaaggaaggagttaagtacttcagcccggtttatctgtttgatgaaggttcaacaatctcgtggatcccttgcggccgcaaactcacttgctcgtaccctggcatcaagttcaactacgaacctgattcatacttcgaccatgaggtatcggttttggagatggatggacagtttgatagactggacgagctgatttacgtggagagtcacttgagcaacctctcgaccaaattctacggcgaagtcactcaacaaatgctcaaacatgctgacttcccgggtagcaacaacgggactggtctattccaaaccattgttggattgaagatcagagacctctatgagcagctcattgccaacaaagccactgctcgtgcagaagctaaagcctaaaacaaacaaagagaagccaaatagaacgcgtcgataaatccatccgcagtttcttcttttcttatttctttctttctttatgcgttgtttaccgcggattttcatggcgaaaaggacggtcttgcttgttttgtaatttgtgtggagataaaaagaaaaagcctgtaatgtagagaagtgaatagcagagcaataacagttcagtttatagaacgcc

SEQ ID NO: 1166 - DNA, 1555 bp, Eutrema halophilum
cacacaaaaacccataaatcaaaaatcgttacccacatttctttcattctatcctaatattcatcactcaaccttagctcacaaaaccaaaaaagaaaaaaacagagagcttaggcggagaagaagaggaagcaggaaccaaacaacaacaatggctgtctcaacaatctactcaacacaagctctcaactcaactcatttcttaacctcttctccatcttcttcctcctcgaaacaagtcttcttctaccgtcgtcaatcccaaaccaaccgtagattcaacacaatcatcacttgcgccgcacaacaaaccatcgtgatcggactcgccgccgactccggatgcggcaaaagcaccttcatgcggaggctcacaagcgtcttcggcggcgccgccgagccaccgaaaggcgggaaccccgattccaacacactcatcagtgacacgaccactgtgatctgtctcgacgactaccattccttggacaggactggtcgcaaagagaaaggagtcactgctttggacccacgcgccaatgactttgatcttatgtatgagcaagtcaaagctctcaagagtggtgtcgccgtcgagaaaccgatttataatcacgtcactggacttcttgatgcgcctgagcttattcagcctcccaagattctcgtcatcgaaggtcttcacccaatgtttgatgagagagtaagagacttgttggacttcagtatctacttagacattagcaatgaggtcaaattcgcttggaaaatacagagggacatggctgaaagaggtcacagtttagagagcatcaaagcaagtatcgaagcccgaaagccggacttcgatgcattcattgacccgcaaaagcagtatgcagatgcagtcatagaagtgcttcctacacagctgattcctgacgacaatgaaggcaaagtgttgagagtgagattgataatgaaggaaggtgttaaatactttagccctgtttacttgttcgatgaaggttcgaccatctcgtggatcccttgcggtcgcaaactcacctgctcgtaccctggcattaagttcaactacgaacctgattcctacttcgaccatgaggtttcggttttggagatggatgggcaattcgatagactggacgagctgatttacgtggagagtcatctgagcaacctctcgaccaaattttacggtgaagtgactcaacaaatgctcaagcatgctgatttccctggtagcaacaacgggactggtcttttccagaccattgttggattgaagatcagagatctctatgagcagctcattgcaagcaaagccactactcgtgcagaagctgctaaagcctaaaagacaacaatgcaaaatagatacccgtcgatatatccattcgcagtttctttctttctttctttggctttatgtgtttgtttacccgcggattttcataaaggacggtcttgcttgtttgtaatttgtgtggagattaaaaaaaaaaaagcctgtaatgtagagaaggtaatagcagagcaataacaattcagttcatac

SEQ ID NO: 1167 - DNA, 1554 bp, Eutrema parvulum
cacacaaaaacccataaatcaaaaatcgttacccacatttctttcattctatcctaatattcatcactcaaccttagctcacaaaaccaaaaaagaaaaaaacagagagcttaggcggagaagaagaggaagcaggaaccaaacaacaacaatggctgtctcaacaatctactcaacacaagctctcaactcaactcatttcttaacctcttctccatcttcttcctcctcgaaacaagtcttcttctaccgtcgtcaatcccaaaccaaccgtagattcaacacaatcatcacttgcgccgcacaacaaaccatcgtgatcggactcgccgccgactccggatgcggcaaaagcaccttcatgcggaggctcacaagcgtcttcggcggcgccgccgagccaccgaaaggcgggaaccccgattccaacacactcatcagtgacacgaccactgtgatctgtctcgacgactaccattccttggacaggactggtcgcaaagagaaaggagtcactgctttggacccacgcgccaatgactttgatcttatgtatgagcaagtcaaagctctcaagagtggtgtcgccgtcgagaaaccgatttataatcacgtcactggacttcttgatgcgcctgagcttattcagcctcccaagattctcgtcatcgaaggtcttcatccaatgtttgatgagagagtaagagacttgttggacttcagtatctacctagacattagcaatgaggtcaagttcgcttggaaaatccagagggacatggctgaaagaggtcacagcttagagagcatcaaagcaagtatcgaagcacgaaagcctgacttcgatgcattcattgacccgcaaaagcagtatgcggatgcggtcattgaagtgcttcctacacagctgattccagatgacaatgaaggcaaagtgttgagagtgagattgataatgaaggaaggtgttaaatactttagccctgtttacttgttcgatgaaggttcaaccatctcgtggatcccttgcggtcgcaaactcacctgctcgtaccctggcattaagttcaactacgaacctgactcctacttcgaccatgaggtttcggttttggagatggatgggcaattcgatagactggacgagctgatttacgtggagagtcatctgagcaacctctcgaccaaattttacggtgaagtgactcaacaaatgctcaagcatgctgatttccctggtagcaacaacgggactggtcttttccagaccattgttggattgaagatcagagatctctatgagcagctcattgcaagcaaagccactactcgtgcagaagctgctaaagcctaaaagacaacaatgcaaaatagatacccgtcgatatatccattcgcagtttctttctttctttctttggctttatgtgtttgtttacccgcggattttcataaaggacggtcttgcttgtttgtaatttgtgtggagattaaaaaaaaaaaagcctgtaatgtagagaaggtaatagcagagcaataacaattcagttaata

SEQ ID NO: 1168 - DNA, 2654 bp, Eutrema halophilum
aaccacactaaatcatatcaaaatcaaaacaaaacaaaactctttttttcttctttgcaaattgccatttgttttcctacaaacccattttcatcctctcatttctctctttcccccataaaaaaaaaaccccatttatttttttatttgaagaaaaaccacatctttacatcaccacacaaaaacccataaatcaaaaatcgttacccacatttctttcattctatcctaatattcatcactcaaccttagctcacaaaaccaaaaaagaaaaaaacagagagcttaggcggagaagaagaggaagcaggaaccaaacaacaacaatggctgtctcaacaatctactcaacacaagctctcaactcaactcatttcttaacctcttctccatcttcttcctcctcgaaacaagtcttcttctaccgtcgtcaatcccaaaccaaccgtagattcaacacaatcatcacttgcgccgcacaacaaaccatcgtgatcggactcgccgccgactccggatgcggcaaaagcaccttcatgcggaggctcacaagcgtcttcggcggcgccgccgagccaccgaaaggcgggaaccccgattccaacacactcatcagtgacacgaccactgtgatctgtctcgacgactaccattccttggacaggactggtcgcaaagagaaaggagtcactgctttggacccacgcgccaatgactttgatcttatgtatgagcaagtcaaagctctcaagagtggtgtcgccgtcgagaaaccgatttataatcacgtcactggacttcttgatgcgcctgagcttattcagcctcccaagattctcgtcatcgaaggtcttcacccaatgtttgatgagagagtaagagacttgttggacttcagtatctacttagacattagcaatgaggtcaaattcgcttggaaaatacagagggacatggctgaaagaggtcacagtttagagagcatcaaagcaagtatcgaagcccgaaagccggacttcgatgcattcattgacccgcaaaagcagtatgcagatgcagtcatagaagtgcttcctacacagctgattcctgacgacaatgaaggcaaagtgttgagagtgagattgataatgaaggaaggtgttaaatactttagccctgtttacttgttcgatgaaggttcgaccatctcgtggatcccttgcggtcgcaaactcacctgctcgtaccctggcattaagttcaactacgaacctgattcctacttcgaccatgaggtttcggttttggagatggatgggcaattcgatagactggacgagctgatttacgtggagagtcatctgagcaacctctcgaccaaattttacggtgaagtgactcaacaaatgctcaagcatgctgatttccctggtagcaacaacgggactggtcttttccagaccattgttggattgaagatcagagatctctatgagcagctcattgcaagcaaagccactactcgtgcagaagctgctaaagcctaaaagacaacaatgcaaaatagatacccgtcgatatatccattcgcagtttctttctttctttctttggctttatgtgtttgtttacccgcggattttcataaaggacggtcttgcttgtttgtaatttgtgtggagattaaaaaaaaaaaagcctgtaatgtagagaaggtaatagcagagcaataacaattcagttcatacaatgcttatgtcgatccatcaaagtttcttcctttaatgcatccaaggagaattcagaagccaaagaagagaaaagcttcttcctattgatcgtaatcatgttttgaatcttaaatagacacattggttctttttatacaaaatgcacagttgaaaacttccttaaagatccatataagaaagcatagaaattatacaaaacaaaacactaatcccattcttttagaactccaccaatcactactttgggtaccaaaacatgcctttaatgccttctggatcagcttcaaaccccaaattctgatagaaatccacaactgcaaactccccaccaaaaaagagacaaattcaacaactgtgaaagaacaaatccaaacctttaattacaaaattgtagcttaggttggtttgatatttatcaccttggctatctgcaaaaagagagatatttccaatatccttttgaagaagagcccttacaagtttttctacaagagctttaccaagcccttgaccctgaagaacaaaacaaaaacacaattaaacttaaaacacaaagcaaaaaccttttggttacctgatattcaggatcaacaagaacatcccagattgtagcattaaaggcatgatccgacgtcgcacgtgccattccaataagcttcttctgctgcttctgctggtcattatcgccttctgtgtcaaataacttctccaaaatccgctaagatgttcatcaaaacatcctctttgtggtatatttcctttgttaatggaatcaagaaaagagctaacgtaattgaagcacctgataaatctgaatctgaaggtgacgacttcaagacagaatgcaatgtagccaccatataactattcttcaaagctgcagctagtttcgataacggtcttcgaggccaccccaccttt

SEQ ID NO: 1169 - DNA, 1429 bp, Brassica napus
cagagagcttaggcggagaagaagaggaagaggaacaaatcaccagcagcaatggctgtttcaacaatctactcaactcaagctctcaattcaactcatttctttacctcctcctcctcctccaaacaagtcttcttctaccgtcgccaaaccaaccgtagattcaacaccatcatcacttgcgccgcacaacaaaccgtggtgatcggactcgctgccgactccggatgcggcaaaagtaccttcatgcggaggctgaccagtgtcttcggtggagccgccgagccaccaaagggagggaaccctgactccaacacactcatcagtgacatgaccactgtgatctgcctcgacgattaccattccttagacagaaccggtcgcaaagagaaaggagtcactgctttggacccacgcgccaatgactttgatctcatgtatgagcaagtcaaagctctcaagagtggtatcgccgtcgagaaacccatttataatcacgtcactggacttcttgacgcacctgagcttattcagcctcccaagattctcgtcatcgaaggtcttcacccaatgtttgatgagagggtaagagacttattggacttcagtatctacctagacattagtaatgaggtcaagttcgcttggaaaattcagagggacatggctgaaagaggtcacagcttagagagcatcaaagcgagtatcgaagcacgaaagcctgacttcgatgcattcattgacccacaaaagcagtacgcggatgcggtgatagaagtgcttccaacacagctgattccagatgacaatgaaggcaaagtgttgagagtgaggttgataatgaaggaaggtgttaagtactttagcccggtctacctattcgatgaaggttcaaccatctcgtggatcccttgcggccgcaaactcacctgctcgtaccctggtatcaagttcaactacgcacctgattcctacttcgaccatgaggtttcggttgttgagatggacgggcaattcgatagactggacgagctgatttatgtggaaagccatctgagcaacctctcgaccaaattctacggggaagtgactcaacaaatgctgaaacatgctgatttccctggtagcaacaatggaactggacttttccagaccattgttggattgaagatcagagatctctatgagcagctcattgccaacaaagcaactgctcctgcagaagctgctaaagcctaaaacaaaaaccaaattataacccgtctataaacccgtttgcagtttcttctttctttcttttatggattcttttttcatggcgaaaaggactatcttgctttggtttgtaatttatgtggagatggtaacagaaaattctgtaatgtagagaagttaatagcaaagcaataaaaaattaaattaacacaat

SEQ ID NO: 1170 - DNA, 1671 bp, Brassica juncea
ctctcatttatctccttatatcaccacacaacaacccataaatcaaaactcgttacccacaattcttacattctatcctaatcctcatcactcaaaccaaagcagggagagcttaggcggagaagaagaggaagaggatccccaaacatcaacaacaatggctgtctcaacaatctactcaacacaagctctcaattcaactcatttctttacctcctcctcctcctcaaaacaagtcttcttctaccgtcgtcatcaatcccaaaccaaccgtagattcaacacaatcatcacttgcgctgcacaacaaaccgtcgtgatcggactcgccgccgactcaggatgcggcaaaagtaccttcatgcggaggctgaccagtgtcttcggtggcgccgccgagccaccaaaaggagggaaccctgactccaacacactcatcagtgacatgaccactgtgatctgtctcgacgattaccattctttagacaggactggtcgcaaagagaaaggagtcactgctttggacccacgcgccaatgactttgatctcatgtatgagcaagtcaaagctctcaagagtggtatcgccgtcgagaaacccatttataatcacgtcactggacttcttaacgcacctgagcttattcagcctcccaagattctcgtcatcgaaggtcttcatccaatgtttgatgagagagtaagagacttattggacttcagtatctacctagacattagtaacgaggtcaagttcgcttggaaaatccagagggacatggctgaaagaggtcacagtttagagagcatcaaagcaagtatcgaagcacgaaagcctgacttcgatgcattcattgatccacaaaagcagtacgcggacgcggtgatagaagtgcttcccacacagctgattccagatgacaatgaaggcaaagtattgagagtgaggttgataatgaaggaaggtgttaagtacttcagccctgtttacctattcgatgaaggttcaaccatctcgtggatcccttgcggtcgcaaactcacctgctcctaccctggcatcaagttcaactacgaacctgattcctacttcgacaatgaggtttctgttgtggagatggatgggcaattcgatagacttgacgagctgatttacgtggagagccatctgagcaacctctcgaccaaattctacggtgaagtgactcaacaaatgctcaaacatgctgacttccctggtagcaacaacggaactggtcttttccagaccattgttggattgaaaatcagagatctctatgagcagctcattgccaacaaagccactgctcctgcagaagctgctaaagcctaaaacaaataagcaaaacagaacctgtcgataaacccattcgcagtttcttctttctttcttgctctatgcattgtttcctgcggattttcatggcgaaacggacggtctttcatggtttgtaatttgtgtggagatggtatgtagagaagttcatagcagagcaataattattcagttaatacaatccatctcaagtttcctcatttacagcatcaaacctttaagcaaaagaagaaaaggtttcttctattgattatattcatgtttgatcttaaatagacaaatattgatttagagttacaaaatgcacagttagt

SEQ ID NO: 1171 - DNA, 1452 bp, Brassica napus
tctactcaacacaagctctcccaaaacaaacaaaacagagagcttaggcggagaagaagaggaagaggaaccaatcaccaacaacaatggctgtctcaacaatctactcaacacaagctctcaattcaactcatttctttacctcctcctcctcaaaacaagtcttcttctaccgtcgccaaaccaaccgtagattcaataccatcatcacttgcgccgcacaacaaaccgtggtgatcggactcgctgccgactccggatgcggcaaaagtaccttcatgcggaggctgaccagtgtcttcggtggagctgccgagccaccaaagggagggaaccctgactccaacacactcatcagtgacatgaccactgtgatctgcctcgacgattaccattccttagacagaaccggtcgcaaagagaaaggagtcactgctttggacccacgcgccaatgactttgatctcatgtatgagcaagtcaaagctctcaagagtggtatcgccgtcgagaaacccatttataatcacgtcactggacttcttgacgcacctgagcttattcagcctcccaagattctcgtcatcgaaggtcttcacccaatgtttgatgagagggtaagagacttattggacttcagtatctacctagacattagtaatgaggtcaagttcgcttggaaaattcagagggacatggctgaaagaggtcacagcttagagagcatcaaagcgagtatcgaagcacgaaagcctgacttcgatgcattcattgacccacaaaagcagtacgcggatgcggtgatagaagtgcttccaacacagctgattccagatgacaatgaaggcaaagtgttgagagtgaggttgataatgaaggaaggtgttaagtactttagcccggtctacctattcgatgaaggttcaaccatctcgtggatcccttgcggccgcaaactcacctgctcgtaccctggtatcaagttcaactacgcacctgattcctacttcgaccatgaggtttcggttgttgagatggacgggcaattcgatagactggacgagctgatttatgtggagagccatctgagcaacctctcgaccaaattctacggggaagtgactcaacaaatgctgaaacatgctgatttccctggtagcaacaatggaactggacttttccagaccattgttggattgaagatcagagatctctatgagcagctcattgccaacaaagcaactgctcctgcagaagctgctaaagcctaaaacaaaaaccaaattataacccgtctataaacccgtttgcagtttcttctttccttcttttatgtattttttttttcttggcgaaaaggactatcttgctttggtttgtaatttatgtggagatggtaacagaaaattctgtaatgtagagaggttaatagcaaagcaataaaaaattaaa

SEQ ID NO: 1172 - DNA, 2524 bp, Brassica rapa
gggagactaaaaacttatctaaaacaaacatcacatagtgttaacttgaggaaatcaaaacatgagccactcattacagaccacatcagatcaaaaccataactcatttgccatttgtttcctatagactcatttgcctcctctcatttgttttcacatctttacatcaccacacaaaaacccatatttctttcatcatatccaaatcctcatcactcaaccaaagctctcccaaaacaaaacaaaaacagagagcttaggcggagaagaagagtcaccaacaacaatggctgtctcaacaatctactcaacacaagctctcaattcaactcatttctttacctcctcctcctcctcaaaacaagtcttcttctaccgtcgccaaaacaaccgtagattcaacaccatcatcacttgcgccgcacaacaaaccgtggtgatcggactcgctgccgactccggatgcggcaaaagtaccttcatgcggaggctgaccagtgtcttcggtggagccgccgagccaccaaagggagggaaccctgactccaacacactcatcagtgacatgaccactgtgatctgcctcgacgattaccattccttagacagaaccggtcgcaaagagaaaggagtcactgctttggacccacgcgccaatgactttgatctcatgtatgagcaagtcaaagctctcaagagtggtatagccgtcgagaaacccatttataatcacgtcactggacttcttgacgcacctgagcttattcagcctcccaagattctcgtcatcgaaggtcttcacccaatgtttgatgagagggtaagagacttattggacttcagtatctacctagacattagtaatgaggtcaagttcgcttggaaaattcagagggacatggctgaaagaggtcacagcttagagagcatcaaagcgagtatcgaagcacgaaagcctgacttcgaagcattcattgacccacaaaagcagtacgcggatgcggtgatagaagtgcttccaacacagctgattccagatgacaatgaaggcaaagtgttgagagtgaggttgataatgaaggaaggtgttaagtactttagcccggtctacctattcgatgaaggttcaaccatctcgtggatcccttgcggccgcaaactcacctgctcgtaccctggtatcaagttcaactatgcacctgattcctacttcgaccatgaggtttcggttgttgagatggacgggcaattcgatagactggacgagctgatttatgtggagagccatctgagcaacctctcgaccaaattctacggggaagtgactcaacaaatgctgaaacatgctgatttccctggtagcaacaatggaactggacttttccagaccattgttggattgaagatcagagatctctatgagcagctcattgccaacaaagcaactgctcctgcagaagctgctaaagcctaaaacaaaaaccaaattataacccgtctataaacccgtttgcagtttcttctttccttcttttatggattttttttttcatggcgaaaaggactatcttgctttggtttgtaatttatgtggagatggtaacagaaaattctgtaatgtagagaagttaatagcaaagcaataaaaaattaaattaatacaatatatccattttaaagtttcctcatcaaaccttttttgaagcaatggaaagaaaggtttcttcctattgatcatatactcatgtttgaatcttaaatagacaaatatcgatttcgagttacaaaatgcacagttagtaaacttccttattgacccgacccatataataagaaagcatacagccaaacagtaaagtcccattcttttgcaaacacaccaactgctactttgggtaccaaaacatgcctttgatgccttctggatcagcctcaaaccccaagttttgatagaaatccacaactgcatgacaaactcaataactcttaaaaaagaagaagtgttgattacaaaagtttgtatggtgatttgatatttgtattattaccttgactatctgcaaaaagagatatattaccaatatctctctgaagaagagcccttacaagcttttccacaagagctttaccaagcccttgaccctgaaaaccaaaaacaacacttattaacaacatcccaaaaaactagttatttgttttggttacctgatactcaggatcaacaagaacatcccaaattgtagcattaaaggcatgatccgacgtggcacgtgccattccaataagcttcttattctgctgctgctgctgctgctcattatctccttctgtgtcaaataacttctccaaaatccgctaagatattcatcaaaacatcggatgaatgaagattaaggttacttgaatgaagcacctgatgatgatgatgatggcttcaatacagaatgcaatgtagcaaccatataactattcttcaaagctgcagctagtttcgttagcggtctccgaggccatcccaccttta

SEQ ID NO: 1173 - DNA, 1820 bp, Eutrema parvulum
aactacattacaaagtattttactccaagaaaccaaaacatgagccactcattacacaaccagattaaatcaaaataaaacaaaactccttttctcctttgcaaattgccatttgtttcctatagacccattttcctcctctcatttctctatttccccatataaaaaaacaccatttatttttattttaagaaaaaatcacatctttatatcaccacacaaaaacccataaatcaaaaatcgttacccacatttctttcattctatcctaatcctcatcactcaaccaaagctcccaaaaaaaagaaaaacagagagcttaggcggagaagaagagaaagaggaatcaaaccatcaacaacaatggctgtttcaacaatctactcaactcaagctctcaattcaactcatttcttaacctcttctccttcttcttcctcctcaaaacaagtcttcttctaccgtcgtcatcaatcccaaaccaaccggagattcaacacaatcatcacttgcgccgcacaacaaaccgttgtgatcggactcgctgctgactccggatgcggcaaaagtaccttcatgcggaggctgaccagtgtcttcggtggcgccgccgagccaccaaaaggagggaaccctgactccaacacactcatcagtgacatgaccactgtgatctgtcttgacgattaccattccttagacaggaccggtcgcaaagagaaaggagtcactgctttggacccacgcgccaatgactttgatctcatgtatgagcaagtcaaagctcttaagagtggtatcgccgtcgagaaacccatttacaatcacgtcactggacttcttgacgcgcctgagcttattcagcctcccaagattctcgtcatcgaaggtcttcatccaatgtttgatgagagagtaagagacttgttggacttcagtatctacctagacattagcaatgaggtcaagttcgcttggaaaatccagagggacatggctgaaagaggtcacagcttagagagcatcaaagcaagtatcgaagcacgaaagcctgacttcgatgcattcattgacccgcaaaagcagtatgcggatgcggtcattgaagtgcttcctacacagctgattccagatgacaatgaaggcaaagtgttgagagtgagactgataatgaaggaaggtgttaagtactttagccctatttacctatttgatgaaggttcaaccatctcgtggatcccttgcggccgcaaactcacctgctcgtaccctggcatcaagttcgactacgcacctgactcctacttcgaccatgaggtttcggttttggagatggatgggcaatttgatagactagacgagctgatttacgtggagagtcatctgagcaacctctcgaccaaattctacggtgaagtgactcaacaaatgctcaaacatgctgatttccctggtagcaacaatgggactggtcttttccagaccattgttggattgaagatcagagatctctatgagcagctcattgccaacaaagcaactgctccagcagaagctgctaaagcctaaacaaagaagagacaaaaaacgagaagcgaaatagaacccgtcgataaatccatttgcagtttcttcatctttctttctttctttctttctttatgtgttgtttccccgcggattttcatggcgaaaaggacggtcttgcttgtttgtaatttgtgtggagataaaaagaaaagcctgtactgtagagaagttaatagcagagcaataacaattcagttaatataacgcctttatcaatccattaaagtttc

SEQ ID NO: 1174 - DNA, 1443 bp, Brassica napus
aatcctcatcactaaaccaaagctctcccaaaacaaaacaaaaacagagagcttaggcggagaagaagaggaagaggaaccaatcaccaacaacaatggctgtctcaacaatctactcaacacaagctctcaattcaactcatttctttacctcctcctcctcaaaacaagtcttcttctaccgtcgccaaaccaaccgtagattcaataccatcatcacttgcgccgcacaacaaaccgtggtgatcggactcgctgccgactccggatgcggcaaaagtaccttcatgcggaggctgaccagtgtcttcggtggagccgccgagccaccaaagggagggaaccctgactccaacacactcatcagtgacatgaccactgtgatctgcctcgacgattaccattccttagacagaaccggtcgcaaagagaaaggagtcactgctttggacccacgcgccaatgactttgatctcatgtatgagcaagtcaaagctctcaagagtggtatcgccgtcgagaaacccatttataatcacgtcactggacttcttgacgcacctgagcttattcagcctcccaagattctcgtcatcgaaggtcttcacccaatgtttgatgagagggtaagagacttattggacttcagtatctacctagacattagtaatgaggtcaagttcgcttggaaaattcagagggacatggctgaaagaggtcacagcttagagagcatcaaagcgagtatcgaagcacgaaagcctgacttcgatgcattcattgacccacaaaagcagtacgcggatgcggtgatagaagtgcttccaacacagctgattccagatgacaatgaaggcaaagtgttgagagtgaggttgataatgaaggaaggtgttaagtactttagcccggtctacctattcgatgaaggttcaaccgtctcgtggataccttgcggccgcaaactcacctgctcgtaccctggtatcaagttcaactatgcacctgattcctacttcgaccatgaggtttcggttgttgagatggacgggcaattcgatagactggacgagctgatttatgtggagagccatctgagcaacctctcgaccaaattctacggggaagtgactcaacaaatgctgaaacatgctgatttccctggtagcaacaatggaactggacttttccagaccattgttggattgaagatcagagatctctatgagcagctcattgcgaacaaagaaactgctcctgcagaagctgctaaagcctaaaacaaaaagcaaattataacccgtctataaacccgtttgcagtttcttctttctttcttttatggatttttttcatggcgaaaaggactatcttgctttggtttgtaatttatgtggagatggtaacagaaaattctgtaatgtagagaagttaatagcaaag

SEQ ID NO: 1175 - DNA, 1599 bp, Raphanus sativus
ggatcgacccatttgcctcccatctcatttgtttccacatctttgcatcaccacacaaaaaacctacaaaccaaaaatcactacccatatctctttcatcctatccaaatcctcatcactcaaccaaagctaagaaaacagagagcttaggcggagaagaagaggagcaggaaccaaccatcaacaacaatggctgtttcaacaatctactcaacacaagctctcaactcaactcatttcttatcctcttccccttcctcaaaacaagtcttcttctaccgccgtcatcaatcccaaaccaaccgtagattcaacaccatcatcacttgcgccgcacaacaacaaaccgtcgtgatcggactcgctgccgactccggatgcggcaaaagcaccttcatgcggaggctgacaagtgtcttcggtggagcagccgagccacccaagggagggaaccctgactccaacacactcatcagcgacatgaccactgtgatctgtctcgacgattaccattccttggacagaaccggtcgcaaagagaaaggagtcactgctttggacccacgcgccaatgactttgatctcatgtatgagcaagtcaaagctcttaagagtggtatcgccgttgagaaacccatttataatcacgtcactggacttcttgacgcgcctgaactcattcagcctcccaagattctcgtcatcgaaggtcttcatccgatgtttgatgagagggtaagagacttattggacttcagtatctacctagacattagcaatgaggtcaaattcgcttggaagattcagagggacatggctgaaagaggtcacagcttagagagcatcaaggcgagtatcgaagcacgaaagcctgacttcgatgcattcattgacccacaaaagcagtacgcggatgcggtgatagaagtgcttccaacacagctgattccagatgacaatgaaggcaaagtgttgagagtgagattgataatgaaggaaggtgtcaagtactttagccccgtttacctatttgatgaaggttcaaccatctcgtggatcccttgcggtcgcaaactcacctgctcctaccctggcatcaagttcgactatgcacctgattcctacttcgaccatgaggtttcggttgtggagatggatgggcaattcgatagactggatgagctgatttacgtggagagccatctgagcaacctatcgaccaaattctacggtgaagttactcaacagatgctcaaacatgctgatttccctggtagcaacaatggaacaggtcttttccagaccattgttggattgaagatcagagatctctatgagcagctcattgccaacaaagccactgctcctgcagaagctgctaaagcctaaaacacaaggcaaaatagaacccgtctataaagtataaacccctttgcagtttcttcttctctctctttctttttatggatttttcatggcgaaaaggactatttttgctttggtttgtaatttatgtggagatggtaacagaaaattctctaaagtagagaagttaataatagcaaagcaataaaaattaaattaatacaatccaaaaaa

SEQ ID NO: 1176 - DNA, 1463 bp, Brassica juncea
tcactcaaaacagagtgcttaggcggagaagaagaggaagaggaaccaaacatcaagcaacaatggctgtctcaacaatctactcaacacaagctcttaactcaactcatttcttaacctcttccccttcttcctcttcaaagcaagtcttcttctaccgtcgtcaaaccaaccgtagattcaacaccatcatcacttgcgccgcacaacaaaccgtcgtgatcggactcgctgccgactctggatgcggcaaaagtaccttcatgcggaggctaaccagtgtcttcggtggagcagctgagccaccaaaaggagggaaccctgactccaacacactcatcagtgacatgaccactgtgatctgtctcgacgattaccattcgttggacaggaccggtcgcaaagagaaaggagtcactgctttggacccacgcgccaatgactttgatctcatgtatgagcaagtcaaagctctcaagagtggcatcgccgtcgagaaacctatttataatcacgtcacaggacttctcgacgcacctgagcttattcagcctcccaagattctcgtcatcgaaggtcttcatccaatgtttgatgagagagtaagagagttgttggacttcagtatctacctagacattagcaatgaggtcaaattcgcttggaaaatccagagggacatggctgagagaggtcacagtttagagagcatcaaagcaagtatcgaagcacgaaagcccgacttcgatgcattcatcgacccacaaaagcagtacgcggatgcggtgatagaagtgcttccaacgcagttgattccagatgataatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagacttgacgagctgatttacgtggagagccatctgagcaacctctcgaccaaattctacggtgaagtgactcaacagatgctcaaacatgctgacttccctggtagcaacaatggaactggtcttttccagaccattgttggattgaagatcagagatctctatgagcagctcattgccaacaaagccactgctccttcagaagctgctaaagcctaaaacaaataaaagcaaaacaggacgcgtcgataaacccattggttgtttcttcttctttctttctttctttctttatgctttgtttcccgcggattttcatggcgaaaaggacggtgttgcttgtttgtaatttatgtggagatataaaaagaaaatgcctgtaatgtagagaatttattagcagagcaataaaaattcagttaatcg

SEQ ID NO: 1177 - DNA, 1753 bp, Brassica rapa
aacaagattacaaagcatattactcaagtaaaaccaaaacatgagccacacatttttttaaagaaaaaacaaaactcattttcttctttgcatattgccatttgtttcctttagacccattttcctcctctcatttatctccttatatcaccacacaacaacccataaatcaaaactcgttacccacaattcttacattctatcctaatcctcatcactcaaaccaaagcagagagagcttaggcggagaagaagaggaagaggatccacaaacatcaacaacaatggctgtctcaacaatctactcaacacaagctctcaactcaactcatttcttaacctcttctccttcttcctccacctcaaaacaagtcttcttctaccgtcgtcatcaatcccaaaccaaccgtagattcaacacaatcatcacttgcgctgcacagcaaaccgtcgtgatcggactcgcagccgactcgggatgcggcaaaagtaccttcatgcggaggctgaccagtgtcttcggtggcgcagccgagccaccaaaaggagggaaccctgactccaacacactcatcagtgacatgaccactgtgatctgtctcgacgattaccattccttagacaggactggtcgcaaagagaaaggagtcactgctttggacccacgcgccaatgactttgatctcatgtatgagcaagtcaaagctctcaagagtggtatcgccgtcgagaaacccatttataatcacgtcactggacttcttgatgcccctgagcttattcagcctcccaaaattctcgtcatcgagggtcttcacccaatgtttgatgagagagtaagagaattattggacttcagtatctacctagacattagcaatgaggtcaagttcgcttggaaaatccagagggacatggctgaaagaggtcacagcttagagagcatcaaagcaagtatcgaagcacgaaagcccgacttcgatgcattcattgacccgcaaaagcagtatgcggatgcggtgatagaagtgcttccaacgcagctgattccagatgacaatgaaggcaaagtgttgagagtgaggttgataatgaaggaaggtgttaagtacttcagcccggtttaccttttcgatgaaggctcaaccatctcgtggatcccttgtggtcgcaaactcacttgctcgtaccctggcatcaagttcaactacgaacctgatacctacttcgaccatgaggtttcggttttggagatggatgggcagttcgatagactagacgagctgatttacgtggagagccatttgagcaacctctcgagcaaattctacggtgaagtcactcaacagatgcttaaacatgctgacttccctggtagcaacaacgggactggtcttttccagaccattgttggattgaagatcagagatctctatgagcagctcattgccaacaaagccactgctcctgcagaagctgctaaagcctaagaaagcaaaatagaatccatcgataaatccgttcccagtttctttccttctttctttatgcgttgtttcccgcggattttcatggcgaaaaaggacggtctttcttggtttgtaatttgtgtggagatggtcaagaaaaaatatatatatgtagagaagtttatagaagagcaataataatctggttaatacattgatccatcttcctattgatcatactcatatatattttttggtgtaagagcatactcatatttggaaaa

SEQ ID NO: 1178 - DNA, 1801 bp, Brassica napus
gagggtttgggatgtaatcggagaaatgagggacgtcttcgagaacgtaaccggctggaccggtgacgatctttttgtcggagtttaaggcagaggttgccataaccaaccttgtcggagactcgaatctctgattaacgatcaagaggagacccgaatcaaagctcaacgatcgatacttcctaccgagtctagggatcaaagacccgaattgatgatgatgatgatcggttcggaagacgtgctctgttttgaggaggacttgatgaatctttgaagatagtgagggatagagacgatacaagaactgtggagaaacggatcaggtcagtcacggggttgtcgggacccacaattcttacattctatcctaatcctcatcactcaaaccaaagcagggagagcttaggcggagaagaagaggaagaggatccccaaacatcaacaacaatggctgtctcaacaatctactcaacacaagctctcaactcaactcatttcttaacctcttctccttcttcctccacctcaaaacaagtcttcttctaccgtcgtcatcaatcccaaaccaaccgtagattcaacacaatcatcacttgcgctgcacagcaaaccgtcgtgatcggactcgcagccgactcaggatgcggaaaaagtaccttcatgcggaggctgaccagtgtcttcggtggcgccgccgagccaccaaaaggagggaaccctgactccaacacactcatcagtgacatgaccactgtgatctgtctcgacgattaccattccttagacaggactggtcgcaaagagaaaggagtcactgctttggacccacgcgccaatgactttgatctcatgtatgagcaagtcaaagctctcaagagtggtatcgccgtcgagaaacccatttataatcacgtcactggacttcttgatgcccctgagcttattcagcctcccaaaattctcgtcatcgagggtcttcacccaatgtttgatgagagagtaagagaattattggacttcagtatctacctagacattagcaatgaggtcaagttcgcttggaaaatccagagggacatggctgaaagaggtcacagcttagagagcatcaaagcaagtatcgaagcacgaaagcccgacttcgatgcattcattgacccgcaaaagcagtatgcggatgcggtgatagaagtgcttccaacgcagctgattccagatgacaatgaaggcaaagtgttgagagtgagattgataatgaaggaaggtgttaagtacttcagcccggtttaccttttcgatgaaggctcaaccatctcgtggatcccttgtggtcgcaaactcacctgctcgtaccctggcatcaagttcaactacgaacctgatacctacttcgaccatgaggtttcggttttggagatggatgggcagttcgatagactagacgagctgatttacgtggagagccatttgagcaacctctcgagcaaattctacggtgaagtcactcaacagatgcttaaacatgctgacttccctggtagcaacaacgggactggtcttttccagaccattgttggattgaagatcagagatctctatgagcagctcatcgccaacaaagccactgctcctgcagaagctgctaaagcctaagaaagcaaaatagaatccatcgataaatccgttcccagtttctttccttctttctttatgcgttgtttcccgcggattttcatggcgaaaaaggacggtttttcttggtttgtaatttgtgtggagatggtcaagaaaaaatata

SEQ ID NO: 1179 - DNA, 1463 bp, Brassica napus
gtgctttggcggagaagaagaggaagaggaaccaaacatcaagcaacaatggctgtctcaacaatctactcaacacaagctcttaactcaactcatttcttaacctcttccccttcttcctcctcaaaacaagtcttcttctaccgtcgtcaaaccaaccgtagattcaacaccatcatcacttgcgccgcacaacaaaccgtcgtgatcggactcgctgccgactctggatgcggcaaaagtactttcatgcggaggctaaccagtgtcttcggtggagccgctgagccaccaaaaggagggaaccctgactccaacacactcatcagtgacatgaccactgtgatctgtctcgacgattaccattctttggacaggaccggtcgcaaagagaaaggagtcactgctttggacccacgcgccaatgactttgacctcatgtatgagcaagtcaaagctctcaagagtggcatagccgtcgagaaacctatttataatcacgtcactggacttcttgacgcacctgagcttattcagcctcccaagattctcgtcattgaaggtcttcatccaatgtttgatgagagagtaagagacttgttggacttcagtatctacctagacattagcaatgaggtcaaattcgcttggaaaatccagagggacatggctgagagaggtcacagtttagagagcatcaaagcaagtatcgaagcgcgaaagcccgatttcgatgcattcattgacccacaaaagcagtacgcggatgcggtgatagaagtgcttccaacccagttgattccagatgacaatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagactggacgagctgatttacgtggagagccatctgagcaacctctcaaccaaattctacggtgaagtgactcaacaaatgctcaaacatgctgacttccctggtagcaacaacggaactggtcttttccagaccattgtaggattgaaaatcagagatctctatgagcagctcattgccaacaaagccaatgctcctacagaagcttctaaagcctaaaacaaataagcaaaacagaacgcgtcgataaacccattggttgtttcttcttctttctttctttatgctttgtttccgcggattttcatggagaaaaggacggtgttgcgattaccaaaaaaaaaaaggacggtgttgcatgtttgttatttgtgtggagatataaaaagaaaagcatgtaatgtagaaaatttattagcagagcaataacaattaagtta

SEQ ID NO: 1180 - DNA, 1503 bp, Raphanus sativus
  misc_feature (324)..(324): n is a, c, g, or t
  misc_feature (432)..(432): n is a, c, g, or t
  misc_feature (531)..(531): n is a, c, g, or t
  misc_feature (576)..(576): n is a, c, g, or t
  misc_feature (775)..(775): n is a, c, g, or t
  misc_feature (891)..(891): n is a, c, g, or t
  misc_feature (948)..(948): n is a, c, g, or t
  misc_feature (1218)..(1218): n is a, c, g, or t
  misc_feature (1272)..(1272): n is a, c, g, or t
ataaatcaaaactcgttacccacatttcttacattctatcctaatcctcatcactcaaaccaaagcagagagagagcttaggcggagaagaagaggaagaggaggaaccaaacatcaacaaaaatggctgtctcaacaatctactcaacacaagctctcaactcaactcatttcctaacctcttctccttcttcctccacctcaaaacaagtcttcttctaccgtcgccatcaatcccaaaccaaccgtagattcaacacaatcatcacttgcgctgcacaacaaaccgtcgtgatcggactcgcagccgactcaggatgcggnaaaagtaccttcatgcggaggctgaccagtgtcttcggtggcgccgccgagccaccgaaaggagggaaccctgactccaacacactcatcagtgacatgaccactgtnatctgtctcgatgattaccattccttagacaggactggtcgcaaggagaaaggagtcactgctttggacccacgcgccaatgactttgatctcatgtangagcaagtcaaagctctcaagagcggtatcgccgtcgagaaaccnatttataatcacgtcactggacttcttgatgcccctgagcttattcagcctcccaagattctcgtcattgaaggtcttcacccaatgtttgatgagagagtaagagaattattggacttcagtatctacctagacattagcaatgaggtcaagttcgcttggaaaatccagagggacatggctgaaagaggtcacagtntagagagcatcaaagcaagtatcgaagcacgaaagcccgacttcgatgcattcattgacccacaaaagcagtatgcggatgcggtgatagaagtgcttccaacgcagctgattccngatgacaatgaaggcaaagtgttgagagtgagattgattatgaaggaaggtgttaantacttcagcccggtttaccttttcgatgaaggctcaacaatctcgtggatcccttgtggtcgcaaactcacctgctcgtaccctggcatcaagttcaactacgaacctgatacctacttcgaccatgaggtttcggttttggagatggatgggcaattcgatagactagacgagctgatttacgtggagagtcatttgagcaacctctcgaccaaattttacggtgaagtcactcaacagatgcttaaacatgctgacttccctggcagnaacaacgggactggtcttttccagaccattgttggattgaagatcagagatctntatgagcagctcattgctaacagagccactgttcctgcagaagctgctaaagcctaagaaagcaaaatcaaaacccatcgataaatccattttcagtttctttccttctttctttatgccgcggattttcatggcgaaaaaggacggtcttgcttggtttgtaatttgtgtggagatggtcaaaaagaaaaaaatatgtaatgcagagaagtttatatatagcagagcaat

SEQ ID NO: 1181 - DNA, 1484 bp, Brassica juncea
attctatcctaatcctcatcactcaaaccaaagcagagagagcttaggcggagaagaagaggaagaggatccacaaacatcaacaacaatggctgtctcaacaatctactcaacacaagctctcaactcaactcatttcttaacctcttctccttcttcctccacctcaaaacaagtcttcttctaccgtcgtcatcaatcccaaaccaaccgtagattcaacacaatcatcacttgcgctgcacagcaaaccgtcgtgatcggactcgcggccgactcgggatgcggcaaaagtaccttcatgcggaggctgaccagtgtcttcggtggcgccgccgagccaccaaaaggagggaaccctgactccaacacactcatcagtgacatgaccactgtgatctgtctcgacgattaccattctctggacaggactggtcgcaaagagaaaggagtcactgctttggacccacgagccaatgattttgatctcatgtatgagcaagtcaaagctctcaagagcggtatcgccgtcgagaaacccatttataatcacgtcactggacttcttgatgctccagagctcattcagcctccaaagattctcgtcatcgaaggtcttcacccaatgtttgatgagagagtaagagacttattggacttcagtatctacctagacattagcaatgaggtcaagttcgcttggaaaatccagagggacatggctgaaagaggtcacagcttagagagcatcaaagcaagtatcgaagcacgaaagccagacttcgatgcattcattgacccacaaaagcagtatgcggatgcggtgatagaagtgcttccaacgcagctgattccagatgacaatgaaggcaaagtgttgagagtgaggttgataatgaaggaaggtgttaagtactttagcccggctacctattcgatgaaggttcaaccgtctcgtggataccttgcggccgcaaactcacctgctcgtaccctggtatcaagttcaactatgcacctgattcctacttcgaccatgaggtttcggttgttgagatggacgggcaattcgatagactggacgagctgatttacgtggagagccatctgagcaacctctcgactaaattctacggtgaagtgactcaacaaatgctcaaacatgctgacttccctggtagcaacaacggaactggtcttttccagaccattgttggattgaagatcagagatctctatgagcagctcattgccaacaaagcaactgctcctgcagaagctgctaaagcctaaatacaaataagcaaaaaaataacctgtcgataaacccattcgcagtttcttctttctttcttgctctatgcattgtttcctgcggattttcatggcgaaacggacggtctttcatggtttgtaatttgtgtggagatggtatgtagagaagttcatagcagagcaataattattcagttaatacaatccat

SEQ ID NO: 1182 - DNA, 1242 bp, Brassica juncea
cagagtgctttggcggagaagaagaggaagaggaaccaaacatcaagcaacaatggctgtctcaacaatctactcaacacaagctcttaactcaactcatttcttaacctcttccccttcttcctcctcaaaacaagtcatcttctaccgtcgtcaaaccaaccgtagattcaacaccatcatcacttgcgccgcacaacaaaccgtcgtgatcggactcgctgccgactctggatgcggcaaaagtactttcatgcggaggctaaccagtgtcttcggtggagccgctgagccaccaaaaggagggaaccctgactccaacacactcatcagtgacatgaccactgtgatctgtctcgacgattaccattccttagacagaaccggtcgcaaagagaaaggagtcactgctttggacccacgcgctaatgactttgatcttatgtatgagcaagtcaaagctcttaagagtggtatcgccgtcgagaaacccatttataatcacgtcactggacttcttgacgcacctgaacttattcagcctcccaagattctcgtcatcgaaggtcttcacccaatgtttgatgagagggtaagagacttattggacttcagtatctacctagacattagtaacgaggtcaagttcgcttggaaaatccagagggacatggctgaaagaggtcacagtttagagagcatcaaagcgagtatcgaagcacgaaagcctgactttgatgcattcattgacccgcaaaagcagtatgcggatgcggtgatagaagtgcttccaacgcagctgattccagacgacaatgaaggcaaagtgttgagagtgaggttgataatgaaggaaggtgttaagtacttcagcccggtttacctattcgatgaaggttctaccatctcgtggatcccttgtggtcgcaaactcacctgctcgtaccctggcatcaagttcaactaccaacctgattcctacttcgacaatgaggtttcggttgtggagatggatgggcaattcgatagacttgacgagctgatttacgtggagagccatctgagcaacctctcgaccaaattctacggtgaagtaactcaacaaatgctcaaacatgctgacttccctggtagcaacaatggaactggtcttttccagaccattgttggattgaagatcagagatctctatgagcagctcattgccaacaaagccactgctccttcagaagctgctaaagc

SEQ ID NO: 1183 - DNA, 1413 bp, Brassica oleracea
ccaaacatcaagcaacaatggctgtctcaacaatctactcaacacaagctcttaactcaactcatttcttaacctcttccccttcttcctcctcaaaacaagtcatcttctaccgtcgtcaaaccaaccgtagattcaacaccatcatcacttgcgccgcacaacaaaccgtcgtgatcggactcgctgccgactctggatgcggcaaaagtactttcatgcggaggctaaccagtgtcttcggtggagccgctgagccaccaaaaggagggaaccctgactccaacacactcatcagtgacatgaccactgtgatctgtctcgacgattaccattctttggacaggaccggtcgcaaagagaaaggagtcactgctttggacccacgcgccaatgactttgacctcatgtatgagcaagtcaaagctctcaagagtggcatagccgtcgagaaacctatttataatcacgtcactggacttcttgacgcacctgagcttattcagcctcccaagattctcgtcattgaaggtcttcatccaatgtttgatgagagagtaagagacttgttggacttcagtatctacctagacattagcaatgaggtcaaattcgcttggaaaatccagagggacatggctgagagaggtcacagtttagagagcatcaaagcaagtatcgaagcacgaaagcccgatttcgatgcattcattgacccacaaaagcagtacgcggatgcggtgatagaagtgcttccaacacagttgattccagatgacaatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagactggacgagctgatttacgtggagagccatctgagcaacctctcaaccaaattctacggtgaagtgactcaacaaatgctcaaacatgctgacttccctggtagcaacaacggaactggtcttttccagaccattgtaggattgaaaatcagagatctctatgagcagctcattgccaacaaagccaatgctcctacagaagcttctaaagcctaaaacaaataagcaaaacagaacgcgtcgataaacccattggttgtttcttcttctttctttctttatgctttgtttccgcggattttcatgaagaaaaggacggtgttgcatgtttgttatttgtgtggagatataaaaagaaaagcatgtaatgtagaaaaattattagcagagcaataacaattaagttagtacaatgctt

SEQ ID NO: 1184 - DNA, 1724 bp, Brassica rapa
gtttaattcagaaaatcaaaacatgagccactcattacacaaccacatctagtcacaacaaaactcattttcttctttacaaattgccattaattcctataacccattttcctcctctcattcctcattttatttttatttcaagaaaataacatctttatgtcaccacacaataacccataaaatcaaaaatcgttacccacattctctcattctatcctaatcctcatcactcaaaacagagtgcttaggcggagaagaagaggaagaggaaccaaacatcaagcaacaatggctgtctcaacaatctactcaacacaagctcttaactcaactcatttcttaacctcttccccttcttcctcttcaaagcaagtcttcttctaccgtcgtcaaaccaaccgtagattcaacaccatcatcacttgcgccgcacaacaaaccgtcgtgatcggactcgctgccgactctggatgcggcaaaagtaccttcatgcggaggctaaccagtgtcttcggtggagcagctgagccaccaaaaggagggaaccctgactccaacacactcatcagtgacatgaccactgtgatctgtctcgacgattaccattcgttggacaggaccggtcgcaaagagaaaggagtcactgctttggacccacgcgccaatgactttgatctcatgtatgagcaagtcaaagctctcaagagtggcatcgccgtcgagaaacctatttataatcacgtcacaggacttctcgacgcacctgagcttattcagcctcccaagattctcgtcatcgaaggtcttcatccaatgtttgatgagagagtaagagagttgttggacttcagtatctacctagacattagcaatgaggtcaaattcgcttggaaaatccagagggacatggctgagagaggtcacagtttagagagcatcaaagcaagtatagaagcacgaaagcccgacttcgatgcattcatcgacccacaaaagcagtacgcggatgcggtgatagaagtgcttccaacgcagttgattccagatgataatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagacttgacgagctgatttacgtggagagccatctgagcaacctctcgaccaaattctacggtgaagtgactcaacaaatgctcaaacatgctgacttccctggtagcaacaacggaactggtcttttccagacaattgttggattgaaaatcagagatctctatgagcagctcattgccaacaaagccaatgctcctacagaagctgctaaagcctaaaacaaataagcaaaacagaacgcgtcgataaacccattggttgtttcttcttctttctttctttatgctttgtttccgcggattttcatggagaaaaggacggtgttgcatgtttgtaatttgtgtggagatataaaaagaaaagcatgtaatgtagaaaatttattagcagagcaataacaattaagttagtacaatgcttttatctatgagaaaatgacttagataacactaaaaaa

SEQ ID NO: 1185 - DNA, 1480 bp, Brassica napus
gcttaggcggagaagaagaggaagaggaaccaaacatcaagcaacaatggctgtctcaacaatctactcaacacaagctcttaactcaactcatttcttaacctcttccccttcttcctcttcaaagcaagtcttcttctaccgtcgtcaaaccaaccgtagattcaacaccatcatcacttgcgccgcacaacaaaccgtcgtgatcggactcgctgccgactctggatgcggcaaaagtaccttcatgcggaggctaaccagtgtcttcggtggagcagctgagccaccaaaaggagggaaccctgactccaacacactcatcagtgacatgaccactgtgatctgtctcgacgattaccattcgttggacaggaccggtcgcaaagagaaaggagtcactgctttggacccacgcgccaatgactttgatctcatgtatgagcaagtcaaagctctcaagagtggcatcgccgtcgagaaacctatttataatcacgtcacaggacttctcgacgcacctgagcttattcagcctcccaagattctcgtcatcgaaggtcttcatccaatgtttgatgagagagtaagagagttgttggacttcagtatctacctagacattagcaatgaggtcaaattcgcttggaaaatccagagggacatggctgagagaggtcacagtttagagagcatcaaagcaagtatagaagcacgaaagcccgacttcgatgcattcatcgacccacaaaagcagtacgcggatgcggtgatagaagtgcttccaacgcagttgattccagatgataatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagacttgacgagctgatttacgtggagagccatctgagcaacctctcgaccaaattctacggtgaagtgactcaacaaatgctcaaacatgctgacttccctggtagcaacaacggaactggtcttttccagaccattgttggattgaaaatcagagatctctatgagcagctcattgccaacaaagccaatgctcctacagaagctgctaaagcctaaaacaaataagcaaaacagaacgcgtcgataaacccattggttgtttcttcttctttctttctttatgctttgtttccgcggattttcatggagaaaaggacggtgttgcatgtttgtaatttgtgtggagatataaaaagaaaagcatgtaatgtagaaaatttattagcagagcaataacaattaagttagtacaatgcttttatctattgataaaagtatctatcgaaaaaaaaaaaa

SEQ ID NO: 1186 - DNA, 1323 bp, Triticum aestivum
agagtgcttaggcggagaagaagaggaagaggaaccaaacatcaagcaacaatggctgtctcaacaatctactcaacacaagctcttaactcaactcatttcttaacctcttccccttcttcctcttcaaagcaagtcttcttctaccgtcgtcaaaccaaccgtagattcaacaccatcatcacttgcgccgcacaacaaaccgtcgtgatcggactcgctgccgactcaggatgcggcaaaagtaccttcatgcggaggctaaccagtgtcttcggtggagccgctgagccaccaaaaggagggaaccctgactccaacacactcatcagtgacatgaccactgtgatctgtctcgacgattaccattctttggacaggaccggtcgcaaagagaaaggagtcactgctttggacccacgcgccaatgactttgacctcatgtatgagcaagtcaaagctctcaagagtggcatagccgtcgagaaacctatttataatcacgtcactggacttcttgacgcacctgagcttattcagcctcccaagattctcgtcattgaaggtcttcatccaatgtttgatgagagagtaagagacttgttggacttcagtatctacctagacattagcaatgaggtcaaattcgcttggaaaatccagagggacatggctgagagaggtcacagtttagagagcatcaaagcaagtatcgaagcacgaaagcccgatttcgatgcattcatcgacccacaaaagcagtacgcggatgcggtgatagaagtgcttccaacgcagttgattccagatgacaatgaaggcaaagtgttgagagtgagattgataatgaaagaaggtgttaagtacttcagcccggtttacctattcgatgaaggctcaaccatctcgtggatcccttgtggtcgcaaactcacctgctcgtaccctggcatcaagttcaactacgaacctgatacctacttcgacaatgaggtttcggttgtggagatggatgggcaattcgatagactagacgagctgatttacgtggagagccatctgagcaacctctcaagcaaattctacggtgaagtgactcaacaaatgctcaaacatgctgacttccctggtagcaacaacggaactggtcttttccagaccattgttggattgaaaatcagagatctctatgagcagctcattgccaacaaagccaatgctcctacagaagctgctaaagcctaaaacaaataagcaaaacagaacgcgtcgataaacccattggttgtttcttcttctttctttctttatgctttgtttccg

SEQ ID NO: 1187 - DNA, 1616 bp, Brassica juncea
tttatttttatttcaagaaaataacatctttatgtcaccacacaataacccataaaatcaaaaatcgttacccacattctctcattctatcctaatcctcatcattcaaaacagagtgcttaggcggagaagaagaggcatagtaaccaaacatcaaaaaacaatggctgtctcaacaatctactctacacaagctctcaactcaactcatttcttaacctcttccccttcttcctcctcctcctcaaaacaagtcttcttctaccgtcgtcaaaccaaccgtagattcaacaccatcatcacttgcgccgcacaacaaaccgtggtgatcggactcgctgccgactccggatgcggcaaaagtaccttcatgcggaggctgaccagtgtcttcggtggagccgccgagccaccaaagggagggaaccctgactccaacacactcatcagtgacatgaccactgtgatctgcctcgacgattaccattccttagacagaaccggtcgcaaagagaaaggagtcactgctttggacccacgcgccaatgactttgatctcatgtatgagcaagtcaaagctctcaagagtggtatagccgtcgagaaacccatttataatcacgtcactggacttcttgacgcacctgagcttatccagcctcctaaaattctcgtcatcgaaggtcttcatccaatgtttgatgagagggtaagagacttgttggacttcagcatctacctagacattagcaatgaggtcaaattcgcttggaaaatccagagggacatggctgagagaggtcacagtttagagagcatcaaagcaagtatcgaagcacgaaagcccgatttcgatgcattcattgacccacaaaagcagtacgcggatgcggtgatagaagtgcttccaacacagttgattccagatgacaatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagactggacgagctgatttacgtggagagccatctgagcaacctctcaaccaaattctacggtgaagtgactcaacaaatgctcaaacatgctgacttccctggtagcaacaacggaactggtcttttccagaccattgttggattgaaaatcagagatctctatgagcagctcattgccaacaaagccaatgctcctacagaagctgctaaagcctaaaacaaataagcaaaacagaacgcgtcgataaacccattggttgtttcttcttctttctttctttatgctttgtttccgcggattttcatggagaaaaggacggtgttgcatgtttgtaatttgtgtggagatataaaaagaaaagcatgtaatgtagaaaatttattagcagagcaataacaattaagttagtacaatgcttttatctatgagaaaatgacttagataacaaaaaagagtgacggcagagaga

SEQ ID NO: 1188 - DNA, 1334 bp, Brassica juncea
gatagtaaccaaacatcaaaaaacaatggctgtctcaacaatctactctacacaagctctcaactcaactcatttcttaacctcttccacttcttcctcctcctcctcaaaacaagtcttcttctaccgtcgtcaaaccaaccgtagattcaacaccatcatcacttgcgccgcacaacaaaccgtcgtgatcggactcgctgccgactccggatgcggcaaaagtactttcatgcggaggctaaccagtgtttttggtggagccgctgagccaccaaaaggagggaaccctgactccaacacactcatcagtgacatgaccactgtgatctgtctcgacgattaccattctttggacagaaccggtcgcaaagagaaaggagtcactgctttggacccacgcgccaatgactttgatctcatgtatgagcaagtcaaagctcttaagagtggtatcgccgtcgagaaacccatttataatcacgtcactggacttcttgacgcacctgaacttattcagcctcccaagattctggtcatcgaaggtcttcatccaatgtttgatgagagagtaagagagttgttggacttcagtatctacctagacattagcaatgaggtcaaattcgcttggaaaatccagagggacatggctgagagaggtcacagtttagagagcatcaaagcaagtatcgaagcacgaaaaccggatttcgatgcattcatcgacccgcaaaagcagtacgcggatgcggtgatagaagtgcttccaacgcagttgattccagatgacaatgaaggcaaagtgttgagagtgaggctgataatgaaggaaggtgttaagtacttcagcccggtttacctattcgatgaaggttctaccatctcgtggatcccttgtggtcgcaaactcacctgctcgtaccctggcatcaagttcaactaccaacctgattcctacttcgacaatgaggtttcggttgtggagatggatgggcaatttgatagactggacgagctgatttacgtggagagccatctgagcaacctctcgaccaaattctacggtgaagtcactcaacagatgcttaaacatgctgacttccctggtagcaacaacgggactggtcttttccagaccattgttggattgaagatcagagatctctatgagcagctcattgccaacaaagccactgcgcctgcagaaattgctaaagtctaagaaagcacaatagaatccatcgataaatccgttcctagtttctttccttctttctttatgcgttgtttcccgcggattttcatggcgaaaaaggacggtctttctttgg

SEQ ID NO: 1189 - DNA, 1481 bp, Raphanus sativus
attctatcctaatcctcatcacttaaaacagagtgcttaggcggagaagaagaggaagaggaaccaaacatcaaacaacaatggctgtctcaacaatctactcaacacaagctcttaactcaactcatttcttaacctcttccccttcttcctcctcctcctcctcaaaacaagtcttcttctaccgtcgtcaaaccaaccgtagattcaacaccatcatcacttgcgccgcacaacaaaccgtcgtgatcggactcgctgccgactccggatgcggcaaaagtactttcatgcggaggctgacaagtgtcttcggtggagccgccgagccaccgaaaggagggaaccctgactccaacacactcatcagtgacatgaccaccgtgatctgtctcgatgattaccattctttggacagaaccggtcgcaaagagaaaggagtcactgctttggacccacgcgccaatgactttgatctcatgtatgagcaagtcaaagctcttaagagtggtatcgccgtcgagaaacctatttataatcacgtcactggacttcttgacgcacctgagcttattcagcctcccaagattctcgtcatcgaaggtcttcatccaatgtttgatgagagagtaagagacttgttggacttcagtatctacctagacattagcaatgaggtcaaatttgcttggaaaatccagagggacatggctgagagaggtcacagtttagagagcatcaaagcaagtatcgaagcacgaaagcccgatttcgatgcattcatcgacccgcaaaagcagtacgcggatgcggtaatagaagtgcttccaacgcagttgattccagatgacaatgaaggcaaagtgttgagagtgaggctgataatgaaggaaggtgttaagtacttcagcccggtttatctattcgatgaaggttctaccatctcgtggatcccttgtggtcgcaaactcacctgctcgtaccctggcatcaagttcaactaccaacctgattcctacttcgacaatgaggtttcggttgtggagatggatgggcaattcgatagacttgacgagctaatttacgtggagagccatctgagcaacctctcgaccaaattttacggtgaagtgactcaacaaatgctcaaacatgctgacttccctggtagcaacaatggaactggtcttttccagaccattgttggattgaagatcagagatctctatgagcagctcattgccaacaaagccactgctccttcagaagctgctaaagcctaaagcaaatataagcaaaacagaacgcgtcgataaacccattggttgtttcttcttctttctttctttcttttttctttgtttcccgcggattttcatggcgaaaaggacggtgttgcttgttttgtaatttgtgtggagatataaaaagaaaagcccgtaatgtagagaatttattagcagagcaaaagttttttttat

SEQ ID NO: 1190 - DNA, 1422 bp, Brassica napus
agggagagcttaggcggagaagaagaggaagaggatccccaaacatcaacaacaatggctgtctcaacaatctactcaacacgagctctcaactcaactcatttcttaacctcttctccttcttcctccacctcaaaacaagtcttcttctaccgtcgtcatcaatcccaaaccaaccgtagattcaacacaatcatcacttgcgctgcacagcaaaccgtcgtgatcggactcgcagccgactcaggatgcggtaaaagtaccttcatgcggaggctgaccagtgtcttcggtggtgccgccgagccaccaaaaggagggaaccctgactccaacacactcatcagtgacatgaccactgtgatctgtctcgacgattaccattccttagacaggactggtcgcaaagagaaaggagtcactgctttggacccacgcgccaatgactttgatctcatgtatgagcaagtcaaagctctcaagagtagtatcgccgtcgagaaacccatttataatcacgtcactggacttcttgatgcccctgagcttattcagcctcctaaaattctcgtgatcgagggtcttcacccaatgtttgatgagagagtaagagaattattggacttcagtatctacctagacattagcaatgaggtcaagttcgcttggaaaatccagagggacatggctgaaagaggtcacagcttagagagcatcaaagcaagtatagaagcacgaaagcccgacttcgatgcattcattgacccacaaaagcagtatgcggatgcggtgatagaagtgcttccaacgcagctaattccagatgacaatgaaggcaaagtgttgagagtgagattgattatgaaggaaggtgttaagtacttcagccctgtttaccttttcgatgaaggctcaaccatctcgtggatcccttgtggtcgtaaactcacctgctcgtaccctggcatcaagttgaactatgaacctgatacctacttcgaccatgaggtttcggttttggagatggatgggcagttcgatagactagacgagctgatttacgtggagagtcatttgagcaacctctcgagcaaattctacggtgaagtcactcaacagatgcttaaacatgctgacttccctggtagcaacaacgggactggtcttttccagaccattgttggattgaagatcagagatctctatgagcagctcattgccaacaaagccactgcgcctgcagaaattgctaaagcctaagaaagcacaatagaatccatcgataaatccgttcctagtttctttccttctttctttatgcgttgtttcccgcggattttcatggcgaaaaaggacggtctttcttggtttgtaatttgtgtggagatggtcaagaaaaaaaaaatatatgtagagaagttt

SEQ ID NO: 1191 - DNA, 1817 bp, Brassica juncea
tttagacccattttcctcctctcgtttatctctttatcacaccacacaacaacccataaatcaaaactcgttacccacaattcttacattctatcctaatcctcatcactcaaaccaaagcagggagagcttaggcggagaagaagaggaagaggatccccaaacaacaacaacaatggctgtctcaacaatctactcaacacaagctctcaactcaactcatttcttaacctcttctccttcttcctccacctcaaaacaagtcttcttctaccgtcgtcatcaatcccaaaccaaccgtagattcaacacaatcatcacttgcgctgcacagcaaaccgtcgtgatcggactcgcagccgactcaggatgcggtaaaagtaccttcatgcggaggctgaccagtgtcttcggtggcgccgccgagccaccaaaaggagggaaccctgactccaacacactcatcagtgacatgaccactgtgatctgtctcgacgaattaccattccttagacaggactggtcgcaaagagaaaggagtcactgctttggacccacgcgccaatgactttgatctcatgtatgagcaagtcaaagctctcaagagtggtatcgccgtcgagaaacccatttataatctcgtcactggacttcttgatgcccctgagcttattcagcctcccaaaattctcgtcatcgagggtcttcacccaatgtttgatgagagagtaagagaattattggacttcagtatctacctagacattagcaatgaggtcaagttcgcttggaaaatccagagggacatggctgaaagaggtcacagcttagagagcatcaaagcaagtatagaagcacgaaagcccgacttcgatgcattcattgacccacaaaagcagtatgcggatgcggtgatagaagtgcttccaacgcagctaattccagatgacaatgaaggcaaagtgttgagagtgagattgattatgaaggaaggtgttaagtacttcagccctgtttaccttttcgatgaaggctcaaccatctcgtggatcccttgtggtcgtaaactcacctgctcgtaccctggcatcaagttcaactatgaacctgatacctacttcgaccatgaggtttcggttttggagatggatgggcagttcgatagactagacgagctgatttacgtggagagtcatttgagcaacctctcgagcaaattctacggtgaagtcactcaacagatgcttaaacatgctgacttccctggtagcaacaacgggactggtcttttccagaccattgttggattgaagatcagagatctctatgagcagctcattgccaacaaagccactgctccttcagaagctgctaaagcctaaaacaaataaaagcaaaacaggacgcgtcgataaacccattggttgtttcttcttctttctttctttctttctttatgctttgtttcccgcggattttcatggcgaaaaggacggtgttgcttgtttgtaatttatgtggagatataaaaagaaatgcctgtaatgtagagaatttattagcagagcaataaaaattcagttttttgctaactgtctgctgacactacaattagagtaagtaaaacaactaattatttaaatatctgaaggaactaacaaacaaaggaaaaaagttacacgtcagaacctgctggttccatctcgatttctaagatttatctaaagttaccacttgtgaatgtttcacattttaggttccgacccttagagtttcatatatttacaattaagtccatggttacatgacggagcaac

SEQ ID NO: 1192 - DNA, 1269 bp, Brassica juncea
gatcctaatcctcatcactcaaagtctcaaaccaaagcagagagcttaggcggagaagaagaggaagaggatccccaaacatcatcaactaacaatggctgtctcaacaatctattcaacgcaagctctcaactcaactcatttcttgacctcttctccttcttcctccacctcaaaacaagtcttcttctaccgtcgtcatcaatcccaaaccaaccgtagattcaacacaatcatcacttgcgctgcacaacaaaccgtcgtgatcggactcgccgccgactcaggatgcggcaaaagtaccttcatgcggaggctaaccagtgtcttcggtggcgccgccgagccaccaaagggaggcaaccctgactccaacacactcatcagtgacatgaccactgtgatctgtctcgacgattaccattccttggacagaaccggtcgcaaagagaaaggagtcactgctttggacccacgcgccaatgactttgatctcatgtacgagcaagtcaaagctcttaagagtggtatcgccgtcgagaaacccatttataatcacgtcactggacttcttgacgcacctgagcttattcagcctcctaaaattctcgtcatcgaaggtcttcatccaatgtttgatgagagggtaagagacttgttggacttcagtatctacctagacattagcaatgaggtcaaattcgcttggaaaattccagagggacatggctgagagaggtcacagtttagagagcatcaaagcaagtatcgaagcacgaaagcccgacttcgatgcattcattgacccacaaaagcagtacgcggatgcggtgatagaagtgcttccaacacagttgattccagatgacaatgaaggcaaagtgttgagagtgagattgataatgaaggaaggtgttaagtacttcagcccggtttaccttttcgatgaaggctcaaccatctcgtggatcccttgtggtcgcaaactcacctgctcgtaccctggcatcaagttcaactacgaacctgatacctacttcgaccatgaggtttcggttttggagatggatgggcagttcgatagactagacgagctgatttacgtggagagccatttgagcaacctctcgagcaaattctacggtgaagtcactcaacagatgcttaaacatgctgacttccctggtagcaacaacgggactggtcttttccagaccattgttggattgaagatcagagatctctatgagcagctcattgccaacaaag

SEQ ID NO: 1193 - DNA, 1435 bp, Brassica napus
ctcaacacaagctctaactcaactcatttctaacctcttccccttctcctcctcaaaacaagtcttcttctaccgtcgtcaaacaaccgtagattcaacaccatcatcactgcgccgcacacaaaccgtcgtgatcgggactcgctagccggactctggatgcggcaaaagtactttcatgccggaaggctaaccagtggtctcggtggagccgctgagccaccaaaagagggaaccctgactccaacacactcatcagtgacatgaccactgtgatctgtctcgacgattaccattctttggacaggaccggtcgcaaagagaaaggagtcactgctttggacccacgcgccaatgactttgacctcatgtatgagcaagtcaaagactctcaagagtggcatagccgtcgagaaacctatttataatcacgtcactggacttcttgacgcacctgagcttattcagcctcccaagattctcgtcattgaaggtcttcatccaatgtttgatgagagagtaagagacttgttggacttcagtatctacctagacattagcaatgaggtcaaattcgcttggaaaatccagagggacatggctgagagaggtcacagtttagagagcatcaaagcaagtatcgaagcgcgaaagcccgatttcgatgcattcattgacccacaaaagcagtacgcggatgcggtgatagaagtgcttccaacccagttgattccagatgacaatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagactggacgagctgatttacgtggagagccatctgagcaacctctcaaccaaattctacggtgaagtgactcaacaaatgctcaaacatgctgacttccctggtagcaacaacggaactggtcttttccagaccattgtaggattgaaaatcagagatctctatgagcagctcattgccaacaaagccaatgctcctacagaagcttctaaagcctaaaacaaataagcaaaacagaacgcgtcgataaacccattggttgtttcttcttctttctttctttatgctttgtttccgcggattttcatggagaaaaggacggtgttgcgattaccaaaaaaaaaaaggacggtgttgcatgtttgttatttgtgtggagatataaaaagaaaagcatgtaatgtagaaaatttattagcagagcaataacaattaagttagtacaatgcttttatctattgataaaagtagattaaaaccg

SEQ ID NO: 1194 - DNA, 1343 bp, Brassica napus
aagcaagtcttcttctaccgtcgtcaaaccaaccgtagattcaacaccatcatcacttgcgccgcacaacaaaccgtcgtgatcggactcgctgccgactcaggatgcggcaaaagtaccttcatgcggaggctaaccagtgtcttcggtggagccgctgagccaccaaaaggagggaaccctgactccaacacactcatcagtgacatgaccactgtgatctgtctcgacgattaccattcgttggacaggaccggtcgcaaagagaaaggagtcactgctttggacccacgcgccaatgactttgatctcatgtatgagcaagtcaaagctctcaagagtggcatcgccgtcgagaaacctatttataatcacgtcacaggacttctcgacgcacctgagcttattcagcctcccaagattctcgtcatcgaaggtcttcatccaatgtttgatgagagagtaagagagttgttggacttcagtatctacctagacattagcaatgaggtcaaattcgcttggaaaatccagagggacatggctgagagaggtcacagtttagagagcatcaaagcaagtatagaagcacgaaagcccgacttcgatgcattcatcgacccacaaaagcagtacgcggatgcggtgatagaagtgcttccaacgcagttgattccagatgataatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagacttgacgagctgatttacgtggagagccatctgagcaacctctcgaccaaattctacggtgaagtgactcaacaaatgctcaaacatgctgacttccctggtagcaacaacggaactggtcttttccagacaattgttggattgaaaatcagagatctctatgagcagctcattgccaacaaagccaatgctcctacagaagctgctaaagcctaaaacaaataagcaaaacagaacgcgtcgataaacccattggttgtttcttcttctttctttctttatgctttgtttccgcggattttcatggagaaaaggacggtgttgcatgtttgtaatttgtgtggagatataaaaagaaaagcatgtaatgtagaaaatttattagcagagcaataacaattaagttagtacaatgcttttatctatgagaaaacgacaagaag

SEQ ID NO: 1195 - DNA, 1221 bp, Brassica juncea
taccgtcgtcaaaccaaccgtagattcaacacaatcatcacttgcgctgcacagcaaaccgtcgtgatcggactcgcggccgactcgggatgcggcaaaagtaccttcatgcggaggctgaccagtgtcttcggtggcgccgccgagccaccaaaaggagggaaccctgactcaaacacactcatcagtgacatgaccactgtgatctgtctcgacgattaccattccttagacaggactggtcgcaaagagaaaggagtcactgctttggacccacgcgccaatgactttgatctcatgtatgagcaagtcaaagctctcaagagtggtatcgccgtcgagaaacccatttataatcacgtcactggacttcttgatgcccctgagcttattcagcctcccaaaattctcgtcatcgagggtcttcacccaatgtttgatgagagagtaagagaattattggacttcagtatctacctagacattagcaatgaggtcaagttcgcttggaaaatccagagggacatggctgaaagaggtcacagcttagagagcatcaaagcaagtatcgaagcacgaaagcccgactttgatgcattcattgacccgcaaaagcagtatgcggatgcggtgatagaagtgcttccaacgcagctgattccagatgacaatgaaggcaaagtgttgagagtgaggttgataatgaaggaaggtgttaagtacttcagcccggtttaccttttcgatgaaggctcaaccatctcgtggatcccttgtggtcgcaaactcacctgctcgtaccctggcatcaagttcaactacgaacctgatacctacttcaaccatgaggtttcggttttggagatggatgggcagttcgatagactagacgagctgatttacgtggagagccatttgagcaacctctcgagcaaattctacggtgaagtcactcaacagatgcttaaacatgctgacttccctggtagcaacaacgggactggtcttttccagaccattgttggattgaagatcagagatctctatgagcagctcatcgccaacaaagccactgctcctgcagaagctgctaaagcctaagaaagcaaaatagaatccatcgataaatccgttcccagtttctttccttctttctttatgcgttgtttcccgcggattttcatggcgaaaaaggcggtttttctggtttgtaatttgtgt

SEQ ID NO: 1196 - DNA, 1505 bp, Cleome spinosa
atttcgccattctatcccatccgtctctcctttcttctacctcccctcgagctcataagcccgaactccgagcttgagagcaggagcttcaatggcggtttccacggtctacacctctcagtccctcaattcaacccgcttcttatcttcttccacgtctccttcttcttccctcgtttcaaaacacgtcttcttctaccggagaagatctcccacctgccggagatccaccaccgtcatcacatgctccgccggagactctcagacggtggtgatcggcctcgccgccgactccggctgcggtaagagcaccttcatgcggcggctcacctccgtcttcggcggcgccgccgagccgccgaaaggcgggaacccggactcgaacacgctcatctccgacatgaccaccgtcatctgtctcgacgactaccactccctggaccggaccggtcggaaggagaagggagtgacggcgctcgacccacgcgccaacgacttcgacctcatgtacgagcaagtcaaggccttgaagagtggcgtcgccgtcgataagccgatctacaaccacgtcactggtcttcttgatccgccggagctcactaagccaccgaagatcctcgtcatcgagggtctccacccaatgtttgatgagagagtaagggacctcttggacttcagcatctacttagacatcagcaacgaggtcaagttcgcatggaaaatccagagggacatggctgaaagaggtcacagtctagagagcatcaaagccagtatcgaagctcgcaagcccgacttcgacgcctatatcgatccgcagaagcagtacgcagacgcggtgatagaggtgctaccgactcagctgattcccgacgataacgaggggaaagtgctgagagtgaggctgataatgaaggagggagtgaagaatttcagcccggtttacctgtttgacgaaggatccaccatcaactggataccctgcggccgcaaactcacctgctcctaccccgggatcaagttctcgtacggtcccgacacttacttcgaccacgaggtatcggttttggaaatggacgggcaattcgacagactggacgagctgatatacgtcgagagccatctgagcaacctctcgtccaaattctacggagaggtcacccaacagatgctgaaacacgccgacttccccggcagcaacaacggcactggcctctttcagaccatcgtcggcctaaagatcagagacctctacgagcagatcgtcgccgccaaggcctccgcccccgtcgaagccgccaaggcctgaaattacgtatctgccccttctcccccctccctccgctgtgggcgggcaagaacagtctctgtgttgtgatctttttctgtaatgtagagaatggatagtttgaagagaaaataacagttggtgaaatccatgatcaaaaaagctctttccttttcagacagagaatcttaaactcgaacctgatcctgcaatggcg

SEQ ID NO: 1197 - DNA, 1084 bp, Brassica napus
caacacaagctcttaactcaactcatttcttaacctcttcccttcttcctcttcaagcaagtcttcttctaccgtcgtcaaaccaaccgtagattcaactaccatcatcacttgcgccgcacaacaaaccgtcgtgatcggactcgctgccgactctggatgcggcaaaagtaccttcatgcggaggctaaccagtgtcttcggtggagcagctgagccaccaaaaggagggaaccctgactccaacacactcatcagtgacatgaccactgtgatctgtctcgacgattaccattcgttggacaggaccggtcgcaaagagaaaggagtcactgctttggacccacgcgccaatgactttgatctcatgtatgagcaagtcaaagctctcaagagtggcatcgccgtcgagaaacctatttataatcacgtcacaggacttctcgacgcacctgagcttattcagcctcccaagattctcgtcatcgaaggtcttcatccaatgtttgatgagagagtaagagagttgttggacttcagtatctacctagacattagcaatgaggtcaaattcgcttggaaaatccagagggacatggctgagagaggtcacagtttagagagcatcaaagcaagtatagaagcaacgaaagcccgacttcgatgcattcatcgacccacaaaagcagtacgcggatgcggtgatagaagtgcttccaacgcagttgattccagatgacaatgaaggcaaagtgttgagagtgagattgataatgaaagaaggtgttaagtacttcagcccggtttacctattcgatgaaggttcaaccatctcgtggatcccttgtggtcgcaaactcacctgctcctaccctggcatcaagttcaactaccaacctgattcctacttcgacaatgaggtttctgttgtggagatggatgggcaattcgatagactggacgagctgatttacgtggagagccatctgagcaacctctcaaccaaattctacggtgaagtgactcaacaaatgctcaaacatgctgacttccctggtagcaacaacggaactggtcttttcca

SEQ ID NO: 1198 - DNA, 1538 bp, Panax ginseng
agctcaaaacaaataattcccttcttttctctctcaaaaatctgtgaaactcccatttgggaatttacagagcagatagaaaaaatggcagtcagcacaatctatacagttcaatccctgaattcaagctgctcaatctcaaaacacacaaaaacccacttgggatttcatcaaaaacaagtttttttttacagcactaatcccaagaaatcaaataacagaagatggaactcagagattacgtgctctgcttcagaaacaattgtgattggcttggccgctgattcaggatgtggaaagagtacttttatgaggagattgacaagtgtttttggaggagcagctgagccaccaaagggagggaacccagattctaacactttgattagtgacactacaactgtgatttgtttggacgattatcattcacttgacaggactgggaggaaaaaggaaggagtgacagcacttgacccaagagccaacaattttgatcttatgtatgaacaggttaaagctattaaggaaggaattgctgttcagaagccaatttataaccatgtttctggtcttttggacccaccagagctcatcaagccacctaagattcttgtcattgaaggattgcacccaatgtatgatgaaagggtgagggacctcttggacttcagtatctacttggatatcagcaatgaggtcaagtttgcatggaaaattcagagggatatggcagagagaggacatagccttgagagtatcaaagctagtattgaagcccgaaagccagatttcgatgctttcattgacccacaaaagcaatatgccgatgcagttatagaagtgttacccacccagctcatccccgacgacaatgaggggaaggtgctgagagtgaagttgataatgaaagagggagtgcagtacttcagcccagtttacctgtttgatgaaggctccaccatctcctggataccctgcggcaggaagctcacttgctcttaccctggcatcaagtttgcctatggccctgactcctactacggccatgaggtttcagttttggagatggatgggcaattcgacagactggatgagctcatctatgtcgaaagccatctgagcaatatctccaccaaattctacggtgaggtcacccaacaaatgctaaagcatgctgatttcccaggcagcaacaatggaacaggtcttttccaaaccattgttggattaaaaatccgagacctctttgagcaactcagtgccagtaaggctgcagctccactggaagccacaaaagcctaaaacaagtgccagatgtattcggacagggcaccaagtcatctcaaatttatcctttctccataaattttctgtagattttatattcacctgcctacaactttcatgttcatgttgagtgctaggatattcctcataaggatgagaaacactctcatatgtatttagttccagctgttattatgtggttacttgtaatatagagaagaaattgcagaaatgaatctaaaatatgatcg

SEQ ID NO: 1199 - DNA, 1579 bp, Cleome gynandra
tgtaattatttattggatttaacaaaataaaaacaagaaatcataattttatttcaccacacaaaaacccataaaacaaaaaattcagaactcatttattcattttatcatctcatcatctcttcttttctactgaaattccaatacaaccttagagcttgagagttgaagcttcaatggcggtctccacagtctacacaactcaatccctcaattcttcacacttcttatcttcttcttcttcttcttcttcttcttcctcttcttctcctttcatttccagacatgtcttcttttaccggaagaaatcgccgagcacccgcatcacatgctccgccggagactctcaaactgttgtcatcggacttgccgccgactctggttgcggtaagagtacgttcatgcggcggcttacttctgtcttcggtggtgctgctgagccaccgaaaggtgggaacccagactcaaacaccttaatctccgacatgaccaccgtcatctgtcttgacgattaccattccctcgaccgtactggtcggaaggagaacggagtgacggcccttgaccctcgtgccaatgactttgaccttatgtacgaacaagttaaggccttgaaaagtggcgtcgccgtcgataagccgatttacaatcatgtcaccggacttcttgacccaccggagctcattaagccaccgaagatcctcgtaatcgagggtcttcatccaatgtttgatgaaagagtaagagacctcttggacttcagtatctacttagacatcagcaatgaggttaagttcgcctggaaaattcagagagatatggccgaaagaggtcatagtttggagagcatcaaagctagtattgaagctcgtaaacccgactttgatgcctatatcgatccacaaaagcaatatgcagatgcagtgatagaagtgttaccaacacaattgataccagacgataatgaaggtaaagttctaagagtgaggcttataatgaaggaaggcgtgaaaaacttcagtcctgtctatctattcgacgaaggctcgaccattaattggatcccttgcggccgtaaactcacttgctcttaccccggcatcaaattctcctacggccccgacacctactttggtcacgaggtttcggttttggagatggacggacaattcgacagattggacgagctaatttacgtggagagtcatctgagcaacctttccaccaagttctatggtgaagtaactcaacaaatgctcaaacacgcggatttccctggcagtaacaatggaactggactcttccaaaccattgtcggattaaagattcgagacctttacgaacaaatcatcgctaacaaagcggttgcaccaatagaagccgcaaaagcttgaagaacactaagcaatgtgtcgataaaacccttcgtttcgatcttttttctcaagtttccactttgttttcgagtattgggttattattgcccattgcgacaataacaatctttgtgttgtataagagaaaaatgaaaagcaagagaaataacagttggtggataaaagaacaccttcaaagtccc

SEQ ID NO: 1200 - DNA, 1532 bp, Papaver somniferum
cccttgtgtcctcgctatattacaaatctccacatgatagtattaaaacataaatgtatacccccactgagaagtgaaaccagaattcagaaaatatattagaattctcttctctaaagagactttcaaagttccaccaaaatggcaatctgtactgtgtatacaactcagtctttgaacacaatatcaacaccaacaacaacaaaaaccaaccttggtttcaatcaaaaacaagtatttttcttcaccaagaaatcatcattatcaaccagaagaaattcttacttctcatgctcagctggagattcaaaaacaattgtgataggattggcagctgattcaggatgtggtaagagtacttttatgagaagattaacaagtgtatttggtggtgccgcagaaccaccaaggggtggaaacccagattcaaatactttgattagtgatacaacaacagtcatatgtttagatgattatcattcacttgatagaaccggaagaaaggaaaagggtgttactgctcttgacccaagagctaatgattttgacctaatgtatgagcaagttaaagctcttaaaaacggtattgctgttgagaaacctatctacaatcatgtatctggtcttttagatcctccagaacttatccagcctcctaagattcttgtcatcgaaggtcttcacccaatgtacgactctcgggttagagacctcctcgacttcagtatctacttggacattagtaacgaagtcaagtttgcatggaaaattcagagggatatggccgaacgtggtcacagtcttgaaagtattaaagctagtattgaagcccgaaagcctgattttgatgcttacattgatccacaaaagcaatatgcagatgcagttatagaagttttaccaacaacattgattccagatgacaacgaaggaaaagttttgagggttagattgatcatgaaagaaggtgtaaaatatttcagtccagtttacttgttcgacgaaggttccaccatttcatggattccttgtggaaggaaactcacttgttcatacccaggcatcaagttcaactatggtcccgactcttacttcgacaatgaggtgtctgtgttggaaatggatggacaatttgacagattagacgaactgatttacgtggagagtcatcttagcaacatctctaccaagttctacggagaagttacccaacagatgttgaagcacgcagatttccccggtagtaacaatggaactggtctctttcaaaccatggttggattgaagatcagagatctttatgaacagattttggcaagcaaagttggagctttggaagcaagcaaagcttgatagcggaaatacttggtcagaatcacttcaaattaccaattattctacgaagttttcatcattgtggagttttttaggctttctactttcaactcgtaagatttaagaacactcttatatgtaattcatgttgtaatactatcatgtggagatttgtaatatagtgaagacacaaggga

SEQ ID NO: 1201 - DNA, 1733 bp, Papaver somniferum
actcacctccactttgtataagctgtgctgtatatggccagtaactaataaactcaacctgaaagagaatgttaaatagtaaaataacaaaacatcaccatttctgaactttttgtttgtttttattctcctctcaaaactacttttagtgtctgttttctttctacaaattaaaacataaatgtatacccccactgagaagtgaaaccagaattcacaaaatatattagaattctcttctctaaagagactttcaaagttccaccaaaatggcaatctgtactgtttatacaactcagtctttgaacacaatatcaacaacaactaaaaccaaccttggtttccatcaaaaacaagtatttttcttcaccaagaaatcatcattatcaaccagaagaaattcttacttctcatgctcagctggagattcaaaaacaattgtgataggattggcagctgattcaggatgtggtaaaagtacttttatgagaagattaacaagtgtatttggtggtgcagcagaaccaccaaggggtggtaacccagattcaaatactttgattagtgatacaacaacagtcatatgtttagatgattatcattcacttgatagaaccggaagaaaagaaaagggtgttactgctcttgacccaagagctaatgattttgacctaatgtatgagcaagttaaagctcttaaaaacggtattgctgttgagaaacctatctacaatcatgtatctggtcttttagatcctccagaacttatccagcctcctaagattcttgtcatcgaaggtcttcacccaatgtacgactctcgggttagagacctcctcgacttcagcatctacttggacattagtaacgaagtcaagtttgcatggaaaattcagagggatatggccgaacgtggtcacagtcttgaaagtattaaagctagtatcgaagcccgaaagcctgattttgatgcttacattgatccacaaaagcaatatgcagatgcagttatagaagttttaccaacaacgttgattccagatgacaacgaaggaaaagttttgagggttagattgatcatgaaagaaggtgtaaaatatttcagtccagtttacttgttcgatgaaggttccaccatttcatggattccttgtggaaggaaactcacttgttcgtacccaggcatcaagttcaactatggtcccgactcttacttcgacaatgaggtgtctgtgttggaaatggatggacaatttgacagattagacgaactgatttacgtggagagtcatcttagcaacatctctaccaagttctacggagaagttacccaacagatgttgaagcacgcagatttccccggtagtaacaatggaactggtctcttccaaaccatggttggattgaagatcagagatctttatgaacagattttggcaagcaaagttggagctttggaagcaagcaaagcttgatggcggaaatacttgatcagaatcacttcaaataaacaattattctacgaagttttcattcttcttcttcttctccaacttcatcattgtggagttctttagggtttctactttcaactcataagatttaagaacactcttatatgtaattcatgttgtaatactatcatgtggagatttgtaatatagcgaggacacaagggagatgaaatgcagtttaaaaagatcaaaatatttgaaactttcataaaaaaaaaa

SEQ ID NO: 1202 - DNA, 1374 bp, Manihot esculenta
catctgttttcccttttggtatcacaaaggaaaatttctccataaattttccatttcatgtttctgcagaaaatcagctgagaaaaagaaaagaaaagaaaagaaaagaaaaattttggcaaaaacccatttacaagaaatggcaatttgcacagtttacacaactcaatcactgaattcaacatgctcaatttatacaccagcaaaaacccacttgggatttaaccagaaacatgttgttttctatagcagtagcaagaaaaccagtagaagagctgcaaatggggtgataacttgctcagcaggtgactcacagacagttgtgattggtctagcagcagactcaggttgtgggaagagtaccttcatgaggaggttaactagtgtgtttggaggtgcagcagagccaccaaagggaggcaatccagattcaaacacactcatcagtgatacaacaacagtgatatgtttagatgattatcattcattggatagaacaggaaggaaagagaaaggagtgacagcacttgatccgagagctaatgattttgatctaatgtatgaacaagttaaagctcttaaagatgggattgctgttgagaaacctatttataatcatgtcactggtctattagatcctcctgagctcatcaagcctcctaagattcttgttattgaaggccttcacccaatgtttgatgaacgtgtaagggatctcttggacttcagcatctacttggacataagcaatgaagttaaatttgcatggaaaattcaaagagacatggcagagcgaggacacagtcttgaaagcattaaagccagtattgaagctcgcaagcctgactttgatgcttatattgatccacaaaagcaacatgcagatgcagtgatagaagtgctaccaacacaactgataccagatgacaatgaagggaaagtattgagagtaaagctgataatgaaagaaggggtgaagtatttcagcccagtttacttgtttgatgaaggttccaccatttcatggattccatgtggtaggaagctcacctgctcttaccctggcatcaaattcttctatggccctgacacttactttggccatgaggtgtcagtattggagatggatgggcaattcgacagattagatgagcttatctatgtagaaagtcatctgagcaacatttccactaagttctatggagaaatcactcagcaaatgttgaagcatgcagatttccctggaagtaacaatggaacaggtctcttccaaaccatcatcggattgaaaataagagatctctacgagcaaatcatcaccagtaaggcgggggctcctgtagaagcaaaagcctaataatttctaccaccttt

SEQ ID NO: 1203 - DNA, 1650 bp, Panax ginseng
agtggtatcaacgcagagtacatgggggatgtcaccaaaaccagctcaaaacaaataattcccttcttttctctctcaaaaatctgtgaaactcccatttgggaatttacagagcagatagaaaaaatggcagtcagcacaatctatacagttcaatccttgaattcaagctgctcaatctcaaaacacacaaaagcccacttgggatttcatcaaaaacaagttttttttacagcactagtccgaagaaatcaaataacagaagatggaactcagagattacatgctctgcttcagaaacaattgtgattggcttggctgctgattcaggatgtggaaagagtacttttatgaggagattgacgagtgtttttggaggagcagctgagcctccaaagggagggaacccagattctaacactttgattagtgacactacaactgtgatttgtttggacgattatcattcacttgacaggactgggaggaaaaaggaaggagtgacagcacttgacccaagagccaacaattttgatcttatgtatgaacaggttaaagctattaaggaaggaattgctgttcagaagccaatttataaccatgtttctggtcttttggacccaccagagctcatcaagccacctaagattcttgtcattgaaggattgcacccaatgtatgatgaaagggtgagggacctcttggacttcagtatctacttggatatcagcaatgaggtcaagtttgcatggaaaattcagagggatatggcagagagaggacatagccttgagagtatcaaagctagtattgaagcccgaaagccagatttcgatgctttcattgacccacaaaagcaatatgccgatgcagttatagaagtgttacccacccagctcatccccgacgacaatgaggggaaggtgctgagagtgaagttgataaatgaaagagggagtgcagtacttcagcccagttttgatgaaggctccaccatctcctggataccctgcggcaggaagctcacttgctcttaccctggcatcaagtttgcctatggccctgactcctactacggccatgaggtttcagttttggagatggatgggcaattcgacagactggatgagctcatctatgtcgaaagccatctgagcaatatctccaccaaattctacggtgaggtcacccaacaaatgctaaagcatgctgatttcccaggcagcaacaatggaacaggtcttttccaaaccattgttggattaaaaatccgagacctctttgagcaactcagtgccagtaaggctgcagctccactggaagccacaaaagcctaaaacaagtgccagatgtattcggacagggcaccaagtcatctcaaatttatcctttctccataaattttctgtagattttatattcacctgcctacaactttcatgttcatgttgagtgctaggatattcctcataaggatgagaaacactctcatatgtatttagttccagctgttattatgtggttacttgtaatatagagaagaaattgcagaaatgaatctaaaatatgatccacattctgagtaactaatgacacacaagtttatcatgctgtacttttccaaattgaacatgactagaaatattattt

SEQ ID NO: 1204 - DNA, 1674 bp, Aristolochia fimbriata
caggaatttatagagaaaaggagtcgtacccatttgatgtttctttctcaagagcggctggaggagctcccggagtctgcaggctccctctactgaaggagagaaagaaaatccagttgggatctttcctcagtgagcaaaacccagagcaaaaatggcggtttccacggtctacaccacccattcgttgaactcgagctgttcgatctcctccccgacgagaacccaattgggttctcatcagagacaggtggttttctacagaagcagcagctgcagagggagaagcagcagggggagaagcgtttctgtgattacatgctctactgacactgttgtaatcggcttggcggccgattccggttgtggtaagagtactttcatgaggaggctgaccagtgtctttggaggggcagcagagcctcccaagggggggaatcctgattccaacaccctgatcagtgacatgactaccgttatttgcctggatgattaccattctctggacaggtacgggaggaaggagaaaggagtgactgctcttgaccccagagctaacaactttgatctcatgtacgagcaagtgaaggctcttaaggaggggaaagcagttgacaagcctatctataaccatgtcactggcttgttggatcctcctgagctcatccagccacccaagattcttgttattgaaggcttgcacccaatgttcgatgcccgcgttagggaactcctcgacttcagtatttacttggatatcagcaacgaggtgaagttcgcttggaaaatccagagggacatggcagaacgtgggcacagtcttgaaagcattaaagctagtattgaagcccggaagccggactttgatgcttttattgacccacagaagcaatatgctgatgcagtcatagaggttcttccaactcaactgatccctgacgacaacgaaggaaaggtcttgcgggttaagttggtgatgaaagaaggcgtcaagcatttcagccctgtgtacctgtttgatgagggatccaccatttcatggattccttgtggaaggaagctaacatgttcctaccctggcatcaagttcgcctatggacctgattcctacttctcccatgaggtatcagtgttggagatggatgggcagtttgacaggcttgatgagcttatctacgtggagagccatctgagcaacctgtcgacaaagttctatggtgaagtcactcagcaaatgttgaagcatgctgatttccccggtagcaacaatggcactgggcttttccaaaccatagttgggttgaaaataagagacctgtatgagcagatagttgcaagcaaagctgcagttcctgtagaagcaacaaaagcctgatctcactcataccctggggagagttgctccagtacccttggccttcttccagatttcatttttatccctttgtttggacatttggctcctccgacagagagcattcttatgtattcactttgtaatcctgttgttgagatatgtaagataggatcaaaagagataaaatgatgtaaaatttcaacgagtttagtatcagttccatccatcttcatgggtatatacatatatttatctatttcaaccaagttttccgacaatgaatagcaatcagaagaattgcagtcggaattccgttt

SEQ ID NO: 1205 - DNA, 1300 bp, Scabiosa columbaria
atccgggtatttcttgattcttgagtgaggaatcaagaaaattcaagaaagtgaaaatggctgcttgtactgtctacacagtccagttcttgaactcaacacattcaatatcatcaacccagttgaaattccagcaaaaacagctcctcttctgcaagaaaaccacacaacccaaaagcaacaggagagtgataacatgctcagcaggtgactcacagacaattgtgattggtctagcagcagattcagggtgtggtaagagtactttcatgaggagacttactagtgtgtttggaggtgcagctgaaccaccaaagggaggcaatccagattcaaacacattgataagtgacactacaacagttatatgtttagatgattatcattcacttgataggacaggtaggaaagagaaaggagtgactgcacttgatccaaaggctaatgactttgatcttatgtatgaacaagttaaagcacttaaagatggtgttgctgttcaaaaacctatttataatcatgtttctggtcttttggatcctcctgagctcattaaaccacctaagattcttgtcattgaaggcttgcacccaatgtatgatgagagggtgagggatctcttggacttcagtatttatttggatatcagcaatgaggtcaaattcgcatggaaaatccagagagacatggctgagagaggacacagtcttgaaagtatcaaagctagcattgaagccagaaagcctgattttgatgcttacatcgatccacaaaagcaatacgcagacgcagtaattgaggtgttgccgacacaactgataccagacgacaacgaaggaaaggttttgagagtgaagctgataatgaaggagggagtgaagcactttaacccggtttatctcttcgatgaaggctcaactatctcttggatcccctgtggtaggaaactcacttgctcttaccctggcatcaagtttgcctatggtcccgactcttacttcggcaatgaggtatcggtattggagatggatggacaattcgacagactagacgaactcatctacgtggaaagccacttaagtaacatctccaccaaattttacggtgaggtgacgcagcagatgctgaaacacgccgatttccctggcagtagcaacggtactggtctattccaaaccattgttggtttaaagatcagggacctttatgagcaactcaccagtactaaggcttcagcgccactcgaagcctccaaagcttaatatgaaaatattatgtacttaaaaatgtaatttaagtt

SEQ ID NO: 1206 - DNA, 1378 bp, Aquilegia formosa
aacaaaatggcaatatgcacagtatactcatcccactcactcaattcaacctgttcaattcctacaccaacaaaaacttacttgggtttcaaccaaaaacaggttatcttcttcacaactaacaaaagaagcaacagaagaggtagcaacagctactctactgagatctcatgtgcagctgagaagacagttgttattggtttggcagcagattcaggatgtgggaagagtactttcatgaggagattgacaagtgtgtttggtggtgcagcagaaccaccaaagggtggcaaccctgattccaacacattgattagtgatacaaccactgttatttgtttggatgattatcactcacttgataggacaggaaggaaggtacataaagtgactgcacttgaccccaaagccaatgattttgatcttatgtatgagcaggtcaaagctctcaaggaggggattgcagttgagaaaccaatttataaccatgttagtggtctattggaccctccagagcttatcaagcctcctaagatccttgtcattgaaggattgcaccctatgtatgatgctcgtgtaagggaactccttgacttcagtatctaccttgacatcagtaatgaggtcaagtttgcatggaaaattcagagggacatggcagaacgtggacacagtcttgaaagtattaaagctagtattgaggctcgaaagccagattttgatgcctatattgacccacagaagcaatatgcagatgcagtcatagaagtcctgccaaccacactcattcctgacgataacgaagggaaggtgttgagagtccgattaataatgaaagaaggggtgaagtatttcaacccagtgtacttgttcgacgagggttccacaatctcatggataccgtgtggaaggaaactgacttgctcataccctggcatcaaattcaactatggcccagatgcttactatgacaatgaggtgtctgtgttggagatggatgggcagtttgacagattagatgaactgatctatgtggagagtcatctgagcaacatttcaaccaagttctatggtgaagttacacagcagatgctaaagcatgcagatttccctggaagtaacaatggaacaggtctcttccaaaccatagttgggttgaagataagagacctctacgagcagttgatcgccagcaagactggcgctccactagaagcaacaaaagccaaataaaagacttggcagagtcattttcatcagtttttctttatcacctacaatgtgtaagttttttacaaggttgatggcacactatgtatctcctgttgtaattcttgtgaaatttgtattatagagtagcaaaaatagataaaatgca

SEQ ID NO: 1207 - DNA, 1707 bp, Nicotiana benthamiana
gccaggacaaaatatcctcaaaggtaaaaaaaggaaaaagaaaaaaaggaattgatcaatgcccattcattcattacatttacatgtcaccccttaaactttagctcatcagatagtcagagagaagggagagccttttccataattctatctctttctctctgaaaaaaagaaaaaacctctcaagaatctgagaggaaaaaatcaagaaaatatggcagtgagtacagtgtacacagctcaatcactgaactctacttgttcaatctccacaccctcaaaatcccacttaggatttcacaaaaaacaagtgattttctacacaaaattaagaaccaacagaagaagcagtagcactagtgtaataacatgttcatcagttgatgaaaagacagtggtgattggtttagcagctgattctggatgtgggaaaagtactttcatgaggagattaacaagtgtatttggtggtgctgctgagccaccaaaaggtggaaatccagattcaaacacattaatctcagatatgactactgtgatttgtcttgatgattatcactcacttgatagaactggaaggaaggagaaaggagtgactgctcttgatcctagagctaatgattttgaccttatgtatgagcaagttaaggctattaaggaaggtattgctgtggagaagcctatttataaccatgttagtggtcttcttgaccccccagaactcattaagcctcccaagattcttgttattgaaggattacaccccatgtacgatgaacgtgtgagagaactcttggacttcagcatctacttggatatcagcaatgaggttaagttcgcttggaagattcagagggatatggctgagagagggcacagccttgagagcattaaggccagtattgaagccaggaagccagattttgatgcttacattgacccacaaaagcaatatgcagatgcagtaattgaagtgctcccaactcagctgatcccagatgacaatgaaggcaaagttttgagagtgagattgataatgaaggaaggagtaaagaacttcaacccggtttacctgtttgatgaaggctccaccatctcatggattccttgtggtaggaagttgacttgttcttaccctggcatcaagttcacctatggccctgactcctactttggcaatgaggtatctgtcttggagatggatgggcaatttgacagactggatgagctcatctatgtggagagccatttgagcaacctctccaccaaattctacggtgaagttactcaacaaatgttgaagcatgctgatttccctggtagcaacaatggaacaggtttcttccagaccattgtaggtttgaagatcagagacctctacgagcaaatcgttgccagcagagctgcagctccagttcaagctgcaaaggcctaaactttgccaaactctattaacagctaggcaccagaatcatctgttgtttcgccctcttccctaaattttttatttgccgacttctttcgtgtttcagtttcatggtagataattccccataaatgagaagatacacttgattatgtatttatatctagctggaaatgtgttgagagttgtaacatggataataaggaggagtaattaagtgaaacatatcaaggcaaacatcaacctttttggctcacattttccacttgatcatcatttgg

SEQ ID NO: 1208 - DNA, 1582 bp, Tragopogon dubius
gggtagtcatagaaacccataaaactgaggacatcccacatccatctctcatctgattactagaatttcatctgtttatttttacttcaagtgaatcttgagtttacactgcctttttggagcatatcctttcaatttgcatccttagaagacttatatccccttgatccctcaccaaaacaaccgcattcaattacacattaaaaagctgttacctttctctctctaaaacttcaaaaagaagagagagagaaacaatggcagtgtgcacagtgtacacagtccaagctctcaacacaacatgctcaatctcaacacccacaaaaacccacctgggatttaaccaaaagcaggtgtttttctacagtaaaaagagcagtagtggcaggatcagaggtggtgaaataacatgctccggcgacacaatagtaatcggacttgcagctgactctgggtgtgggaagagcaccttcatgagaaggttgaccagtgtttttggtggtgcggcctctccgccaaagggagggaatccggactcgaacacactcataagtgacacaaccacagtcatatgtctggatgattaccattctttggacagaactgggaggaaagagaagggagtgactgcacttgacccaagagccaatgactttgatcttatgtatgaacaggttaaggctcttaaagatggtgtggctgttgagaagccgatttataaccatgttagtggtcttttggaccctcctgagctcatcaaaccacctaagattcttgtcattgaaggtctgcacccaatgtatgatgagagagtgagagacctcctggacttcagtatttacttggacatcagtaacgaggttaaatttgcctggaaaattcagagggacatggcagagagaggacacagtcttgaaagcattaaagccagcatagaagctagaaaaccagattttgatgcttttattgaccctcaaaagcaatatgcagacgcggttattgaagtattacctacacagttaattccagatgacgagggaaaagtgttgagagtaaagctgataatgaaagaaggagttaaatacttcaaccctgtgtacttattcgatgaaggttccaccatctcatggatcccatgtgggaggaagctcacttgctcttaccccggcatcaaattcgcttacggtccagacagttactttgggcatgaggtttctgtgttggagatggacgggcagttcgacagactagatgaactcatctatgtggaaagccatttgagcaacatctccacgaaattctatggtgaaatcacccagcaaatgttgaagcatgctgacttcccaggtagcaataatggcactggtctctttcaaaccatcgtagggttgaagatccgagacctgttcgaacagctggcagacaacaaggcatcaactccactccaagctacacaagcttaattctaaacaaacacttctggttgttccaatcccatttgtatttacttcaagttgtgtattctatggagatatatataatataaagatttcaatgacaaccaccacaagaaatatccttg

SEQ ID NO: 1209 - DNA, 1552 bp, Arnica chamissonis
agaaacccataaaactaatgagtccctaaatccatctatcttctttcaattctatactttcatctgtttcttttacttcaagggtgacactacctatttagaccatatacccttctctcaattttgcattatcttgaataaccacacacaaatcttgaatttcacattgaaaatctctaatctttgatctctttctctctctaaaacttcagaaagagagagaaacaatggcagtttgcacagtgtacacagtccaagctctcaactcatcatgctcaatctcatcacccacaaaaacccacatgggattcagcccaaagcaggtgtttttctacaccagtggctgtaaaaagaccaaaagtgggaggtttagaggtggtgagatcacatgctcaggggacacaatagtaattggacttgcagcagattctggttgtggaaagagcaccttcatgagaaggttaaccagtgtgtttggtggtgcagcttctccaccaaagggtgggaaccctgactcaaacacactcataagtgacacaaccactgttatatgtctagatgattaccattctttagatagaactggaaggaaagaaaagggtgtgactgcacttgacccaagagccaatgactttgatctgatgtatgaacaggttaaggcacttaaagatggtgtggctgttgagaagccaatttataaccatgtttctggtcttttggaccctcctgagctcatcaaaccacccaagattcttgtcattgaaggtctgcacccaatgtatgatcagagagtaagagacctcttggacttcagtatttacttggacataagtaacgaggttaaattcgcatggaaaattcagagagacatggcagagagaggacacagtctcgaaagcattaaagctagcattgaggccagaaaaccagattttgatgcgtatatcgacccgcaaaagcaatacgcagatgcagtaatcgaagtgttgcctactcagctgattcccgatgacaacgagggaaaagtgttgagagtgaagctaatcatgaaggaaggagttaaatacttcaaccccgtctacttatttgacgaaggttccaccgtttcatggatcccgtgtggaagaaagctcacttgctcgtatcctggcatcaaattcgcctacggtccagacgcttatttcagtcatgaggtttccgtgttggaaatggatgggcaatttgacagattagatgaactcatctatattgaaagccatttgagcaacatttccacgaaattctatggtgaaatcacccaacaaatgttgaaacatgctgatttccccggtagtaataacggtactggtttgtttcaaaccatagtcgggttgaagatccgagatttgtttgaacaaattgcagccaataaggcatcggctccacttgaagctaccaaagcttgatcataaatggggttatcatgactgttgtgatcacatatgtatttaattctatttgtgtacgtattccatggatatatgtaatataagtataccaattcataaatgaa

SEQ ID NO: 1210 - DNA, 1457 bp, Euonymus alatus
gaagattgcctagagaacacaattcagcagcatccacttcctctctcaattccagagagagagagagagagagagagagaatggcagtctgcacagtctacacaacccaatctctcaactcaacatgctcaatctccacactaacaaaaaccaacttgggttttaccgaaacaggttgtgttctatagcacttctggtaagagaagcagaggtagtaacactactgtgataacctgctcagcaggtgactcacagacagttgtcattggcctggcagcagactcaggatgtgggaagagtacattcatgaggaggctaacgagtgtttttggaggagcagcagagccaccaaaaggaggaaatccagactcaaacacactgattagtgacacaacaactgtgatatgcttggatgattatcattctcttgacagaactggaaggaaagagaagggagtgactgcacttgacccaagagccaacaactttgatctcatgtatgagcaggttaaggccatcaaggatggaattgctgttcagaaacccatctataatcatgtgagtggtcttcttgaccctcctgagctcatcaagcctcccaagatccttgtcattgaaggacttcacccaatgtatgatcagagagtaaggaacctgttggactttagtatctacttggatatcagtaatgaagttaagtttgcatggaaaattcagagggacatggctgagcgagggcacagccttgaaagcattaaagctagtatcgaagcgagaaagccggactttgatgcttatattgatccgcaaaagcaatatgcggatgctgtgattgaagtacttccaacccaactcatcccggacgacaacgaggggaaggtgttgagagttaggttgataatgaaggaaggtgtgaagtacttcaaccctgtttacttgtttgatgaaggttccactatttcatggataccctgtggaaggaaactcacctgctcttatcccggcatcaagttctcctatggccctgatagttacttcggccacgaggtttctgtactggagatggatgggcaatttgacagattagatgagctaatctatatagagagccatttgagcaacatttcgactgagttctatggtgaggtcacccaacaaatgttgaaacatgatgattttcctggcagtaacaatggaaccggtctcttccaaactatagttggattgaaaatcagagatctctacgaacagcttgttgcgagcaaggccagacgtccagtagaagcaaaggcctaagcacaaaggcacttcctcttgttcatgttttttcttcgctctttttttcttttcctatcgggccgtcttcggggtggttactcgttaaaatgcgaatcacagtgtgtacctatttcaatttataattgtattgggagtttgtaaaatagagaagaatttca

SEQ ID NO: 1211 - DNA, 1656 bp, Gossypium raimondii
gtaaggacaataatccaaacacgtttttatgtggtctttgattgaggaccatctaacactatttgcccatttttagcaacctcttcttctcttaaagctctctactctacaattctgcttcctagcagacagaaccagagagagtgaggtagctaaacaatggcagtttgcccagtatacaccacccaatctctcaactcaacatgttcaatctccacaccatcaaaaacccacttcagttctcaccacaaccacttagttttctacagaactagcaagagaactagcaagagaggtggcagcagctcatgtgtgataacctgctcagctggtgattcacaaacagttgtgattggtttagctgctgactcaggatgtgggaagagtacctttatgaggaggctaacaagtgtgttcggtggtgcagctgagccaccaaagggaggcaaccctgattccaacacactgatcagcgacatgaccactgtgatatgtttagatgattatcattcacttgacagaactggaaggaaagagaagggagtgacagcacttgacccaagagccaatgactttgacctcatgtatgaacaagttaaggctctcaagagtggtattgctgtcgacaagcctatctacaaccatgttactggtctcttggatcctcctgagctaattaagcctccaaagatccttgtcatcgaaggactgcaccccatgtttgatgaacgtgtgagggatctgttagacttcagtatctatttggatatcagcaatgaggtcaaatttgcatggaaaattcagagggacatggctgagagaggacacagccttgaaagcattaaagccagtattgaagccaggaagcctgatttcgatgcctttatcgatcctcaaaagcaatacgccgatgcagtaatcgaagtgctcccaactcagctgatcccagatgacaatgaggggaaggttttgagagtgaggttgataatgaaagaaggggtggagcatttcagtccagtttacctgtttgatgaaggctcaaccatctcatggataccatgtggaaggaagctcacttgttcttaccctggcatcaaattctcctatggccctgacacatacttcggccatgaggtttctgttctggagatggacgggcaatttgacagattagatgaactgatatacgtagaaagccatttaagcaatctctctaccaagttctatggagaagtcactcaacaaatgttgaagcatgctgatttcccaggaagtaacaatggaactggcctcttccaaaccattgtggggttgaagataagagacctgtatgagcaaattaccgctagcaaaactgcagctccattacaagcaacaaaagcctaagagtttcctcatacattgggcaaggctttggctttggcttcactcttttcagctttccacaatttccacctcctatgtatttattttctcctgttgtaatttagaaaaacgaatcagagatcaaattcaagaagttcatacaaggattccatcatctctacgcttcttgtttgtaatcattaatgatgcttatgatttttgttttttttgtttttgtttttggaataagaggattggctatggagcatggccataatgtgacattctcca

SEQ ID NO: 1212 - DNA, 1359 bp, Ambrosia trifida
taacacttgtgcaacaagagatagagagagataacaagtaacaataataataataataacaatggcagtgtgcacagtgtacacagtccaagctttaagctcatcatgctcaatctcatcaccaacaagaacccatatgggattaaagaccaaaagtggcaggtttagaagtggtggttataagatcacatgctcaggtgacacaatagcgataggacttgcagcagactcaggttgtggaaagagtactttcatgagaaggttaaccagtgtgtttggtggtgcagcctctccaccaaagggtgggaaccctgactcaaacacacttataagtgacacaactactgtcatatgtttagatgattatcattcattggatagaactggaaggaaggaaaagggtgtgactgcacttgacccaagagccaatgactttgatcttatgtatgaacaggttaaggcacttaaagatggtgtggctgttgataagcctatttataaccatgtttctgggcttttggaccctcctgagcttattaaaccgcccaagattcttgtcattgaaggtctacatccaatgtatgatcagagagtaagagacctactggacttcagtatataccttgacattagtaacgaggttaaattcgcatggaaaatccagagagatatggcagagagaggacatagtcttgaaagcattaaagctagcattgaggccagaaaaccagattttgatgcttatatcgacccgcaaaagcaatacgcggatgccgtaattgaagtgttgcctactcagctgatccccgatgacaacgagggaaaagtgttgagagtgaagctcatcatgaaagaaggagttaaatacttcaaccccgtctacttattcgacgaaggctccaccgtatcctggatcccgtgtggaagaaagctcacttgctcctaccccggcatcaaattcgcctatggtcccgacacttatttcggccatgaggtatccgtgttggaaatggatgggcaatttgacagactagatgaactcatctatgttgaaagccatttgagcaacatttccaccaaattctacggcgaaatcacgcagcaaatgctgaaacatgctgatttcccgggtagtaacaatgggaccggtttgtttcaaaccatagtcgggttaaagatcagagacttgtttgaacaaattgcagccaataaggggtctgctgcacttcaagcttcaaaagcttgatcatatatatattataagtatgagttcatgttgtgatcacatatgtattttattattccatttgtgtacttattccatgcagatatgtaatataagcataccaattcattaaa

SEQ ID NO: 1213 - DNA, 1996 bp, Gossypium raimondii
cagccactccattcatgccacgtgtcaccagaatatccaaactacaacgaatgacaaccccatgctctgtaacaaaagcatttcaaattactcttttgtccctttccaattgaatcaagtccattcatgcacacctgcaaaacccgtccaaaactaggggcagtcacaggaacccacaaacgaaatacacctcagctgttcaaccatttttcttcaacctttttcctcctcttatttgtgttccataatttcccttgtaaggacaataatccaaacacgtttttatgtggtctttgattgaggaccatctaacactatttgcccatttttagcaacctcttcttctcttaaagctctctactctacaattctgcttcctagcagacagaaccagagagagtgaggtagctaaacaatggcagtttgcccagtatacaccacccaatctctcaactcaacatgttcaatctccacaccatcaaaaacccacttcagttctcaccacaaccacttagttttctacagaactagcaagagaactagcaagagaggtggcagcagctcatgtgtgataacctgctcagctggtgattcacaaacagttgtgattggtttagctgctgactcaggatgtgggaagagtacctttatgaggaggctaacaagtgtgttcggtggtgcagctgagccaccaaagggaggcaaccctgattccaacacactgatcagcgacatgaccactgtgatatgtttagatgattatcattcacttgacagaactggaaggaaagagaagggagtgacagcacttgacccaagagccaatgactttgacctcatgtatgaacaagttaaggctctcaagagtggtattgctgtcgacaagcctatctacaaccatgttactggtctcttggatcctcctgagctaattaagcctccaaagatccttgtcatcgaaggactgcaccccatgtttgatgaacgtgtgagggatctgttagacttcagtatctatttggatatcagcaatgaggtcaaatttgcatggaaaattcagagggacatggctgagagaggacacagccttgaaagcattaaagccagtattgaagccagaaagcccgatttcgatgcctttatcgatcctcaaaagcaatacgccgatgcagtaatcgaagtgctcccaactcagctgatcccagatgacaatgaggggaaggttttgagagtgaggttgataatgaaagaaggggtggagcatttcagtccagtttacctgtttgatgaaggctcaaccatctcatggataccatgtggaaggaagctcacttgttcttaccctggcatcaaattctcctatggccctgacacatacttcggccatgaggtttctgttctggagatggacgggcaatttgacagattagatgaactgatatacgtagaaagccatttaagcaatctctctaccaagttctatggagaagtcactcaacaaatgttgaagcatgctgatttcccaggaagtaacaatggaactggcctcttccaaaccattgtggggttgaagataagagacctgtatgagcaaattaccgctatcaaaactgcagctccattacaggcaacaaaagcctaagagtttcctcatacattgggcaaggctttggctttggcttcactcttttcagttttccacaatttccacctcctatgtatttattttctcctgttgtaatttagaaaaacgaatcagagatcaaattcaagaagttcatacaaggattccatcatctctcctcctcttgtttgtaatcattaatgatgcttatgatttttgtttttttttgtttttgtttttggaataagaggattggctatggagcatggccataatgtgacattctccaatctgttgcgacacttttaataacgtgtaaaacaaaattaaagaaaaaaagcgcaaacaagtagtgcagaaaaggaaataata

SEQ ID NO: 1214 - DNA, 1463 bp, Centaurea maculosa
agaaaaaaaaatggcagtgtccacagtgtacacagtccaatctctcaactcatcatgttcaatctcaacacccacaaaaacccacttaggaattcagcaaagacaagtgttgttctacagcaatgctggtaaaaagaccaataggggcagggtgagaggtggtgagataagatgtgcaggggacactatagtaatcggactagcagcagactcagggtgtgggaagagtaccttcatgaggaggctgactagtgtgtttggcggtgcagcgtcgccaccaaagggcggcaatccggattcaaacacactcataagtgacacaacaacggtgatctgtttggatgattaccattcattggacagaacaggaaggaaagtggagggtgtgacagcacttgatccaagggccaacaattttgatcttatgtatgaacaggttaaggctcttaaggatggtattgctgttgacaagcccatctataaccatgttagtggtcttttggaccctcctgagctcattcagccccccaagatccttgtcattgaaggtttgcacccaatgtatgatgagagagtaagagacctattggacttcagtatctacttggatatcagcaatgatgttaaatttgcctggaaaattcagagggacatggcagagagaggacacagccttgaaagtatcaaggctagtattgaggcccgaaagccagattttgatgcttatattgacccacaaaagcagtacgcagatgcagttatagaagtgctacctacgcagctgattccaggcgacaatgaagggaaggttttgagagtgaagctgataatgaaagagggagtgaaatacttcagccctgtttacttgtttgatgaaggctccaccatctcatggatcccatgtgggaggaagctcacctgttcttaccctggtatcaaatttaactatggccccgattcttactttggccaagaggtctctgtgttggagatggacgggcaatttgacagactggacgagctcatctatgtcgagagccatttgagcaacatctccaccaaattctacggagaaattacacaacaaatgttgaagcatgccgacttccctggtagcaacaatggcacaggtctcttccaaaccattgttggcttgaaaatccgagacctctttgaacaagtcacagcaagcagggcttcagctccattggaagctacaaaagcttaaagtacaagaaacaaaaagtggtttaacatggaacaaaaaagtccttgattttctttcctctacaacctcttttgtctatgtaaaatttccgagtgttaggcttttatcgcgagtttcattgagagttgcactcccatatgtatttagttccatttgtctattccatggagatgtgtaaatagagaatcaaattcttgactgaaaaaagaaaagtaccgactgcgactctgcgttg

SEQ ID NO: 1215 - DNA, 1432 bp, Centaurea maculosa
  misc_feature (233)..(233): n is a, c, g, or t
  misc_feature (242)..(242): n is a, c, g, or t
  misc_feature (299)..(299): n is a, c, g, or t
  misc_feature (302)..(302): n is a, c, g, or t
  misc_feature (317)..(317): n is a, c, g, or t
  misc_feature (353)..(353): n is a, c, g, or t
  misc_feature (362)..(362): n is a, c, g, or t
  misc_feature (407)..(407): n is a, c, g, or t
  misc_feature (428)..(428): n is a, c, g, or t
  misc_feature (1275)..(1275): n is a, c, g, or t
aagctgtttatctctttctctctctcttgaacttccaaagttagagagaaaaaaaaatggcagtgtccacagtgtacacagtccaatctctcaactcatcatgttcaatctcaacacccacaaaaacccacttaggaattcagcaaagacaagtgttgttctacagcaatgctggtaaaaagaccaataggggcagggtgagaggtggtgagataagatgtgcaggggacacnatagtaatnggactagcagcagactcagggtgtgggaagagtaccttcatgaggaggctgactagngtntttggcggtgcagcntcgccaccaaagggcggcaatccggattcaaacacnctcataagngacacaacaacggtgatctgtttggatgattaccattcattgganagaacaggaaggaaagtgganggtgtgacagcacttgatccaagggccaacaattttgatcttatgtatgaacaggttaaggctcttaaggatggtattgctgttgacaagcccatctataaccatgttagtggtcttttggaccctcctgagctcattcagccccccaagatccttgtcattgaaggtttgcacccaatgtatgatgagagagtaagagacctattggacttcagtatctacttggatatcagcaacgatgttaaatttgcctggaaaattcagagggacatggcagagagaggacacagccttgaaagtatcaaggctagtattgaggcccgaaagccagattttgatgcttatattgacccacaaaagcagtatgcagatgcagttatagaagtgctacctacgcagctgattccaggcgacaatgaagggaaggttttgagagtgaagctgataatgaaagagggagtgaaatacttcagccctgtttacttgtttgatgaaggctccaccatctcatggatcccatgtgggaggaagctcacctgttcttaccctggtatcaaatttaactatggccccgattcttactttggccaagaggtctctgtgttggagatggacgggcaatttgacagactggacgagctcatctatgtcgagagccatttgagcaacatctccaccaaattctacggagaaattacacaacaaatgttgaagcatgccgacttccctggtagcaacaatggcacaggtctcttccaaaccattgttggcttgaaaatccgagacctctttgaacaagtcacagcaagcagggcttcagctccattggaagctacaaaagcttaangtacaagaaacaaaaagtggtttaacatggaacaaaaaagtcccttgatttttctttcctctacaacctcttttgtcatgtaaaatttccgagtgttaggcttttatcgcgagtttcatgagagttgcactcccatatgtatttagttccatttgtc

SEQ ID NO: 1216 - DNA, 1397 bp, Cichorium intybus
agaaagttaagagagaaaaatggcagtgtcgacagtgtacacagtccaatctttgaactcaacatgttcatcaatctcaacacccagcagtaaaagccagttgggaattcagcaaagacaagtgttgttctatggtagaaagacaaacaggggaaggttggtgagaggtggagagataagatgctcaggggacacgatcgtaattggactggcagcagactcagggtgtgggaagagtaccttcatgaggaggttgacgagtgtgtttggaggtgcagcagagccgccaaggggagggaatcctgattccaacacactcataagtgacaccacaaccgtcatatgtttggatgactaccattcattggatcgaacagggaggaaagtggagggagtcacagctcttgatccaagagccaacaattttgatctcatgtatgaacaggttaaggctcttaaagacggtattgctgttgataagcctatttataaccatgttagtggtcttttggaccccccagagctcattaagccccctaagatccttgtcattgaaggtttgcatccaatgtatgatgagagagtaagagacctgctggacttcagtatttacttggacatcagcgacgatgttaaatttgcctggaaaattcagagggacatggcagagagaggacacagtcttgaaagtattaaagctagtattgaggccagaaagccagattttgatgcttatattgacccacaaaagcagtatgcggatgcggtcatagaagtgctaccaacacagctgattccggatgataatgaaggaaaggtgttgagagtgaagctgataatgaaagagggagtgaaatacttcaaccctgtttacttatttgatgaaggatccaccatctcatggatcccatgcgggaggaagctcacctgttcttaccctggaatcaaattcgcgtatggccctgattcttactatggccatgaggtgtctgtgttggagatggatgggcaatttgacagactggatgagctcatctatgttgagagccacttgagcaacatttccaccaaattctatggagaaatcactcagcaaatgttgaagcattcagacttccctggaagcaacaatggaacgggtctattccaaaccattgtcggtttgaaaatcagagacctttttgaacaaatcatagccgccagggcctccgctccattggaagctacaaaagcttaaacttttatctttcctccaaaacctctcttttcatgtaaaatcattccgagtgttaggcatttacactcccatatgtatttagttccaatctctgttatattaatatctgttatatagagaatcaatttctggaaggatttcaaaacaataattgcgaatt

SEQ ID NO: 1217 - DNA, 1555 bp, Solanum melongena
attaatctctccagctctatcagaaaatcagagagaaagaaagagcctccatagttctctctaaaaaaactctcgaggaaaaatcaagaaaatatggcagtttgtacagtgtacacagctcaatcactcaattcaacttgttcaatctccaccccatcaaaatcccacttaggatttcaccaaaaacaagtaattttctacacaaaaagaacaaacagaacaagaagccaaacaaatcatgtgataacatgttctgcagatgctgaaaagacagttgtaattgggttagcagcagactctgggtgtggcaaaagtacatttatgaggagattaacaagtgtttttggtggtgctgctgagccaccaaaaggtggaaatccagattcaaacacattgatatcagacatgactactgtgatttgtcttgatgattatcattcacttgataggactggaaggaaggaaaaaggggtaactgctcttgatcctagagctaatgattttgaccttatgtatgaacaagttaaggctattaaggatggcattgctgtgcaaaagcctatttataatcatgttagtggtcttcttgatcctcctgagctcattaagcctcccaagattcttgtcattgaaggattacaccccatgtttgatgagcgtgtgagagagctcttggacttcagtatctacttggatatcagcaatgaggtcaagtttgcttggaagatccagagggatatggctgagagaggacacagccttgagagcattaaggccagtattgaagccaggaaaccagattttgatgcttacatagacccacaaaagcaatatgcagatgcagtcattgaagtgctcccaactcagctaatcccagatgacaatgaaggaaaagttttgagagtgagattgataatgaaggaaggagtgaaaaacttcaatccagtttacctgtttgatgaaggctccacaatctcatggattccttgtggtaggaagttgacttgttcttaccctggcatcaaattcacctatggccctgacagctacttcggcaatgaggtatctgtcttggagatggatggtcaattcgacagactagatgagctcatctatgtggagagccacttgagcaacctctccagcaaattctatggtgaagttactcaacaaatgttgaagcatgccgacttccctggcagcaacaatggaacaggttttttccagaccattgtcggtttgaagatcagagacctgtacgagcaaattgttgcaagcagagctggggctcctgtgcaagctgcaaaggcctaaactttgccaaactctattaacagctaggcatcagaatcatctgttgtaccttgttgttccccctcttccctaaattttatttgccgacttctttcccccacttgtctcagtttcatggtagataattccccataaatgagaaaatacactttgttatgtatttatttgtagctggaaatgtgttgagaattgtaacatggacaataaaacgtgaaatgaatttcaattccgagcagttttt

SEQ ID NO: 1218 - DNA, 1454 bp, Flaveria ramosissima
ttatttgaacacacatatgataactagtcaaccacacacaaatcttgaattccacattgaaaaagctccaacctttatacctctttctctctcaaaacttcaggaaacaagagagtaacaatggcagtgtgcacagtgtacacactgcaacctctcaactcatcatgctcaatctcatcacgcacaaaaacccacatgggattcacccaaaagcaagtctttttctactccaatggtagtaaaaagactaaaagcaagaggtatagaacaggtggtgagatcacatgctcaggggacacaatagtaataggacttgcagcagactcagggtgtggtaaaagcaccttcatgaggaggttaaccagtgtgtttggtggtgcagcctctccaccaaagggtgggaaccctgactcaaacacactcataagtgacaccaccactgtcatatgtttagatgactatcattcattagatcgcacaggaagaaaagagaagggtgtgactgcacttgacccacgagccaatgactttgatctgatgtatgaacaggttaaggcgcttaaagatggtgtggctgttgagaagcccatttataaccatgtttcgggtcttttggaccctcctgagctcattaaaccacccaagattcttgttattgaaggtctgcatccaatgtatgatcagagagtaagagacctcctggacttcagtatttatttggacatcagcaacgaggttaaattcgcatggaaaatccagagagatatggcggagagaggacacagtcttgaaagcattaaagctagcattgaggccagaaaaccggacttcgatgcttatatcgacccgcaaaagcaatacgcggatgcagtaatcgaagtgctgcctacacagctaattcctgatgacaacgagggaaaggtgttgagagtgaagctcatcatgaaagaaggagttaagtacttcaaccccgtctacttattcgatgaaggttccaccatctcatggatcccgtgtggaagaaagcttacttgctcgtatcctggcatcaaattcgcctacggtccagacacttatttcggccatgaggtttcagtgttggaaatggatgggcagtttgacagattagatgaactcatctatgttgaaagccatttgagcaacatttcgacaaaattctacggtgaaatcacccaacaaatgttgaaacatgctgatttcccgggcagcaataatggtactggtttgtttcaaaccattgtcgggttgaagatccgagatttgtttgaacaaattgcagccaataagggatcagttccacttgaagctacaaaagcttgatcacaaatgaagagttattatgagttcatgttgttatcacatatgtatttagctagttccatttgtgttttctgtggagatatgtaatgtaagtataccaattaataaatgaa

SEQ ID NO: 1219 - DNA, 1521 bp, Flaveria ramosissima
ttccacattgaaaaagctccaacctttatacctctttctctctcaagacttcaagaaacaagaaagtaacaatggcagtgtgcacagtgtacacactgcaacctctcaactcatcatgctcaatctcatcacccacaaaaacccacatgggattcacccaaaagcaagtctttttctactccaatggtggtaaaaagactaaaagtaacaggtatagaacaggtggtgagatcacatgctcaggggagacaatagtaataggacttgcagcagactcagggtgtggtaaaagcacctttatgaggaggttaaccagtgtgtttggtggtgcagcctctccaccaaagggtgggaaccctgactcaaacacactcataagtgacaccacaactgtcatatgtttagatgactatcattcattagatcgcacaggaagaaaagaaaagggtgtgactgcacttgacccacgagccaatgactttgatctgatgtatgaacaggttaaggcgcttaaagatggtgtggctgttgagaagcccatttataaccatgtttcggggcttttggaccctcctgaactcattaaaccacccaagattcttgttattgaaggtctgcacccaatgtatgatcagagagtaagagacctcctggacttcagtatttacttggacatcagtaacgaggttaaattcgcatggaaaatccagagagatatggcggagagaggacacagtcttgaaagcattaaagctagcattgaggcccgaaaaccagattttgatgcttatatcgacccgcaaaagcaatacgcggatgcagtaattgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaacccatttgagcaacatttcgacgaaattctatggtgaaatcacccaacagatgttgaaacatgctgatttcccaggtagcaataatggtactggcttgtttcaaaccattgtcgggttgaagatccgagatttgttcgaacaaattgcagccaataagggatcagctccacttgaagctacaaaagcttgatcataaatgaagagttattatgagttgatgttgttatcacatatgtatttagctagttccatttgtgtattatgtggagatatgtaatgtaagtataccaattcataaatgaaaccctgagtgagattgtcataagttgcaacatactcattttccgcttgtcggttttgtggacacttgtcatgacagttagccgtctttctaattataagtaaaagaatatgagatg

SEQ ID NO: 1220 - DNA, 1513 bp, Flaveria ramosissima
aaaagctccaacctttatacctctttctctctcaagacttcaagaaacaagagagtaacaatggcagtgtgcacactgtacacactgcaacctctcaactcatcatgctcaatctcatcacccacaaaaacccatatgggattcacccaaaagcaagtctttttctactccaatggtagtaaaaagactaaaagcaagaggtatagaacaggtggtgaaatcacatgctcaggggacacaatagtaataggacttgcagcagactcagggtgtggtaaaagcacctttatgaggaggttaaccagtgtgtttggtggtgcagcctctccaccaaagggtgggaaccctgactcaaacacactcataagtgacaccacaactgtcatatgtttagatgactatcattcattagatcgcacaggaagaaaagaaaagggtgtgactgcacttgacccacgagccaatgactttgatctgatgtatgaacaggttaaggcgcttaaagatggtgtggctgttgagaagcccatttataaccatgtttcggggcttttggaccctcctgaactcattaaaccacccaagattcttgttattgaaggtctgcacccaatgtatgatcagagagtaagagacctcctggacttcagtatttacttggacatcagtaacgaggttaaattcgcatggaaaatccagagagatatggcagagagaggacacagtcttgaaagcattaaagctagcattgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggacgggcagtttgacagactagatgaactcatctatgttgaaagtcatttgagcaacatttcgacgaaattttatggtgaaatcacacaacaaatgttgaaacatgctgatttccccggtagcaataatggtactggcttgtttcaaaccattgtcgggttgaagatccgagatttgtttgaacaaattgcagccaataagggatcagctccacttgaagctacaaaagcttgatcgcatatgaagagttattatgagttcttgttgttatcacatatgtatttagctagttccatttgtgttttctgtggagatatgtaatgtaagtataccaattcataatgaaaccctgagtgagattgtcataagttgcaacattctcattttccgcgtgtcaattttgttgacacttgtcgtgacggttagccgtctttctaattatagtaaaagaaacatgagatgatct

SEQ ID NO: 1221 - DNA, 1470 bp, Flaveria ramosissima
gaccataaacccaattccagtgacacattaaaaggctattttctcattctctctttaaaacttgaataagttgagagagagagagaatggcagtgtgcacagtgtacacagtgcaatctctgaactcaacatgttcaatctcaacaccaacaaaacccatttgggaattcagcaaagacaagttttgttctatagtaaaagaccaataggggcagggtgagaggtggtgagataagctgctcaggggacacaatagtaattggactagcagcagactcagggtgtgggaaaagtaccttcatgaggaggttgactagtgtgtttgaggggcagcagagccaccaaagggaggcaatcctgattcaaacacactcattagtgacaccacaacagttatatgtttagatgattaccattcattggatagaacaggtaggaaagtggaaggggtgaccgcgcttgatccgagagccaataactttgatcttatgtatgagcaggtcaaggctttaaaagatggtattgctgtagagaagcctatttataaccatgttactggtctttttggaccctcctgagctcatcaagccacccaagatccttgtcattgaaggtttgcacccaatgtttgatcagagagtaagagacctcttggacttcagtatctacctggacatcagcaacgatgttaaatttgcctggaaaattcagagggacatggcagagagaggacacagccttgaaagtatcaaagctagtattgaggccagaaagcctgattttgatgcctatattgacccacaaaagcaatatgcagatgcggttatagaagttttgcctacacagctgattccagacgacaatgaggggaaggtgttgagagtgaagttgataatgaaagagggagtgaaatatttcagcccagtttatttgtttgatgaaggttccaccatttcatggattccctgtgggaggaagctcacttgttcttacccgggtatcaaattcgcctatggccctgatacttactacggtcatgaggtgtctgtgttggagatggatgggcaatttgacaaactggatgagctcatctatgttgagagccatttaagtaacatctccaccaaattctatggagaaattacccaacaaatgttgaagcatgccgacttcccaggtagtaacaatggcaccggtctcttccaaaccattgttggtttgaaaattagagatctctttgaacaaatcacagccagcaaggcctcagctcaattggaagctgcaaaagcttaatccaaaatgtaaaaaataaagtccatttttctttctcctacgaactcttcttttcatgtaagattcaagtgttaggcttatatcacgagtctcatgagagttacaatcccatatgtatttatttgcatttctctattccatggagatctgtgatataggaaatcaaattcttaattg

SEQ ID NO: 1222 - DNA, 1637 bp, Ambrosia trifida
gaacttaaccacaaacacacatacacacaaatcttgaatttcaagattggaaagctctaacctttcatctctttatctctctaacacttgtgaaacaagagagagaaagataaacaagtaacaatggcagtgtgcacagtgtacacagtccaagctttaagctcatcatgctcaatctcatcaccaacaaaaacccatatgggattaaagaccaaaagtggcaggtttagaggtggttataagatcacatgttctggtgacacaatagtaataggacttgcagcagattcaggttgtggaaagagtactttcatgagaaggttaaccagtgtgtttggtggtgcagcctctccaccaaagggtgggaaccctgactcaaacacacttataagtgacacaactactgtcatatgtttagatgattatcattcattggatagaactggaaggaaagaaaagggtgtgactgcacttgacccaagagccaatgactttgatcttatgtatgaacaggttaaggcacttaaagatggtgtggctgttgacaagcctatttataaccatgtttctggtcttttggaccctcctgagcttattaaaccacccaagattcttgtcattgaaggtctacatccaatgtatgatcagagagtaagagacctactggacttcagtatataccttgacattagtaacgaggttaaattcgcatggaaaatccagagagatatggctgagagaggacacagtcttgaaagcattaaagctagcattgaggccagaaaaccagattttgatgcttatatcgacccgcaaaagcaatacgcggatgccgtaattgaagtgttgcctactcagctgatccccgatgacaatgagggaaaagtgttgagagtgaagctcatcatgaaagaaggagttaaatacttcaaccccgtctacttattcgacgaaggctccaccgtttcctggatcccgtgtggaagaaagctcacttgctcctaccctggcatcaaattcgcctatggaccggacacttattttggccatgaggtatccgtgttggaaatggatgggcaatttgacagactagatgaactcatctatgttgaaagccatttgagcaacatttcaaccaaattctacggtgaaatcacgcaacaaatgctgaaacatgctgatttccctggtagtaacaatggaaccggtttgtttcaaaccatagtcgggttgaagatcagagacttgtttgaacaaattgcagtcagtaaggggtctgctgcacttcaagcttcaaaagcttgatcatatatattataactatgagttcatgttgtgatcacatatgtattttattttattccatttgtgtacttattccatgcagatatgtaatataagcatataccaattcattaaataaaacattggtaattatggttattaaaagttatattattattgtaaactgcgtgtcgattttgttgccacgtgtcgtgaggattggggttctttctaaatatagtaaaggttgcatgagatgatgatgaaagaggtttgaatttgaaggaggataggttttgaagtccaagttgaattgggtaggaggtatgtgtcttttaatgcttgttaggata

SEQ ID NO: 1223 - DNA, 1623 bp, Manihot esculenta
aggcaaggccactcaatttcttctttcccaaacaaactgccatctgtttttcctttttggtatttatacattggaataattacttgaattttccatttcatgcctcttcacacaagaaactgaaaattgccaagattctcatttccaattcttaagaaatggcaatttgcacagtttacactacccaatctctgaattcaacatgctcaatttacactccaggaaaaacccactttggatttaaccaaaaacatcttgtgttgtatagcagcagtagcaagagaatcaataggagagcttccactagtgtaataacatgctcagcagaagattcacagactgttgtgattggtctagctgcagactcagggtgtgggaagagtaccttcatgaggaggctgactagtgtgtttggcggtgcagcggagccaccaagaggaggcaatcctgattcaaatacactcatcagtgacacaactactgtgatatgtttagatgattatcactcactggatagaacaggaaggaaggaaaaaggagttacagcacttgatccaaaagccaatgattttgatctcatgtgtgagcaagttaaagctcttaaagatgggattgctgttgagaaacctatctataatcatgtcactggtctccttgatccccctgagctcatcaagcctcctaagattcttgttattgaaggtcttcacccaatgtttgatgaacgtgtaaggaaactgttagacttcagcatctatttggacataagcaatgaggttaaatttgcatggaaaattcagagggacatggcagagcgaggacatagtcttgaaagcattaaagccagtattgaagcacgcaagcctgactttgatgcttatattgatccacaaaagcaatatgcggatgcagtgatagaagtgctgccaacccaactgattccaggggacaatgaggggaaaatattaagagttagaatgataatgaaagaaggagttgagtatttcatccccgtctacttgtttgatgaaggatccaccatttcatggataccttgtggtaggaagctcacctgctcttatcctggcatcaagttctcctacggccctgaaacttattttggccacgaggtgtctgtagtggagatggatgggcaattcgacagattagatgagctcatatatgtagaaagccatctaagcaacatctccaccaagttctatggagaagtcactcagcaaatgttgaagcatgcagatttccctggaagtaacaatggaacaggtctcttccaaacaatcataggattgaaaataagagatctttatgagcaaatcattgctagtaaggcaaaggctcgtgtagaagcaaaagcctaatacattaactgtctctgtcttgaatactgaacagaacattcttattctctaagttctaccaccttttcctactttcttcctttttccctgcccactgtttctgatcgagttttaggctattcctcacaagagtcagaaacacttgtgtagctatcggtgttataactctctggagatttgtgaaatatagataaatcaaaagctagcagagattaaattcagttcaagtcctttcaacatgacc

SEQ ID NO: 1224 - DNA, 1982 bp, Ricinus communis
aaacaaagggtagccatagaaatccataaaacattaaaacaaagaagacacatcagcctcccatcaccaggcttgagcagttttatttcccatacaaagtgccatctgttttctctcttcaacctttttttcatcctcttattatttttgatattattattgttattattaggagcagaagtgtccataaaataatttatattgtacatgtcctgttcaaagaaccattaggcttagctagcttcaaagaaaaaagaattgccaagagcccagttcactgctcttaatttcttctcaagaaatggcaatttgcacagtgtacacaacccaatccctgaattcaacatgctctatctcaacaccaggaaaaacccacttgggatttaaccaaaaacaagtagtgttttatagcaaaaggaccaacaagagagctactagcactagtgtgataacatgctcagcagacgactcacagacagtggtgattggtctagcagcagattcaggatgtggcaagagtactttcatgagaaggttaacaagtgtatttggaggtgcagcagagccaccaaaaggagggaaccctgactcaaacacacttattagtgatacaactactgttatttgtttagatgattatcattcacttgataggactggaaggaaagaaaagggtgtcacagcacttgacccaagagccaatgattttgatcttatgtacgaacaagttaaagctattaaagatggtgtagctgttgaaaagccaatctacaatcatgttactggtttgttggatcctcctgagcttatcaagcctcctaagattcttgtcattgaaggcctccacccaatgtatgatcaacgtgtgagggaccttttagacttcagtatctatttggacatcagcaatgaggttaaatttgcatggaaaattcagagagacatggcagagcgaggacacagccttgaaagcattaaagccagtattgaagcacgcaagcctgattttgatgcttatattgatccacaaaagcaatacgcagatgcggtgatcgaagtgctgccaactcaactaattccagatgacgagggaaaggttttgagagttagactgataatgaaagaaggggtgaagaatttcaacccagtttatttgtttgatgaaggctctacaatctcgtggattccttgtggtaggaagctcacctgctcttaccccggcatcaaattcttctacggtcctgaaacttacttcggccacgaggtgtctgtattagagatggatgggcaattcgacagattagatgagctcatttacgtggaaagccatctgagcaacatctccactaaattctacggagaggtcacccaacaaatgctgaagcatgctgatttccctggaagtaacaatggaacgggtctcttccaaaccattgtcgggttgaaaataagagacctctacgagcaaatcatcgccagcaaggccaaaactcctgtagaagccaaagcttaattcaactgcatgcttccctgcctaccttaagtactcaacaaggcttccccctttctttcttttttctttttggttggtttcatgatgcttcagttgagatttaggctattcctcagtaagaatcagaacacttaaattgtatctatttgatattgtaattctgtggagattggtgtaaattagagagaatcaaaagcagcgattaaattcagttaacaaatttcatacaagaccacagtccttttgggattatcttctgtctggttcgtctactgctcttcttgcagcaccagcttattcatattctctagctacttcacggccacaaataatgttcatctgaataatgttcccaaattatatccacttagatttcatcttacctgcagatttgcgcagttgttcagtcatgaagataatttaacgatctattcaaatgttatatctgcatttccagcattgacaagat

SEQ ID NO: 1225 - DNA, 1618 bp, Gossypium hirsutum
tcttcttctcttaaagctctctactctacaattctgcttcctagcagccagaaccagagagagtgaggtagctaaacaatggcagtttgcccagtatacaccacccaatctctcaactcaacatgttcaatctccacaccatcaaaaacccacttcagttctcaccacaaccacctagttttctacagaactagcaagagaactagcaagagaggtggcagcagctcatgtgtgataacctgctcagctggtgactcacaaacagttgtgattggtttagctgctgactcaggatgtgggaagagtaccttcatgaggaggctaacaagtgtgttcggtggtgcagctgagccaccaaagggaggcaaccctgattccaacacactgatcagcgatatgaccactgtgatatgtttagatgattatcattcacttgacagaactggaaggaaagagaagggagtgacagcacttgacccaagagccaacgactttgacctcatgtatgaacaagttaaggctctcaagagcggtattgctgtcgacaagcctatctacaaccatgtttctggtctcttggatcctcctgagctaattaagcctccaaagatccttgtcatcgagggactgcaccccatgtttgatgaacgtgtgagggatctgttagacttcagtatctatttggatatcagcaatgaggtcaaatttgcatggaaaattcagagggacatggctgagagaggacacagccttgaaagcattaaagccagtattgaagccaggaagcctgatttcgatgcctttatcgatcctcaaaagcaatacgccgatgcagtaatcgaagtgctcccaactcagctgatcccagatgacaatgaggggaaggttttgagagtgaggttgataatgaaagaaggggtggagcatttcagtccagtttacctgtttgatgaaggctcaaccatctcatggataccatgtggaaggaagctcacttgttcttaccctggcatcaaattctcctatggccctgacacatacttcggccatgaggtttctgttctggagatggacgggcaatttgacagattagatgaactgatatacgtagaaagccatttaagcaatctctctaccaagttctatggagaagtcactcaacaaatgttgaagcatgctgatttcccaggaagtaacaatggaactggcctcttccaaaccattgtggggttgaagataagagacctgtatgagcaaattaccgctatcaaaactgcagctccattacaggcaacaaaagcctaagagtttcctcatacattgggcaaggctttggctttggcttcactcttttcagttttccacaatttccacctcctatgtatttattttctcctgttgtaatttagaaaaacgaatcagagatcaaattcaagaagttcatacaaggattccatcatctctcctcctcttgtttgtaatcattaatgatgcttatgattttttattttttgttttgttttggaataagaggattggctatggagcatggccataatgtgacattctccaatctgttgcgacacttttaataacgtgtaaaacaaaaattaaagaa

SEQ ID NO: 1226 - DNA, 1529 bp, Flaveria ramosissima
tttttgaacacacatatgataactagtcaaccacacacaaatcttgaattccacattgaaaaagctccaacctttatacctctttctctctcaaaacttcaagaaacaagagagtaacaatggcagtgtgcacagtgtacacactgcaacctctcaactcatcatgctcaatctcatcacgcacaaaaacccacatgggattcacccaaaagcaagtctttttctattccaatggtagtaaaaagactaaaagcaagaggtatagaacaggtggtgagatcacatgctcaggggacacaatagtcataggacttgcagcagactcagggtgtggtaaaagcaccttcatgaggaggttaaccagtgtggttggtggtgcagcctctccaccaaagggtgggaaccctgactcaaacacactcataagtgacaccaccactgtcatatgtttagatgactatcattcattagatcgcacaggaagaaaagagaagggtgtgactgcacttgacccacgagccaatgactttgatctgatgtatgaacaggttaaggcgcttaaagatggtgtggctgttgagaagcccatttataaccatgtttcggggcttttggaccctcctgagctcattaaaccacccaagattcttgttattgaaggtctgcacccaatgtatgatcaaagagtaagagacctcctggacttcagtatttacttggacatcagtaacgaggttaaattcgcatggaaaatccagagagatatggcggaaagaggacacagtcttgaaagcattaaagctagcattgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccatttgagcaacatttcgacgaaattctatggtgaaatcacccaacagatgttgaaacatgctgatttcccaggtagcaataatggtactggtttgtttcaaaccattgttgggttgaagatccgagacttgtttgaacaaattgcggccaataagggatcagctccacttgaagctacaaaagcttgatcataaatgaagagttattatgagatgatgttgttatcacatatgtatttagctagttccatttgtgtattatgtggagatatgtaatgtaagtataccaattcataaatgaaaccctgagtgagattgtcataagttgcaacatactcattttccgcttgtcgattttgtggtacacttgtcatgaac

SEQ ID NO: 1227 - DNA, 1397 bp, Flaveria ramosissima
aaaaagctccaacctttatacctctttctctctcaaaacttcaagaaacaagagagtaacaatggcagtgtgcacagtgtacacactgcaacctctcaactcatcatgctcaatctcatcacgcacaaaacccacatgggattcacccaaaagcaagtctttttctattccaatggtagtaaaaagactaaaagcaagaggtatagaacaggtggtgagatcacatgctcaggggacacaatagtcataggacttgcagcagactcagggtgtggtaaaagcaccttcatgaggaggttaaccagtgtgtttggtggtgcagcctctccaccaaagggtgggaaccctgactcaaacacactcataagtgacaccaccactgtcatatgtttagatgactatcattcattagatcgcacaggaagaaaagagaagggtgtgactgcacttgacccacgagccaatgactttgatctgatgtatgaacaggttaaggcgcttaaagatggtgtggctgttgagaagcccatttataaccatgtttcggggcttttggaccctcctgagctcattaaaccacccaagattcttgttattgaaggtctgcacccaatgtatgatcaaagagtaagagacctcctggacttcagtatttacttggacatcagtaacgaggttaaattcgcatggaaaatccagagagatatggcggaaagaggacacagtcttgaaagcattaaagctagcattgaggcccgaaaaccagattttgatgcttttatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccatttcgtggatcccgtgtgggagaaagctgacttgctcatatcctggcatcaaattcgcctatggtccagacacttatttcggccatgaggtttctgtgttggaaatggatgggcagtttgacagattagatgagctcatctatgttgaaacccatttgagcaacatttcgacgaaattctatggtgaaatcacccaacagatgttgaaacatgctgatttcccaggtagcaataatggtacaggtttgtttcaaaccattgtcgggttgaagatccgagacttgtttgaacaaattgcggccaataagggatcagctctacttgaagctacaaaagcttgatcataaatgaagagttattatgagttgatgttgttatcacatatgtatttagctagttccatttgtgtattatgtggagatatgtaatgtaagtataccagttcataaatgaaacc

SEQ ID NO: 1228 - DNA, 1704 bp, Tabernaemontana elegans
aaggaagagaaagaaaaaaccaaacaaacacaaacctcatgtcacagtgcattcactagctacctcacaaaaacctcaattaaggccacataaagggttctgttttgtctgtcaaaattcagtagcactcaaggagtagagggagaagaaaacaatggctgtttccacagtctacacagttcaatccctcaattctacatgctcaatctcaactccatcaaaatcccacttgggatttacccagaaacaccaagttttcttctacagcacaagcaagaaaagtatcaacaccaccagaaggagcagtgaaatatcgtgctcggctcaggagaaaacagtggttataggcttagcagcagactcaggatgtgggaaaagtactttcatgagaagattaacaagtgtgtttggaggtgcagcagagcctccaaagggtggaaatcctgactcaaacacactcatcagtgacatgaccactgtgatttgcttagatgattatcattcacttgatagaactggaagaaaagagaagggagttactgcacttgacccaagagccaacaactttgatcttatgtatgagcaagttaaggctttgaaaagtggcgttgctgttgataagcctatctacaatcatgttactggtcttcttgatcctcctgagctcatcaaacctccaaagattcttgttattgaaggtttgcatccaatgtttgatgagcgtgtaagagatctcctggacttcagtatctacctagacatcagtaacgaggtcaagtttgcatggaaaattcagagagacatggctgagagaggacacagccttgagagtattaaagctagcattgaagccaggaagcctgattttgaagcctatattgatccacagaagcaatatgctgacgctgtcattgaagttttgccaacacaactcattcctgatgacaatggtgggaagattttgagagtaaaattgataatgaaagagggagtgaagcatttcagcccagtttatctatttgatgaaggctctacaatctcatggattccttgtggaaggaagttgacatgttcataccctgggatcaaattctcttatggtcctgacacttactttggcaatgaggtatctgtcttggagatggatggccaatttgacagactcgatgaactgatctatgtggaaagccatttgagcagcctctcaaccaagttctatggcgaagtcactcaacaaatgttaaaacatgctgacttccctggcagcaacaatggcacaggtctcttccaaaccattgttggattgaagatcagagacctctatgagcaaattgcggctaccaaggttgcaactccattggaagcagcaaaggcctaaggaatttgccgatatgtcctgagagtagacgtaaattactccttgctcttaatcctttcctctattttttatttcaattttcctctctccatgtctgagtttgagtttgagtgttaggtttctcatcataaattggaaacactctgcacatgtacttatttccagtgcaaactctgttgggacttgtaatatagagaagcaaaaggagaaatgaaatggaaaagggcttgaaaagctagaatcttttggcgttgtactctttgcttcttacctgctacggagaactcaattgtgttcctaataggaggagagacaatccaaagatt

SEQ ID NO: 1229 - DNA, 1449 bp, Centaurea maculosa
aaaaaaaaatggcagtgtccacagtgtacacagtccaatctctcaactcatcatgttcaatctcaacacccacaaaaacccacttaggaattcagcaaagacaagtgttgttctacagcaatgctggtaaaaagaccaataggggcagggtgagaggtggtgagataagatgtgcaggggacacaatagtaattggactagcagcagactcagggtgtgggaagagtaccttcatgaggaggctgaccagcgtctttggcggtgcagcatcgccaccaaagggcggcaatcccgattcaaacacgctcataagcgacacaacaacggtgatctgtttggatgattaccattcattggatagaacaggaaggaaagtggaaggtgtgacagcacttgatccaagggccaacaattttgatcttatgtatgaacaggttaaggctcttaaggatggtattgctgttgataagcccatctataaccatgttagtggtcttttggaccctccagagctcattaagccccccaagatccttgtcattgaaggtttgcacccaatgtatgatgagagagtaagagacctattggacttcagtatctacttggatatcagcaacgatgttaaatttgcctggaaaattcagagggacatggcagagagaggacacagccttgaaagtatcaaagctagtattgaggcccgaaagccagattttgatgcttatattgacccacaaaagcagtatgcagatgcagttatagaagtgctacctacgcagctgattccaggcgacaacgaagggaaggtcttaagagttaagctgataatgaaagagggagtgaaatacttcagtcctgtttacttgtttgatgaaggctccaccatctcatggatcccatgtgggaggaagctcacctgttcttaccctggtatcaaattcaactatggccccgattcttactttggccaagaggtgtctgtgttggagatggacgggcaattcgacagactggatgagctcatctatgtcgagagccatttgagcaacatctccaccaaattctacggagaaattacacaacaaatgttgaagcatgccgacttccctggtagcaacaatggcaccggtctcttccaaaccattgttggcttgaaaatccgtgacctctttgaacaaatcacggcaagcagggcttcggctccattggaagctacaaaagcttaaagtaaagaaacaaaaagtggtttaacatggaaacaaaaagtccccttgattttcttccttctacaacctcttttgtcatgtaaaatttcccgagtgtttaggcttttatcgcgagtttcatgagagttgcactcccatatgtatttagttccatttgtctattccatggagatatgtaaaatagagaatcaaattcttgactgaaatcttgagaagatcaaag

SEQ ID NO: 1230 - DNA, 1281 bp, Flaveria ramosissima
ttccacattgaaaaagctccaacctatatacctctttctctctcaagacttcaagaaacaagagagtaacaatggcagtgtgcacagtgtacacactgcaacctctcaactcatcatgctcaatctcatcacccacaaaaacccacatgggattcacccaaaagcaagtctttttctactccaatggtagtaaaaagactaaaagcaagaggtatagaacaggtggtgaaatcacatgctcaggggacacaatagtcataggacttgcagcagactcagggtgtggtaaaagcaccttcatgaggaggttaaccagtgtgtttggtggtgcagcctctccaccaaagggtgggaaccctgactcaaacacactcataagtgacaccacaactgtcatatgtttagatgactatcattcattagatcgcacaggaagaaaagagaagggtgtgactgcacttgacccacgagccaatgactttgatctgatgtatgaacaggttaaggcgcttaaagatggtgtggctgttgagaagcccatttataaccatgtttcggggcttttagaccctcctgaactcattaaaccacccaagattcttgttattgaaggtctgcacccaatgtatgatcagagagtaagagacctgctggacttcagtatttacttggacatcagtaacgaggttaaattcgcatggaaaatccagagagatatggcggagagaggacacagtcttgaaagcattaaagctagcatcgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccatttgagcaacatttcaacgaaattctatggtgaaatcacccaacagatgttgaaacatgctgatttcccaggtagcaataatggtactggcttgtttcaaaccattgtcgggttgaagatccgagatttgttcgaacaaattgcagccaataagggatcagctccacttgaagcta

SEQ ID NO: 1231 - DNA, 1558 bp, Helianthus annuus
acttatagccatatagccatagtggtataccccactgatcctttaaagaaattaaccacacacacacacaacacaatacacaacacaaatcttgaatttcaagattggaaagctctaaccttttatctacttatcttatattctctctctctagaacttgagaaacaagagagagaaacaaaccaacaatggcagtgtgcacagtgtacacagtccaagctctaagctcatcatgctcaatctcatcacccacaaaaacccacatgggattgagcccaaaacaggtgttgttctacaacaatagtggcaaaaagaccaaaagtgggaggtttagaagtggtgagatcacatgctctggtgacacaatagtaataggactagcagcagactctgggtgtggaaaaagcaccttcatgagaaggttaaccagtgtgtttggtggtgcagcctctccaccaaagggtgggaaccctgactcaaacacacttataagtgacacaaccactgtcatatgtttagatgattatcattcattggatagaactggaaggaaagaaaagggtgtgactgcacttgaccctagagccaatgactttgatcttatgtatgaacaggttaaggctcttaaagatggtgtggctgttgagaagcctatttataaccatgtttctgggcttttggaccctcctgagctcattaaaccacctaagattcttgtcattgaaggtttgcacccaatgtatgatgagagagtaagagacctactggacttcagtatttacctggacattagtaacgaggttaaattcgcatggaaaatccagagagacatggcagagagaggacatagtcttgaaagcattaaagctagcattgaggccagaaaaccagattttgacgcttatatcgacccgcaaaagcaatacgcggatgcagtaatcgaagtgttgccaacccagttgattcccgatgacaatgagggaaaagtgttgagagtgaagctcatcatgaaagaaggagttaaatacttcaaccccgtctacttattcgacgaaggttccactgtttcatggatcccatgtggaagaaagctcacttgctcgtaccctggcatcaaattcgcctatggtccagacagctatttcggccatgaggtttcagtgttggagatggatggacaatttgacagactagatgaactcatctatgttgaaagccatttgagcaacatttcgacaaaattctatggcgaaatcacgcaacaaatgttgaagcattctgacttccccggtagtaacaatggtaccggtttgtttcaaaccatagtcgggttgaagatccgagatttgtttgaacaaattgcagccggtaaaggagctgtctcacttgaagcttcaaaagcatgatcatacataaacaaagagttattattatgagttcatgttgtgatcacattatatgtattttattccatttatgtatgtatgtattccttggctatatgtaatataagtacaccaattcataaatgtaatcctggtaattatgtttattaaaa

SEQ ID NO: 1232 - DNA, 1530 bp, Centaurea maculosa
aaaaaatggcagtgtccacagtgtacacagtccaatctctcaactcatcatgttcaatctcaacacccacaaaaacccacttaggaattcagcaaagacaagtgttgttctacagcaatgctggtaaaaagaccaataggggcagggtgagaggtggtgagataagatgtgcaggggacacaatagtaattggactagcagcagactcagggtgtgggaagagtaccttcatgaggaggctgaccagcgtctttggtggtgcagcatcgccaccaaagggcggcaatcccgattcaaacacgctcataagcgacacaacaacggtgatctgtttggatgattaccattcattggatagaacaggaaggaaagtggaaggtgtgacagcacttgatccaagggccaacaattttgatcttatgtatgagcaggttaaggctcttaaggatggtattgctgttgataagcccatctataaccatgttagtggtcttttggaccctccagagctcattaagccccccaagatccttgtcattgaaggtttgcacccaatgtatgatgagagagtaagggacctcttggacttcagtatctacttggatatcagcaacgatgttaaatttgcctggaaaattcagagggacatggcagagagaggacacagccttgaaagtatcaaagctagtattgaggcccgaaagccagattttgatgcttatattgacccacaaaagcagtatgcagatgcagttatagaagtgctacctacgcagctgattccaggcgacaatgaagggaaggtcttaagagttaagctgataatgaaagagggagtgaaatacttcagtcctgtttacttgtttgatgaaggctccaccatctcatggatcccatgtgggaggaagctcacctgttcttaccctggtatcaaattcaactatggccccgattcttactttggccaagaggtgtctgtgttggagatggacgggcaattcgacagactggatgagctcatctatgtcgagagccatttgagcaacatctccaccaaattctacggagaaattacacaacaaatgttgaagcatgccgacttccctggtagcaacaatggcaccggtctcttccaaaccatcgttgggttgaaaatccgagacctctttgaacaaatcacggcaaccagggcttcagctccattggaagctacaaaagcttaaagtaaagaacaaaaagtggtttaacatggaacaaaaagtcccttgatttttctttcctccacaacctcttttgtcatgtaaaatttccgagtgttaaggcttttatcgcgagtttcatgagagttgcactcccatatgtatttagttccatttgtgtattccatggagatatgtaaaatagagaatcaaattcttgactgaaatcttgagaagatacaaagaacttattattaagattaatacttgcgcataccagaacgtataaagtgacaggtaagctaatgtttataagtattaataaaactag

SEQ ID NO: 1233 - DNA, 2115 bp, Chelidonium majus
caagtagtattcttcacaactaccaggaaatccaacagaagaaacaattcctactcttctgaaatttcatgttcagctgaggaagcaaagactattgtaattggattagcagcagattctggttgtgggaagagtacttttatgaggagattgacaagtgtatttggtggtgcagcagaaccaccaaagggtggtaaccctgattcaaacactttgattagtgacacaactactgtgatctgtttggatgattaccattcacttgatagaacaggaaggaaggagaaaggtgtgactgcacttgacccaagagccaatgattttgatcttatgtatgaacaggttaaggctcttaagcaagggattccagttcagaagcctatttataaccatgtttctggtctcttagatcctcctgagcttattcaacctcctaagatccttgtcattgaaggacttcacccaatgtacgattctcgcgttagagaccttctcgacttcagtatctacttggatatcagcaatgaagtcaagtttgcttggaaaattcagagggacatggcggaacgtgggcacagtctcgaaagtattaaagctagtatcgaagctcgaaagccagatttcgacgcttacatcgatccacagaagcaatatgcagatgccgtgatcgaagtactaccaactgagctaattccagatgacaatgaggggaaagttttgagagttcgattgattatgaaagaaggggtgaaatatttcagcccggtttacttgttcgacgaaggctcaaccatttcttggattccctgtggaaggaaattgacatgttcataccctggcatcaagttcaactacggcccagatgcttactttgacaatgaggtgtctgtgttggagatggatggacaatttgacagattagatgagcttatttatgtggagagtcatctgagcaacatctctaccaagttttacggagaagttactcagcaaatgttaaagcatgccgacttccccggaagcaacaacgggacaggtctcttccaaaccatggttggattgaagatcagagacctctacgaacagcttgtggctaacaaagctgcagctccattacaagctaccaaagcttaataacgggacttttcgcagtcatttaaatcaccattaattctctgaagtttttcactttcttcttcttcttcttcttcttcctcataaggttaagaaaacttttatatgtatttcatgttgtaatgtcgtgggatagaccctagtgaaagtatgtgagctaatataccaccaacttgtccaacaaccatcccctaccctttccctgaaactaataaaacttcttcttcttctactactgattttagagagagagagaggcgaacggactggtagtaaagatggatccagattcattatctagggcattcgtagagcactattactcaacatttgatacgaatcgtgctaaccttggtggcttatatcaagaaggttctatgttaacctttgaaggtcagaagatccaaggctcacaaaacattgttgcaaaattgagcagcttaccattccagcagtgtaaacattccatctccaccgttgattgccagccttctggacctgctggtggtatgcttgttttcgtcagtggcaatcttcaactcgccggtgaacaacatgctctcaagttcagtcagatgttccatttgatgcctactcaagggggaagcttctatgtgttcaatgacatattccggttgaattatgcttgagactatgagaatgatcacccagtcaggaatttgatgctggttgttttggggagttatatgtgaatttgaatgtgaagggatcagatgaatatttcttacttctgatttgtagcttttagacttgttaaaatgagtgggtaatattgctttgtttggatatgttgctttgtttttactgtgttaatgttctgtcttcaaactgtttgttcgtgtaccgcgttggtgattggatgaattgatgaaaaatgttaccaaaattctaccaaaatacctacattggtcttgattttggaagtttttgtggggtttatatgattatttttctccccct

SEQ ID NO: 1234 - DNA, 1520 bp, Flaveria ramosissima
tctcacaaaaactatcacttgggagaaacttaccaaaaacccaattccagtaacacattaaaaagctattttctcattctctctctctaaaacttcaaaaagtttagaaagagagaatggcagtgtgcacagtgtacacagtgcaatctctgaactcaacatgttcaatctcaacaccaacaaaaacccatttgggaattcagaaaagacaagtgttgttctatagtaaaaagaccaataagggcagagtgagaagtggtgagataagatgctcaggggacacaatagtaattggactagcagcagactcagggtgtgggaagagtaccttcatgaggaggttgactagtgtgtttggaggtgcagcagagccaccaaagggcggcaatcctgattcaaacacacttattagtgacacaacaacagtcatatgtttggatgattaccattcattggatagaacaggtaggaaagtggaaggggtgaccgcacttgatccgagagccaataactttgatcttatgtatgagcaggtcaaggctttaaaagagggtgttgctgtagagaagcctatttataaccatgttactggtcttttggaccctcctgagctcatcaagccacccaagatccttgtcattgaaggcttgcacccaatgtttgatcagagagtaagagacctcttggacttcagtatctacttggacatcagcaacgacgttaaatttgcctggaaaattcagagggacatggcagagagaggacacagccttgaaagtatcaaagccagtattgaggccagaaagcctgattttgatgcctatattgacccacaaaagcaatatgcagatgcagttatagaagttttgcctacacagctgattccggacgacaacgaggggaaggtgttgagagtgaagttgataatgaaagagggagtgaaatatttcagcccagtttatttgtttgatgaaggctccaccatttcatggattccctgtgggaggaagctcacttgttcttacccgggtatcaaattcgcctatggccctgatacttactacgatcatgaggtgtctgtgttggagatggatgggcaatttgacaaactggatgagctcatctatgttgagagccatttgagcaacatctccaccaaattttatggagaaattacccaacaaatgttgaagcatgctgacttcccaggcagcaacaatggcaccggtctcttccaaaccattgttggtttgaaaatcagagatctctttgaacaaatcacagccagcaaggcctcggctcaattggaagctacaaaagcttaattcaataagtaacaaataaagtccatttttctttctcctaccaactcttcttttcatgtaaaattcgagtgctaggcttttatcactagtctcatgagagttacactcccatatgtattcatttgcatttgtctattccatggagatctgtgatacagagaatcaaattcctaaatgaaatcttgagaagattaa

SEQ ID NO: 1235 - DNA, 1637 bp, Nicotiana tabacum
  misc_feature (364)..(364): n is a, c, g, or t
  misc_feature (434)..(434): n is a, c, g, or t
  misc_feature (809)..(809): n is a, c, g, or t
agggagagcactccataattctatctctttctctctggaaaaaagaaaaaacctctcaagaatctgagaggaaaaaaatcaagaaaatatggcagtgagtacagtgtacacagctcaatcactgaactctacttgttcaatctccacaccctcaaaatcccacttaggatttcaccaaaaacaagtgattttctacaccaaattaagaaaccaacagaagaagcagtagcactagtgtaataacatgttcatcagctgatgaaaagacagtggtgattggtctagcagctgattctggttgtgggaaaagtactttcatgaggagattaacaagtgtatttggtggtgctgctgagccaccaanaggtggaaatccagattcaaacacattaatctcagacatgactactgtgatttgtcttgatgattatcantcacttgatagaactggaaggaaggagaaaggagttactgctcttgatcctagagctaatgattttgaccttatgtatgagcaagttaaggctattaaggaaggtattgctgtggagaagcctatttataaccatgttagtggtcttcttgaccccccagaactcattaaacctcccaagattcttgttattgaaggattacaccccatgtacgatgagcgtgtgagagagctcttggacttcagcatctacttggatatcagcaatgaggttaagttcgcttggaagattcagagggatatggctgagagagggcacagccttgagagcattaaggccagtattgaagccaggaagccagattttgatgcttanattgacccacaaaagcaatatgcagatgcagtaattgaagtgctcccaactcagctgatcccggatgacaatgaaggcaaagttttgagagtgagaatgataatgaaggaaggagtgaagaacttcaacccggtttacctgtttgatgaaggctccaccatctcatggattccttgtggtaggaagttgacttgttcttaccctggtatcaagttcacctatggccctgacacctactttggcaatgaggtatctgtcttggagatggatggccaatttgacagactagatgagctcatctatgtagagagccatttgagcaacctctccaccaaattctatggtgaagttactcaacaaatgttgaagcatgctgatttccctggtagcaacaatggaacaggtttcttccagaccattgtcggtttgaagatcagagacctctacgagcagatcgttgccagcagagctgcagctccagttcaagctgcaaaggcctaaacttcgccaaactctattaacagctaggcaccagaatcatctgttgtacctggttgtttcacccctcttccctaaattttttatttgccgacttcttaccccccactttcatgtttcagtttcatggtagataattccccataaatgagaagatacacttgattatgtatttatatatagctggaaaggtgttgagagttgtaacatggataataaggaggagaaattaagtgaaacaaatcaaggcaagcatcaacctcttgggctgatgttatcacttgatcatcacttggttttggatgaaaacaaggccataatttcaacgcc

SEQ ID NO: 1236 - DNA, 1392 bp, Flaveria ramosissima
gaattccacattgaaaaagctccaacctttatacctctttctctctcaagacttcaagaaacaagagagtaacaatggcagtgtgcacagtgtacacactgcaacctctcaactcatcatgctcaatctcatcacccacaaaaacccacatgggattcacccaaaagcaagtctttttctactccaatggtggtaaaaagactaaaagcaacaagtatagaacaggtggtgagatcacatgctcaggggacacaatagtaataggacttgcagcagactcagggtgtggtaaaagcaccttcatgaggaggttaaccagtgtgtttggtggtgcagcctctccaccaaagggtgggaaccctgactcaaacacactcataagtgacaccaccactgtcatatgtttagatgactatcattcattagatcgcacaggaagaaaagaaaagggtgtgactgcacttgacccacgagccaatgactttgatctgatgtatgaccaggttaaggcgcttaaagatggtgtggctgttgagaagcccatttataaccatgtttcggggcttttggaccctcctgaactcattaaaccacccaagattcttgttattgaaggtctgcacccaatgtatgatcagagagtaagagacctgctggacttcagtatttacttggacatcagtaacgaggttaaattcgcatggaaaatccagagagatatggcggaaagaggacacagtcttgaaagcattaaagctagcattgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaaccctgtctacttattcgatgaaggttccactgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccatttgagcaacatttcgacgaaattctatggtgaaatcacccaacagatgttgaaacatgctgatttcccaggtagcaataatggtactggtttgtttcaaaccattgtcgggttgaagatccgagacttgtttgaacaaattgcggccaataagggatcagctccacttgaagctacaaaagcttgatcataaacgaagagttattatgagttgatgttgttatcacatatgtatttagctagttccatttgtgtattatgtggagatatgtaatgtaagtata

SEQ ID NO: 1237 - DNA, 1541 bp, Platanus occidentalis
ttggtttgatatctgaggagcagaatcaaaacccagtttcatgtctgctcacaaaaccagctaaattcagaaaaccgacctcagaacttctcctatcagaagtttctaagaggtctgtgtgtacaggaacaatggcaatttgcacagtctacacaaccccttcactgaattcaacctgttcaatctccacaccaacacagacccacctgggttttcaccaaagacaggtcttcttctacagcactagcaagaaaagcagcaggagaggctgcagcaatgtttctgagatcacatgttcagccgaggagaagacaattgtgattgggttggcagcagattcagggtgtgggaagagtaccttcatgaggaggttaacaagcgtgtttggtggtgcagcagagccacccaaggggggaaacccagactcaaacaccctgattagtgacacaaccactgtaatttgtttggatgattaccattcgcttgataggacaggaaggaagcagaagggagtaactgcacttgacccaagagccaacaacttcgacctcatgtatgagcaggtcaaggctatcaaggatggaattcctgttgagaagcctatatataaccatgtcagtggtctcttggatcctccagagcttattaaacctcccaagattctggtcatcgaaggattgcacccaatgttcgattcccgtgtaagggacctcttggacttcagtatctacttagacatcagcaacgaggtcaagtttgcttggaaaattcagagggacatggcagaacgtggacacagtcttgaaagtattaaagctagtattgaagcccgaaagccagacttcgatgcctacattgacccacagaagcaatatgcagatgcggtgattgaagtcctgccaacccaacttattcctggtgataacgaagggaaggttctcagggttcggctgataatgaaagaaggggtgaagtatttcagcccagtttacctgttcgatgagggctccaccatctcatggattccctgtggaaggaaactgacatgctcgtatcccggcatcaaattcttctacggtcctgacacttactttggtcatgaggtgtctgtgttggagatggatgggcagtttgacagattagatgagcttatttatgtggagagccatctgagcaatatctctacaaagttttatggtgaagttacacaacaaatgttgaagcactcggacttcccagggagtaacaacgggacaggtttcttccaaaccatagttggattgaagataagagacctctttgagcagattgtcgccagcagggcaacagctccattagaagcaaccaaagcttaataaatggacatggcagagtcaccttcgttatcatgccgttcagtttttcctcttcatcttcattgagcccaggcacttcataagattaagaacactttatatatatttgttgttgtatttttgtggagatatgtattatagaggtgcaaagaacagatgaaatgcagttaagaaaatttcctttgg

SEQ ID NO: 1238 - DNA, 1888 bp, Populus trichocarpa
agaattcgaaatgacaatcttagtcatgcacattaaattatacccttccatgtcccctctattcctaccttaacatcacctccatctttgtaaaaaacaaggggtggtcacagaaaacataaacaagacagatcagcctcccatcaccagccaaaacacccttttctttcccatacaaactgccatttttttccccacccgtttcctccactcatttgtgttccaaacttttcctttgagggaaaagtgtccacaaatccattacatgtcctcgtttcaaaactagctgagaagcataggattccaagacctcatttcacctccatctcttccactctcaagctagctctctgaaaaaaaaataaaaaaaatggcagtttgcactgtatacacccctcagtcccttaattcaacatgctcaatctccacgccaacaaaaacccacttgggatttaaccaaaaacatgtagtgttctatagcagtaacaagaaaacaagcaagagagctagcagtgcagtgataacctgctcagctgacacacagactgttgttattggtctagctgcagactctgggtgtggtaaaagtaccttcatgaggaggttaacaagtgtttttggaggtgcagcagagccaccaaaaggtggaaatcctgactcaaacacactcataagtgacacaacaactgtgatatgtttagatgattatcactcacttgataggactggaaggaaagaaaagggtgtcacagcacttgaccccagagccaacgacttcgatctcatgtatgaccaagttaaggccattaaagatgggattgctgttgagaaacctatttacaatcatgttacgggtctcttggatcctccagagcttattaagcctcctaagatccttgtcattgaaggtttgcatccaatgtacgaccaacgtgtgagagatcttttagacttcagtatctacttggacattagcaacgaggttaaatttgcatggaaaattcagagggatatggcagagcgaggacacagtctcgagagcattaaagctagtattgaagcacgcaagccagattttgatgcttatattgatccacaaaagcaatatgctgatgcagtcattgaagtgctgccaacccaactcattccagacgacaatgaagggaaggttttaagagtgaggttgataatgaaagagggggtgaagtttttcagccctgtttatttgtttgatgaaggctcttctatttcatggataccatgtggtaggaagctcacctgctcttaccctggcatcaaattctcctatggccccgacacttattacggccacgaggtgtctgtactggaaatggatgggcaatttgacagattagatgaactcatctatgtcgaaagccatctaagcaacctctccaccaagttctacggagaagttacccaacaaatgttgaagcatgctgatttccccggaagcaacaatggaacaggtctcttccaaacaatcgtcggattgaaaataagagacctctttgagcaaatcattgccagcagggccaaaaccccagtagaagccacaaaagcctaataaactgccttacatattgaacaatgcactcattctctaaagcctaataaactaccttacatattgaacaaggcactcattctctaaagttaccccctttcagtttctctttttcagcgtttcttttgtgctttagttgagtgttaggttggtcttcataagaatgagaagttgagaacactgtatctatttgttataattttatggagatctgtgtaatatagattataaaaaacagatgaattatcagctcagaattttcatacaagatcaggatcttgcggcattcttttctcttta

SEQ ID NO: 1239 - DNA, 1387 bp, Helianthus annuus
ctaaaacttcaaaaccaagagagagaagcaatggcagtgtgcacagtgtacacagtccaacctctcaacacatcatgctcaatctcaacacccacaaaaacccacatgggattcaaccaaaaacaagttttcttcttcaacaactacagtagcaaaaacaccaacaacagcaggtttagaggcaacaaaatcacatgctcaggtgacacaatagtgattggacttgcagcagattctgggtgtggaaaaagcaccttcatgagaaggttaaccagtgtgtttggtggtgcagcttcaccaccaaagggtggtaaccctgactcaaacacactcataagtgacacaaccactgttatatgtttagatgattatcattcattggatagaactggaaggaaagaaaagggtgtgactgcacttgacccaagagccaatgactttgatcttatgtatgaacaagttaaggctcttaaagatggtgtggctgttgagaagcctatttataaccatgtttctgggcttttggaccctcctgagctcattaaacctcccaagattcttgttattgaaggtttgcatccaatgtatgatcagagagtaagagatctcctggactttagtatttacttggacatcagtaatgaggttaaatttgcatggaaaattcagagagatatggcagagagaggacacagtcttgaaagcattaaagctagcattgaggccagaaaaccagattttgatgcttatattgacccacaaaagcaatacgcagatgcagttatcgaagtgttgcctactcggctcatccccgatgacaatgaggggaaagtgttgagagtgaagctaatcatgaaggaaggcgtcaaatacttcaacccggtttacttattcgatgaaggttccaccgtttcatggatcccatgtggaagaaagctcacttgctcctatcctggcatcaaatttgcctatggtccagacacttatttcggccatgaggtttctgtgttggagatggatggacagtttgacagattagatgaactcatctatgttgaaagccatttgagcaacatttcaactaaattttacggtgaaatcacccaacaaatgttgaaacatgctgacttccctggtagcaacaacggcactggtttgtttcaaaccatcgtcgggttgaagatccgagatttgtttgaacaaattgcagccagtaaggcctcggctccacttgaagctacaaaagcttgatcataaataaagagttaattatgagtgttgtaatcccgtatgaatgtattcaattccatttgtgtattccatggagatatgtaatataatatatatcagttcataaatgaaatcctacataggatcatcaaaagtt

SEQ ID NO: 1240 - DNA, 1659 bp, Tragopogon dubius
accttaagctcttggtccaaatccatgggtgattgcattagacagtggtactctttctcatatgacatttgttctgaaatgacaaatgtaccctcaaatttctcaaaaagaccacaactatgaccacttatctttctccatcttgattcattttgtatctcacaaaaactatcacttggaagaaaaggagcataaatggatttggagtgacacattagaaacctatttctctctctctttctcatcttttgaagtagagagaaaaatggcagtgtcaacagtgtacacagtccaatgtatgaactcatcactctcaacaccaaccaaaacccacttaggaaacaagcaaagacaagtgttgttctacggtaaaaagacgagcaggggcaggttgagaggttgtgagataagatgttcgggggacacgatcgtaattggactagcagcagactcagggtgcgggaagagtacgtttatgagaaggttgacaagtgtgtttggaggtgcagcagagccaccaaagggagggaatcccgattccaacacactcataagtgacaccaccacggttatatgtctggatgattatcattcgttggatagaaccgggaggaaagtggaaggagtgaccgcacttgatccaagggccaataattttgatcttatgtatgaacaggttaaggctcttaaagatggtattgctgttgataagcctatttataaccatgttagcggtcttttggaccctcccgagctcatcaagccccctaagatccttgtcattgaaggtctgcatccaatgtatgatgagagagtaagagatctgttggacttcagtatctacttggacatcagtaacgatgtcaaattcgcatggaaaattcagagggatatggcggagagaggacacagtcttgaaagtatcaaagctagtatcgaggccagaaagccagatttcgatgcttatattgacccacaaaagcagtatgcggacgcggttatagaagtgttgcccacgcagctgatccctggtgacaacgaggggaaggtgttgagagtgaagctgataatgaaagagggagtgaaatacttcagccccgtttacttatttgatgaaggatccacaatctcatggatcccatgtgggaggaagctcacttgttcttaccctggtatcaagtttgcatatggccctgattcttactttggcaatgaggtgtctgtgttggagatggatgggcaatttgacagactggatgagctgatctatgtggagagccatttgagcaacatctccaccaaattctatggagaaatcacccaacaaatgttgaagcattccgacttccctggaagcaacaatggcacgggtctcttccaaacccttgttggtttgaaaatacgagacctttttgaacaaatcacagctgccaaggcctctgctccattggaagctacaaaagcttaaacaaaacaaaacttcatttctttgtttccatgagagtctaagttacactcccctgccctgcccatatgtatttagttccattcgtctcttctatcaatatctgtaataatatagagaatcaatttcttattcatatcatcacacaacaccttattatcatcttcatgcacttcataaaaggtaattgttcg

SEQ ID NO: 1241 - DNA, 1309 bp, Flaveria ramosissima
ggcagtgtgcacagtgtacacactgcaacctctcaactcatcatgctcaatctcatcacccacaaaaacccacatgggattcacccaaaagcaggtgtttttctactccaatggtggtaaaagaccaaaagtggtagattaagaggtggtgagatcacatgctcaggggacacaatagtaataggacttgcagcagactctgggtgtggtaaaagcacctttatgagaaggttaaccagtgtgtttggtggtgcagcctctgcaccaaagggtgggaaccctgactccaacacactcataagtgacaccaccactgtcatatgtttagatgactatcattcattagatcgcacaggaagaaaagagaagggtgtgactgcacttgacccacgagccaatgactttgatctgatgtatgaacaggttaaggcgcttaaagatggtgtggctgttgagaagcccatttataaccatgtttcgggtcttttggaccctcctgagctcattaaaccacccaagattcttgttattgaaggtctgcatccaatgtatgatcagagagtaagagacctcctggacttcagtatttatttggacatcagcaacgaggttaaattcgcatggaaaatccagagagatatggcggagagaggacacagtcttgaaagcattaaagctagcattgaggccagaaaaccggacttcgatgcttatatcgacccgcaaaagcaatacgcggatgcagtaatcgaagtgctgcctacacagctaattcctgatgacaacgagggaaaggtgttgagagtgaagctcatcatgaaagaaggagttaagtacttcaaccccgtctacttgttcgatgaaggttccaccatttcatggatcccatgtggaagaaagctcacatgctcgtatcctggcatcaaattcgcctacggtccagacacttatttcggccatgaggtttcagtgttggaaatggatgggcagtttgacagattagatgaactcatctatgttgaaagccatttgagcaacatttcgacaaaattctacggtgaaatcacccaacaaatgttgaaacatgctgatttccccggcagcaataatggtactggtttgtttcaaaccattgtcgggttgaagatccgagatttgtttgaacaaattgcagccaataagggatcagttccacttgaagctacaaaagcttgatcacaaatgaagagttattatgagttcatgttgttatcacatatgtatttagctagttccatttgtgttttctgtggagatatgtaatgtaagt

SEQ ID NO: 1242 - DNA, 1729 bp, Ipomoea nil
gattacaatagattgagacctttgagctatcgtggagcagatgtctttattctggcattttcgctcattagcaaggccagctatgaaaatgtatccaaaaagtggattcctgaattgaggcattacgcaccaggagtgccaattattcttgttggaacaaagctagatctccgagaggataagcagtttttcttagatcaccctggagcaatacctattaccatggctcagggatgatttctctaacctcagccataaaccactttcttagctcttagctcttattcatgtcatcagcttaagccacttatatccacaccttccattattatctgccatttctctctgaacattttcccagaagagaaagaacaatggcagtttgcacagtgtacactgttcaatccctccactcaacatgttcaatctccacgcccaccaaaacccacttccaaagacaggtttttgtctacaaaaagagcgctaggaaggtgggaatttcgtgcgccgccgccgggggcgacggcaagacggtggtgataggcctggcggcggactcggggtgcgggaagagcacgttcatgcggcggctgaccagcgtgttcggcggcgcggcggagccgcccaagggcggaaacccggactccaacacgctcatcagcgacatgaccaccgtgatatgcttagacgactaccattctcttgacaggaccgggaggaaggagaaaggagtgacggctcttgaccccagagctaacgattttgatctcatgtatgaacaggttaaagctttgaaggaaggtaaagccgttgataagcctatttataatcacgttactggccttcttgatccccctgagcttaccaaaccccccaagattcttgtcattgaaggattgcaccccatgtatgatgctcgtgtgagagagctcttggacttcagtatctacttggatatcagcaatgaagttaagtttgcatggaaaatccagagagatatggctgaaagagggcacagccttgagagcatcaaagccagcatagaggccaggaagccagactttgatgcctacattgacccgcagaaacaatatgcagatgcggttatagaggtgctgccgacgcagttgattccagatgacaatgagggcaaggtgttgagagtgaggttgataatgaaagaaggggtgaagcatttcagcccggtttacctctttgatgaagggtctactatctcatggatcccttgcgggcgaaagctgacctgttcttaccccgggatcaagttcacctatggacccgacacatactttggccatgaggtgtctgtgctggagatggacgggcagtttgacagactagatgagctgatctatgttgagagccatttgagcagcctctccaccaaattctatggtgaagtgacacagcaaatgctgaagcacgccgacttcccggggagcaacaatggaacaggcttcttccagaccattgttgggttgaagatcagggatctgtatgagcagatcgttgccacccgggctgcagctccagtggaagccaaggcctaaaaaaattcgcccaaattcattactctttccctttctcatcacttctctgtggttttcacttttcatttaggttttctttctcatctttcatgtaattccacttgagagagagttaggtgatatgatatgatatgatcccccataaagagaaacagtcc

SEQ ID NO: 1243 - DNA, 1618 bp, Olea europaea
aaaagtgacaccatcaaattaaacaacttcctatccaaacaaaactgccttctttcattctgtgtctcacatttttttcattaatttgaaaaaataataaaaattcccacaattcatgtctcaataatattccactccacaccatttcttggactaaagagaaaatggcagtttccacagtgtacacagttcaatctctcaattctacttgttcaatctcaaaacccacaaaaacccacttgggattcaaccaaaaacagctagttttcttcaagaaaaccaccaccacaaccaccaggagacccaccactgtaataacatgctctgccggcgacacggtggtgattggtttagcagcagactctggctgcggaaaaagcaccttcatgcggcggttgacgagtgtcttcggcggcgcagcggagccacccaagggcggcaaccctgactccaacacactgattagtgacaccactactgtgatttgtttagatgattatcattcactggacagaactgggagaaaagagaagggagttactgcacttgatcccagagcaaataattttgatcttatgtatgaacaggttaaggcgattaaaagtggagttcctgtggagaaacctatttataatcatgtcactggtttaattgaccctcctgagttgatcaagccacccaagatttttgttattgaaggattgcacccaatgtatgatgcccgtgtgagagaactcttggacttcagtatctatttggacattagcaatgaggtcaaattcgcatggaaaattcagagggatatggctgagagaggacacagtcttgaaagcattaaagctagtattgaagccaggaaaccagattttgatgcttacattgatccacaaaagcaatatgcggatgcagttattgaagtgttgccaacacaactcattcctgatgacaatgaagggaaggttttaagggtaagattgattatgaaagaaggggtgaaatatttcaaccctgtttacctctttgatgaaggttccaccatttcatggataccttgtggaagaaagttgacatgttcgtacccaggcatcaaattctcttacggccccgaaacctactttgggcatgaggtgtcggtgttggagatggacgggcagttcgacagactagatgagctgatctacgtagaaagccatctgagcaacctttcgtccaagttctacggcgaagtcacacaacaaatgttgaagcatgcggatttccccggcagcaacaatggcacaggattcttccaaacaattgttggcttgaaaatcagagacctctttgagcagatagttgctagcaaaactggagctccattggaagctactaaggcataagatatgcctataatgcatgtttggtacggtgcataattagacagtatgatggatgagattttaaattatttttcttctttaatactatccaatattaattaatccgtcgaccacacccaataactagtccatgtttgtcaaaaattatagttgcttataatttgatccaactctattttattcacgctcgtgtgattacaactttatttcctttttaattaccctaccgttccttaccg

SEQ ID NO: 1244 - DNA, 1569 bp, Ambrosia trifida
gggttagcggaccctcttgaaccctcttggtaccacgcctgtttgcctcttcagaagacctataggttataagtatatccccttgatcctttaaagcatataaccacacacaaatcttgaattgcacttataaagttccaacctttctccctctttctctctctaaacctttagaaacaagagagagaagcaatggcagtgtgcacagtctacacagtccaaccactcaacacatcatgctcaatctcaacaccaacaaaaccccacatgggattcaaccaaaagcaagtctttttcttaaccaaaagtaataataaaaccaccaaaaacagcagctttagaggcaacaaaatcacatgctcaggtgacacaatagttataggactagcagcagactcaggatgtggaaaaagcaccttcatgagaagattaaccagtgtgtttggtggtgcagcttcaccaccaaagggtgggaaccctgactcaaacacactcataagtgacacaaccacagtcatatgtttagatgattatcattcattggatagaactggaaggaaagaaaagggtgtgactgcacttgatcctagagccaatgactttgatcttatgtatgaacaagttaaagctattaaagatggtgtggctgttgagaagcctatttataaccatgtttctggtcttttggaccctcctgagctcattaaaccacctaagattcttgttattgaaggtttgcatccaatgtacgatcagagagtaagagacctcttggacttcagtatttacttggacatcagtaacgaggttaaattcgcatggaaaattcagagagacatggcagagagaggacacagtcttgaaagcattaaggctagcattgaggctagaaaaccagattttgatgcctatattgacccacaaaagcaatatgcagatgcagttatcgaagtattgcctactcaattgatccctgatgacaacgagggaaaagtgttgagagtgaagctaatcatgaaagaaggcgttaaatactttaacccggtttacttattcgacgaaggttccactgtttcatggatcccatgtggacgaaagctcacttgctcctatcctggcatcaaatttgcctatggtccagacgcttatttcagccatgaggtatctgtgctggagatggatggacagtttgacagattagacgaactcatctacgtcgaaagccacttaagcaacatttcaacaaaattttacggcgaaatcacccaacaaatgttgaaacatgctgacttccctggtagcaacaatggcactggtttgtttcaaaccatcgtcgggttaaagatccgagatttgtttgaacaaatcgcagccagtaaggcctcggctccacttgaagctacaaaagcttgatttttaatcaagtgtttactatgagtgttgtgatcccatatgcatgtattcaattccctttgtgtattccatggacatatgtaacataaatatatatataagttcataaatgaaatcctacataggatcaaaaataagataaatgtatatgtgtaa

SEQ ID NO: 1245 - DNA, 1285 bp, Flaveria ramosissima
agtaacacattaaaaagctattttctcattctctctctctaaaacttcaaaaagtttagaaagagaaaatggcagtgtgcacagtgtacacagtgcaatctctgaactcaacatgttcaatctcaacaccaacaaaaacccatttgggaattcagaaaagacaagtgttgttctatagtaaaaagaccaataaggacagagtgagaagtggtgagataagatgctcaggggacacaatagtaattggactagcagcagactcagggtgtgggaagagtaccttcatgaggaggttgactagtgtgtttggaggtgcagcagagccaccaaagggcggcaatcctgattcaaacacacttattagtgacacaacaacagttatatgtctggatgattaccattcattggatagaacaggtaggaaagtggaaggggtgaccgcgcttgatcccagagccaataactttgatcttatgtatgagcaggtcaaggctttaaaagatggtgtcgctgtccagaagcctatttataaccatgttactggtcttttggaccctcctgagctcatcaagccacccaagatccttgtcattgaaggcttgcacccaatgtttgatcagagagtaagagacctcttggacttcagtatctacttggacatcagcaacgacgttaaatttgcctggaaaattcagagggacatggcagagagaggacacagccttgaaagtatcaaagctagtattgaggccagaaagcctgattttgatgcctatattgacccacaaaagcaatatgcagatgcagttatagaagttttgcctacacagctgattccggacgacaacgaggggaaggtgttgagagtgaagttgataatgaaagagggagtgaaatatttcagcccagtttatttgtttgatgaaggctccaccatttcatggattccttgtgggaggaagctcacttgttcttacccgggtatcaaattcgcctatggccctgatacttactacgatcatgaggtgtctgtgttggagatggatgggcaatttgacaaactggatgagctcatctatgttgagagccatttgagcaacatctccaccaaattttatggagaaattacccaacaaatgttgaagcatgctgacttcccaggcagcaacaatggcaccggtctcttccaaaccattgttggtttgaaaatcagagatctctttgaacaaatcacagccagcaaggcctcagctcaattggaagctacaaaagcttaattcaataa

SEQ ID NO: 1246 - DNA, 1461 bp, Guizotia abyssinica
gatgacatatatgataagctgataaccacctacaaatcttgattcttttattcaaaaagctccaacctttcatctctttctctctctaaaacttgagaaacaagagagagaaacaatggcagtatgcacactccaagctctcaactcatcattctcaatctcatcaacaaaaacccacatgggattcaactcaaagcaagtatttttctgcaaaaagaccaaaagtgggaggtttagaagtggtgaaatcacatgctcaggggacacaatagtaattggactagcagcagactcagggtgtggaaaaagcaccttcatgagaaggttaaccagtgtgtttggtggtgcagcctctccaccaaagggtgggaaccctgactcaaacacactcataagtgacaccacaactgttatatgtttagatgattatcattctttagatagaactggaaggaaagaaaagggtgtgactgcacttgacccaagagccaatgactttgatcttatgtatgaacaagttaaagcacttaaagatggtgtggctgttgagaagccaatttataaccatgtttctggtcttttggaccctcctgaactcattaaaccacccaagattcttgtcattgaagggctgcacccaatgtatgatgagagagtaagagacctcctggatttcagtatttacttggatatcagtaacgaggttaaattcgcatgggaaattcagagagatatggcggagaggggacatagtcttgaaagtattaaagctagcattgaggcaagaaaaccagattttgatgcttatattgacccgcaaaagcaatatgcggatgcggtaatcgaagtgttgccgacgcagctgattcccgatgacaacgagggaaaggtgttgagagtgaagctaatcatgaaagaaggggttaaatacttcaacccggtctacttattcgatgaagattccaccatttcatggatcccttgtggaagaaagctcacatgctcgtatcccggcatcaaattcgcatacggtccagacgcttatttcggcactgaggtttccctgttataaatggatgggcaatttgacagattagatgaactgatctatgtagaaagccatttgagcaacatttccactaccttctatggtgaaatcacacaacaacccctgaaacatgctgatttccctggtagtaacaatggtactggtttgtttcaaaccatagtcgggttaaagatccgagatttgtttgaacaaatcgcggccaataaggtctcggctccacttgaagctacaaaagcttgatccttaatgaagagttattatgttgtgatcacatatgtatttaattccatttgtgtacgtatttaatgaagatatgtaatataagtatagcaaattcataaatgaaatcattcttgttttccgcgataaaagaaaaaaaaaggccgcctcgg

SEQ ID NO: 1247 - DNA, 1431 bp, Flaveria ramosissima
acacaaatcttgaattccacattgaaaaagctccaacctttatacctctttctctctcaaaacttcaagaaacaagagagtaacaatggcagtgtgcacagtgtacacactgcaacctctcaactcatcatgctcaatctcatcacgcacaaaacccacatgggattcacccaaagcaagtcttttctattccaatggtaggtaaaagactaaaagcaagaggtatagaacaggtggtgagatcacatgctcaggggacacaatagtcataggacttgcagcagactcagggtgtggtaaaagcaccttcatgaggaggttaaccagtgtgtttggtggtgcagcctctccaccaaagggtgggaaccctgactcaaacacactcataagtgacaccaccactgtcatatgtttagatgactatcattcattagatcgcacaggaagaaaagagaagggtgtgactgcacttgacccacgagccaatgactttgatctgatgtatgaacaggttaaggcgcttaaagatggtgtggctgttgagaagcccatttataaccatgtttcggggcttttggaccctcctgagctcattaaaccacccaagattcttgttattgaaggtctgcacccaatgtatgatcaaagagtaagagacctcctggacttcagtatttacttggacatcagtaacgaggttaaattcgcatggaaaatccagagagatatggcggaaagaggacacagtcttgaaagcattaaagctagcattgaggcccgaaaaccagattttgatgcttatatcgactcgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccacttgagcaacatttcgacgaaattctatggtgaaatcacccaacagatgttgaaacatgctgatttcccaggtagcaataatggtactggtttgtttcaaaccattatcgggttgaagatccgagatttgttcgaacaaattgcggccaataagggatcagctccacttgaagctacaaaagcttgatcataaatgaagagttattatgagatgatgttgttatcacatatgtatttagctagttccatttgtgtattatgtggagatatgtaatgtaagtataccaattcataaatgaaacccagctgagtgag

SEQ ID NO: 1248 - DNA, 1673 bp, Malus domestica
ctaacacttcgaaaaatttatcaaaaaccaggggtagtcccagaaaccccagaaaaaacaacaagacacgtcagcagcagcagtatcagccagcattttcttttccatcccacaaaaccgcctgccatcacctcttccagcctcttatttctgctccaaactctttagtctttctttcccaaattaaaccaagtaaccaagaacacagagagctagagagagagagtagtagtagtgggaaaatggcgatttgtgcggtgcacacaagtggccagctgaacccgacgtgttcgttttcctcctcgttgggattgagcggccaaaagcagcagcaggtggcggtgttctacaagcagagaagcagcagcagccggagatcagttggagtgagtgtgataagatgcgagcaagagacgattgttatcggtttagcagcggactcagggtgtgggaaaagcacattcatgaggaggctgactagcgtgtttggaggaggagcggagccacctaaaggaggaaaccctgactccaacacgctcatcagcgacaccacgacggtgatatgcttggatgattaccattccctggacaggacagggaggaaggagaaaggagtgaccgcgctcgacccaagagctaacgacttcgatcttatgtatgagcaggtgaaggccatcaaggaaggaaaggctgttcagaagcctatttacaaccatgtttctggtctcttggatcctcccgagctcatcaagccccccaagattcttgtcattgaaggtttacatccaatgtatgatcagcgagttagggatctgttggacttcagcatctacttggacatcagcaatgaggttaagtttgcatggaaaattcagagggacatggcggagcgtggacacagtctcgagagcatcaaagccagtattgaagcccgaaagcctgatttcgatgcttatattgatccacaaaagcagtacgcagatgcagtgatagaagtgttgccaacccaattgattccaggtgacaatgaggggaaggtgttgagagtgaggttgattatgaaggaaggtgtgaaatatttcaacccagtctacttgtttgatgagggttccaccatctcatggattccctgtggaaggaagctcacctgctcttaccctggaatcaaattcaactatggccctgacacttatttcggcaacgaggtgtcattgttggagatggatgggcaatttgacagattagatgagctgatctatgtagagagtcatctaagcaacatctccaccaagttctatggagaagtcacccaacaaatgttgaagcactctgatttccccggcagcaacaacggaaccggcctcttccaaaccatcgtcggattgaagatccgggacctctacgagcagctcattgcagccagggccaaaactccggtagaagcaaccaaagcttagaaatatttcatcaaattaatctctttgcctaattacattgttatgccttatctctattgattgtacctacttaattcaagtaagagagtgcatgcatgcctattttccactctcttctctttctttacgttgtaattctatggcagaatacttgtattatacagattaaaattaaacaaaatatatggaaaatttgagttatgaggttcacctata

SEQ ID NO: 1249 - DNA, 1828 bp, Fagus grandifolia
ttttatgtagaacttgagggaaggaaaatccaaatagactattttagctactatccattgatttatctcatccatgtcccttctcatgccaccttaaaattacctccaaatttgtccaaaaaccaaaatcaggggtagtcacataaaaaaacccataagcaaaagacacatcagcctcccaattcccatcaccaagccaacagtttccttcacacctcttatttgtgttccaaagtattcatataaaatcaggaagacaagaagccaaacccattgctaagagttgccaaaagccaattcaatcatctcttgctctctcagagctctgtaaattcctttctaagttgagagagagagagagaagaaaaaaaaatgtcaatttgcacagtttacacaaccccatcactcaattccacatgttcaatctccacatctaaaacccacttgggatttcaccaaaaacaagtagttttctacacaagtggcaagaaaaccagcaagagaggaagcagcagcaacacaacaagcccatatgtgataacatgctcaacaggtgactcacaaacaattgtgattggtcttgcagcagactctggatgtgggaaaagtaccttcatgaggaggctgacaagtgtgtttggaggggcagcagagccaccaaagggtggtaacccagactcgaacacacttatcagtgacaccaccactgtgatatgcttggatgactatcactcactggataggactggaaggaaacagaagggtgtgactgcacttgacccaagagccaatgactttgatctcatgtatgagcaggttaaggctatcaaggatgggattcctgttgagaagcccatttacaatcatgtaactggtctcttggatcctcctgagctcatcaagccccctaagattcttgtcattgaaggtttgcacccaatgttcgatcagcgagtaagggacctgttggacttcagtatctacttggacatcagcaatgaggttaagtttgcgtggaaaattcagagggacatggctgagcgtggacacagtcttgaaagcatcaaagccagtatcgaagccagaaagcctgattttgacgcatatattgatccacaaaagcaatacgcagatgcagtgattgaagtgttgccaacccaactgattccggatgataacgagggaaaggttttgagagtgaggttgataatgaaagaaggggtggagtttttcagcccagtctacctctttgatgaagggtctactatctcatggataccatgcggaagaaagcttacttgttcataccctggcatcaaatttttctatggccctgacgcttacttcggccacgaggtgtctgtgctggagatggatggacaatttgaccgattagacgagctaatttacgtggaaagccatctaagcaacatatctaccaagttctatggagaagtcactcaacaaatgttgaagcactctgatttccctggcagtaacaatggaactggtctattccaaaccattgtcgggttgaagattagagaccttttcgagcagttaattgccagcaaggctaaaactccagtagaagcaacaaaggcctaaaaaactgcatgccttggatatataccatggacgaggcaccgccaagtctctaaaatcattttccactttcgtttttcttataattattatttttcaactccatcttccatgtttttcatttgaatgttaggttgttcttgagaagtatgagaatactctgtatgtacttattttctatcgtggacatgtgtattatagagaagcgaaagcatagataaaa

SEQ ID NO: 1250 - DNA, 1413 bp, Euonymus alatus
agagagagagagagaatggcagtctgcacagtctacacaacccaatctctcaactcaacatgctcaatctccacaccaacaaaaaccaacttgggttttcaccgaaaacaggttgtgttctatagcacttctggtaagagaagcagaggtagtaacactactgtgataacctgctcagcaggtgactcacagacagttgtgattggcctggcagcagactcaggatgtgggaagagtacattcatgaggaggctaacgagtgtttttggaggagcagcagagccaccaaaaggaggaaatccagactcaaacacactgattagtgacacaacaactgtgatatgcttggatgattatcattctcttgacagaactggaaggaaagagaagggagtgactgcacttgacccaagagccaacaactttgatctcatgtatgagcaggttaaggccatcaaggatggaattgctgttcagaaacccatctataatcatgtgagtggtcttcttgaccctcctgagctcatcaagcctcccaagatccttgtcattgaaggacttcacccaatgtatgatcacagagtaagggacctgttggactttagtatctacttggatatcagtaatgaagttaagtttgcatggaaaattcagagggacatggctgagcgaggacacagtcttgaaagcattaaagctagtattgaagcaagaaagccagactttgatgcttatattgatccacagaagcaatatgcagatgctgtgatcgaagtactcccaacccaactcatcccggacgataatgaggggaagaccttgagagttaagttgataatgaaggaaggtgtgaagtacttcaaccctgtttacttgtttgatgaaggctccactatttcatggataccctgtggaaggaaactcacctgctcttatcctggcatccagtttgcctatggccccgatgcttacttcgaccacgaggtgtctgtgctggagatggatggacaatttgacagattagatgagctcatctatgtagagagccatttgagcaacatttccaccaagttctatggagaagtcacccaacaattgttgaagcatgctgatttccccggcagtaacaatggaaccggtctcttccagactatagttggattgaaaataagagatctctatgaacagcttgtagcgagcaaggccggagccccagtaaaagccagaacctaagcacaaaagcatgcacttactcttattcagtcttttgtttccttttccgctgggtctttaggctgcatgtacctatgagtaacactctaggtaacactatgtaccgattcatgtggtaattgtattgggagtttgtaatatagagaagaaataacagatgaaattcagttaagaaattct

SEQ ID NO: 1251 - DNA, 1626 bp, Flaveria ramosissima
gtgaagcttaagttgtacactgcctatttataccacacccttctcacatttttgcattatttgaacacacatatgatgacaatttaaccacacacaaatcttgagttccacattgaaaagctccaacctttaacctctttctctctctaaaacttcaagaaacaagagagaaacaatggcagtgtgcacagtgtacacactgcaacctctcaactcatcatgctcaatctcatcacccacaaaaacccacatgggattcacccaaaagcaggtgtttttctactccaatggtggtaaaaagaccaaaagtggtagattaagaggtggtgagatcacatgctcaggggacacaatagtaataggacttgcagcagactctgggtgtggtaaaagcacctttatgagaaggttaaccagtgtgtttggtggtgcagcctctgcaccaaagggtgggaaccctgactccaacacactcataagtgacaccaccactgtcatatgtttagatgactatcattcattagatcgcacaggaagaaaagagaagggtgtgactgcacttgacccacgagccaatgactttgatctgatgtatgaacaggttaaggcgcttaaagatggtgtggctgttgagaagccgatatataaccatgtttcggggcttttggaccctcctgagctcattaaaccacccaagattcttgtaattgaaggtctgcacccaatgtatgatcagagagtaagagacctcctggacttcagtatttacttggacatcagtaacgaggttaaattcgcatggaaaatccagagagatatggcggagagaggacacagtcttgaaagcattaaagctagcattgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaacccatttgagcaacatttcgacgaaattctatggtgaaatcacccaacagatgttgaaacatgctgatttcccaggtagcaataatggtactggtttgtttcaaaccattgtcgggttgaagatccgagacttgtttgaacaaattgcggccaataagggatcagctctacttgaagctacaaaagcttgatcataaatgaagagttattatgatttgatgttgttatcacatatgtatttagctagttctatttgtgtattatgtggagatatgtaatgtaagtataccaattcataaatgaaaccctgagtgagattgtcataagttgcaacatactcattttctgcttgtcggttttgtggacacttgtcatgacagttagccgtctttctaattatagtaaaagaaatatgagatgttac

SEQ ID NO: 1252 - DNA, 1617 bp, Lactuca sativa
caaaaataccctcaaatattcaaagacacctccatcagagagatgcaccctctgaaacacaagttgtacaatgctttatccagattggaattgcttgattcattttgtatctcacaaaaactatcacttgaaagaaaacgagcataaagccaattagagtgacacattaagaacctatttctttctctctctttcaactcctgagaaacttaaagaaagagagaaaaaatggcagtgtcgactgtagtctacacagtccaatccttgaactcaacatgctcatcaatctcaacacccaccactaaaacccacttgggaatccaacaaagacaagtgttgttctatggtaaaaagacacacaggggcagaatgagaagtggtgagataagatgttcaggggacacaatcgtaattggactagcagcagactcagggtgtgggaaaagtaccttcatgagaaggttgaccagtgtgtttggaggtgcagcagagccaccaaagggagggaatcctgattccaacacactgataagtgacacaacgacagtgatatgtttggatgattatcattcattggatagaacagggaggaaagtggaaggggttacagcattggatccaagagccaataattttgatcttatgtatgaacaggttaaggctcttaaagatggtatcgctgttgataagcctatttataaccatgtcagtggtcttttggatcccccagagctcatcaagccccctaagatccttgtaattgaaggccttcatccaatgtatgatcagagagtacgagacctcttggacttcagtatctacttggacatcagcgatgatgttaaatttgcgtggaaaattcagagggacatggcagagagaggacacagccttgaaagtattaaagctagtattgaggctagaaagccagattttgatgcttatatcgacccacagaagcaatatgcagatgcggttatagaagtgttgcctacacagctgatcccggatgacaatgaagggaaggtgttgagagtgaagctgataatgaaagagggagtgaaatacttcaatcctgtttacttatttgatgaaggatccaccatctcatggatcccatgtggaaggaagctcacctgttcttaccctggtatcaaattcgcctatggccctgattcttactttgacaatgaggtgtctgtgttggagatggatgggcaatttgacagactggatgagctgatctatgttgagagccatttgagcaacatctccaccaaattctatggagaaatcacccaacaaatgttgaagcattcagacttcccaggaagcaacaatggcactggtttattccaaaccattgttggtttgaaaattcgtgatctttttgaacaactcacagctgccaaggcctcagctccattggaagctacaaaagcttaaagtaaaacaaacaaaacaacaaaaatcctaaaacctctgttttcatgtaaaattattccccattcccatatgtgtatttagttcccttcctctgtgctatggatatctgtaatatagagaatcaaattcttgaatgaaatattgagatgatcacacaccatcttctcttat

SEQ ID NO: 1253 - DNA, 1338 bp, Utricularia gibba
gtggggtttggggaaggagcagaggaaaatggcggtcgcctctgtgtacactcttcagtctgtcagctccatttgcggctcctctttcggtttcacccacaagcaccagcatgtccttctctacgccaacaagcaccggatatcgtgctccgccgcacccggggacaagactgtggtcatcggcctcgctgccgattccggctgcggaaaatcgacgttcatgcgccgcctcaccagcgtattcggcggagctgctgagcctccgaaaggcggcaaccccgactccaacacccttataagcgacaccactaccgtcatctgcctcgacgattaccactcccttgatcgcaccgggaggaaggagaagggggtgacggcgcttgaccccagagccaataacttcgatctgatgtatgagcaagtgaaggcattgaaagacgggatcgcagtggagaagcctatttacaatcatgtcaccggtttgcttgacccgccggagctcatcaagcctcccaagattctggtcatagagggcttgcatcccatgtttgacagccgggtaagagatctcttggacttcagtatctatttagacatcagcaatgaagtcaagtttgcctggaagattcagagagacatggctgaaaggggacacagcttagagagtatcaaggccagcattgaagcccggaagcctgatttcgatgcctatattgatcctcagaagcagtacgcagatgcagttatagaagtgctaccgacgcagctgatcccagatgacaatgagggcaaggttctgagagtgaggctgatcatgaaagagggtgtccaatacttcaaccctgtctacctttttgatgaaggctccacaatctcatggatcccctgtgggagaaagctcacttgctcctaccctggaatcaaatttggctacggcccagatacttacttcgaccacgaggtttctgtggtggagatggatgggcagtttgacagattggatgagctgatttatgtggagagccacctgagtaacctttccaccaagttttatggtgaggtgacacagcagatgctgaagcatgcagattttccaggtagcaacaatggaacagggctgtttcagacaatcattggtctgaaaatcagggatctgtttgagcagatctctgctgcaagaaactcagcttctacattggaagctgccaaggcatgatgatgatccagaggagagatatcagcgtttgtattgtgtatggtggttggctgaagcaggaactctatcttgtaatcaatgtagaagaaaaagaggaaacaatgtgaaatgaagaacaggag

SEQ ID NO: 1254 - DNA, 1800 bp, Echinacea purpurea
cgatcaaccaatatcatgatgccacatggcatgatatatatccaaactgaaacaaataaccaccatgcctattgttatcacctcatctccaacacccattctatcttctcttttgcaactttgttaaatgacaacaatgcccttcagtactaatgaccgtgtgaaactctagttggacaatccttttgtttcattttgaatctcacaaaaactatcacttggaagtaaatgaccaaaaagccaatgccaggggcacattaaaaagctattcctcattctctctctcttagcctttggagagaaaaaatggcagtgtccacagtgtacacagcccaatctctgaactctacatgttcaatctcaactcccacaaaaacccatttggaaattcagcaaaggcaagtgttgttctatagtaaaaagaccaataggggcagggtgcgtggtgacgaaataagatgcgcaggggacacaatagtaattggactagcagcagactctggatgcgggaagagtaccttcatgaggaggttgaccagtgtgtttggaggtgcagcagagccaccaaagggaggcaatccagactcaaacacactcataagtgacacaaccacagttatatgtttggatgattatcattcattggatagaacagggaggaaggtggcaggggtgaccgcgcttgacccaaaagccaatgactttgatctcatgtatcaacaggtgaaggctctaaaagatggtattgctgtagaaaagcctatttataaccatgttagtggtcttttggaccctcctgagctcataaagccacctaagatccttgtcattgaaggtttgcacccaatgtatgaccagagagtaagagacctcttggacttcagcatctacttggacatcagcaacgatgttaaatttgcctggaaaattcagagggacatggcagaaagaggacacagccttgaaagtatcaaagctagtatcgaggccagaaagccagattttgatgcctatattgacccacaaaagcaatacgcagatgcggttatagaggtgttgcctacacagctgattccagatgacaatgaggggaaggtgttgagggtgaagctgataatgaaagagggagtgaaatacttcagccctgtttacttgtttgatgaaggctccaccatttcatggattccatgcggtaggaaactcacctgttcttaccctggtatcaagttcgcctatggcccagatacttattacggtcatgaggtctctgtgttggaaatggatgggcaatttgacagattggatgagctcatctatgttgagagccatttgagcaacatttccaccaaattctacggagaaatcacccagcaaatgttgaagcattctgacttccctggtagtaataacggtactggtttgttccaaaccatagtcgggttaaaaatccgagacctgtttgaacaaattgcagccactaaggcatcgactccacaggaagcttcaaaagcttgatcataaatgagagttattattatgatttcatgttgtgatcacatatgtattttattccatttgtgtatgtatcccatggagatatgtaatgtaagtataccaattcataaatgaaacgctgataattatgattgttattagttgcatgagtcttgtaatccgcgtggcgtttttattgccacgacggttagccgggtttctaattatagtaaaggaagcatgagatgatcaaagaggtttgaatttggatgaagataaggtcaacctaagatgggtaggaggtgg

SEQ ID NO: 1255 - DNA, 1687 bp, Glycine max
ctcttttcttttcctgcttataactgccttttgttttggttttaattccacctcatattttatatgtgttccaaacttcttcttggaatgtcccttccttaatacccctcaaagaaaagccaccttaacatctcttctctgaaaattctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagcaccttcatgaggaggctgaccagtgtgtttggaggagcagcagagccaccaaagggtggcaaccctgactccaacactctcatcagtgacaccaccactgtcatatgcttggatgattaccactctttggacagaactggaagaaaggagaagggtgtcactgcccttgaccctagagccaatgattttgatctcatgtatgaacaagttaaagctcttaaggatggaattgctgttgaaaaaccaatctacaaccatgtcactggtctcttggatccccctgagctcattaaaccccccaaaatcttagtcattgaaggtttgcacccaatgtttgattcccgtgtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacgcaactcattccagatgacaacgagggtaagattttgagagtgagattgatacagaaagagggggttaagtactttagcccggtttacttgtttgatgatggctctaccatttcatggataccatgtggaagaaagcttacatgctcctaccctggcatcaaattcttctatggacctgagacttactacggaaatgaggtgtcagttgtagaaatggatggacaatttgacagactagatgaactaatatacgttgagagccacctaagcaacctctctacaaagttctatggagaggttactcaacagatgttgaagcatgctgattttcccggcagcaacaatggaacaggtctcttccaaaccatagttggtttgaagataagagatctatatgagcagctaatagccagcaaggctgagactccagtagctgcaaaagcttaggaattgaacctgccataatatatatacatatatcgatcgagcaacgcagccaaattgagttctctcatcatcaaaatcatcattttctttcttctttcatgttttccacaattccactctatttcatgttattttgtcaattgttattaggctgttctgcatgataattaatgaaaaaaacactatgtatgtatgtacttatccgagaagaaaaagcgaggctgagattcagttatgttgatacaagattgagacaataattggcttctctttctctagctagcg

SEQ ID NO: 1256 - DNA, 1503 bp, Ambrosia trifida
tctgtatctcacaaaaactatcacttggaagaaaatgaccaaaagcccattttaagttactcattaaaaagctatcttatcattttatttctctctaaaagtataaaaaatttagagagaaataatggcagtgtctacagtgtacacagtccaatctcttaactcaacatgttcaatctcaacaccaacaaaagcgcatttaggaagtcatcaaagacaagtgttgttctatactaaaaagaccaataagggtagggtgagaggtggtgagataagatgtgcaggggacactatagtaattgggctagcggcagactcagggtgtgggaagagtactttcatgaggcggttgactagtgtgtttggaggtgcggcagagccaccgaaaggcggcaaccctgattcaaacacactcataagtgacacaacgacggttatatgtttagatgattaccattcgttggatagaacagggaggaaggtggaaggtgtgactgcgcttgatccgagagccaataactttgatcttatgtatgaacaggttaaggctttgaaagacggtattgctgtagataagcctatttataaccacgttagtggtcttttggaccctcctgagctcatcaagccacctaagatccttgtcattgaaggtttgcacccaatgtatgatgagagagtaagagacctcttggacttcagtatctacttggacatcagcaacgacgttaaatttgcatggaaaattcagagagacatggcagagagaggacacagccttgaaagtattaaagctagtattgaggccagaaagccagattttgatgcttatattgacccacaaaagcaatacgcagatgcggttattgaagtgttgcctacacagctgattccagatgacaatgaggggaaggtattgagagtgaagttgataatgaaagagggagtgaaatacttcagcccggtttacttgtttgatgaaggctccaccatctcatggattccctgtgggaggaagctcacttgttctttcccgggtatcaagttctcctatggcccggatacttactacggtcaagaggtgtctgtgttggagatggatggtcaatttgacaaactggatgagctcatctatgttgagagccatttgagcaacatctccaccaaattctatggagaaattacccaacaaatgctgaagcataacgacttcccgggcagtaacaacggaaccggtctcttccaaaccattgtcggtttgaaaatcagagatctctttgaacaaatcacagccagcaaagcctcagctacattggaagctacaaaagcttaaactaaagagaaacaaacttttaagtgtcaggcttttatcacgtttctcatgagagttacgcttgcgtatgtatttagtttcatttgtctattcctaggaggtctgtaatatagggaatccaattcttaatgaaatcttgagaagattaaagaacgcctacattgtcaaaa

SEQ ID NO: 1257 - DNA, 1324 bp, Ambrosia trifida
acagtgtacacagtccaagctttaagctcatcatgctcaatctcatcaccaacaagaacccatatgggattaaagaccaaaagtggcaggtttagaagtggtggttataagatcacatgctcaggtgacacaatagtgataggacttgcagcagactcaggttgtggaaagagtactttcatgagaaggttaaccagtgtgtttggtggtgcagcctctccaccaaagggtgggaaccctgactcaaacacacttataagtgacacaactactgtcatatgtttagatgattatcattcattggatagaactggaaggaaggaaaagggtgtgactgcacttgacccaagagccaatgactttgatcttatgtatgaacaggttaaggcacttaaagatggtgtggctgttgataagcctatttataaccatgtttctgggcttttggaccctcctgagcttattaaaccacccaagattcttgtcattgaaggtctacatccaatgtatgatcagcgagtaagagacctactggacttcagtatataccttgacattagtaacgaggttaaattcgcatggaaaatccagagagatatggcagagagaggacatagtcttgaaagcattaaagctagcattgaggccagaaaaccagattttgatgcttatatcgacccgcaaaagcaatacgcggatgccgtaattgaagtgttgcctactcagctgatccccgatgacaatgagggaaaagtgttgagagtgaagctcatcatgaaagaaggagttaaatacttcaaccccgtctacttattcgacgaaggctccaccgtttcctggatcccgtgtggaagaaagctcacttgctcctaccctggcatcaaattcgcctatggtccggacacttatttcgggcatgaggtatccgtgttggaaatggatgggcaatttgacagactagatgaactcatctatgttgaaagccatttgagcaacatttccaccaaattctacggtgaaatcacgcaacaaatgctgaaacatgctgatttcccgggtagtaacaatggaaccggtttgtttcaaaccatagtcgggttaaagatcagagacttgtttgaacaaattgcagtcagtaaggggtctgcttcacttcaagcttcaaaagcttgatcatatatattataataactatgagttcatgttgtgatcacatatgtattttattttattccatttgtgtacttattccatgcagatatgtaatataagcatataccaattcattaaataaatccttggtaattatggttattaaaagtta

SEQ ID NO: 1258 - DNA, 1834 bp, Cicer arietinum
cttttattttcctactgaactctctttgttttgggtctaaattccacctcatacattttatgtgtcccaaacttcttagaatatatgtcccctatcccataataataatcctctatccaacttaaactcatttcgtctcaaaaaaatatttctttaacttcattgtatagagaaagagagagaaagaaaaaaatcagtgagaatggcagcttgcactgtctactcaacacaatcactaagaacaaacatctcaattccaacatcatcatcatcaaaaacacatcttggttttaatcaaaaacaagtagttttctacacaacaagcaaaaaaagcagaaccaacaacaacaaaagatatttgataacatgtaaagcaggtgattcacagacaattgtgattggtctagcagctgattctggctgtggaaaaagcactttcatgagaagactcacaagtgtgtttggaggagcagcagaaccaccaaaaggtggaaatcctgattcaaacacacttataagtgacacaacaactgtgatttgtttggatgattatcattcattggacagaactggtagaaaagaaaaaggtgtcactgcacttgatccaagagctaatgattttgatcttatgtatcaacaagttaaagctattaaagatggaatttctgttgaaaaacctatttataatcatgtcactggtcttttggatcctccagagcttattaaaccaccaaaaatcttagtcattgaaggtcttcacccaatgtatgattctcgagtcagagatcttttggactttagtatctacttagacattagcaatgaagtgaaattcgcttggaaaattcagagagacatggcagagcgaggacatagtcttgaaagtatcaaggctagcattgaagcaaggaagcctgattttgatgcttttattgatcctcaaaagcaatatgcagatgcagtgatagaagtgttgccaacacaactaattcctgatgataatgagggaaagattttaagagtgaggttgatacaaaaagagggtgttaagtactttagcccagtttacttgtttgatgaaggttcaaccatttcatggataccatgtggaaggaagcttacatgctcttatcctggcattaagttcttctatggaccagatacttactttggaaatgaggtgtcagttgtagaaatggatggacaatttgacagactagatgaactaatatatgtggagagccatttgagcaacctctcttcaaaattctatggagaagtaactcaacaaatgttgaagcatgctgatttccctggtagcaacaatggaacaggtcttttccaaaccatagttggtttaaagataagagatttatttgagcagatagtagccagcagggctgagactccagtaggagctgcaaaagcttaggaaattgccatatatataaatattggataaggcacccattgaattgtatttcaaaagttattattttcttatttttatgtattgtatgttgtattttatgataatgtgaaaagactctgcatgtatttatgtaatatgttgttactttataatatagaggacaaaaagcagggctgagatttcagctatgttgataaaaaaatattgcaacaatttggtatcactggcatatgaatattattattgttttttttccttccaatacatatattttgaaaagacaagtgaaaagtattaggaggagagaggagtggatgagattgatagtaatgaaataatatatttcaatagtaggaaataaaaaatgtatatacaagagataaggagaaaggggaaattaga

SEQ ID NO: 1259 - DNA, 1500 bp, Cicer arietinum
cccataataataatcctctatccaacttaaactcatttcgtctcaaaaaaatatttctttaacttcattgtatagagaaagagagagaaagaaaaaatcagtgagaatggcagcttgcactgtctactcaacacaatcactaagaacaaacatctcaattccaacatcatcatcatcaaaaacacatcttggttttaatcaaaaacaagtagttttctacacaacaagcaaaaaaagcagaaccaacaacaacaaaagatatttgataacatgtaaagcaggtgattcacagacaattgtgattggtctagcagctgattctggctgtggaaaaagcactttcatgagaagactcacaagtgtgtttggaggagcagcagaaccaccaaaaggtggaaatcctgattcaaacacacttataagtgacacaacaactgtgatttgtttggatgattatcattcattggacagaactggtagaaaagaaaaaggtgtcactgcacttgatccaagagctaatgattttgatcttatgtatcaacaagttaaagctattaaagatggaatttctgttgaaaaacctatttataatcatgtcactggtcttttggatcctccagagcttattaaaccaccaaaaatcttagtcattgaaggtcttcacccaatgtatgattctcgagtcagagatcttttggactttagtatctacttagacattagcaatgaagtgaaattcgcttggaaaattcagagagacatggcagagcgaggacatagtcttgaaagtatcaaggctagcattgaagcaaggaagcctgattttgatgcttttattgatcctcaaaagcaatatgcagatgcagtgatagaagtgttgccaacacaactaattcctgatgataatgagggaaagattttaagagtgaggttgatacaaaaagagggtgttaagtactttagcccagtttacttgtttgatgaaggttcaaccatttcatggataccatgtggaaggaagcttacatgctcttatcctggcattaagttcttctatggaccagatacttactttggaaatgaggtgtcagttgtagaaatggatggacaatttgacagactagatgaactaatatatgtggagagccatttgagcaacctctcttcaaaattctatggagaagtaactcaacaaatgttgaagcatgctgatttccctggtagcaacaatggaacaggtcttttccaaaccatagttggtttaaagataagagatttatttgagcagatagtagccagcagggctgagactccagtaggagctgcaaaagcttaggaaattgccatatatataaatattggataaggcacccattgaattgtatttcaaaagttattattttcttatttttatgtattgtatgttgtattttatgataatgtgaaaagactctgcatgtatttatgtaatatgttgttactttataatatagaggacaa

SEQ ID NO: 1260 - DNA, 1513 bp, Euphorbia peplus
cacacaaaagtggctccttaattccacaatttccatttcctcactcccacaaaaaaatgtcaatctgctcaatctacacaccccaatccctcaactcaacatgctcaatctccaaaccaaaaaatacccaattgagctttcttcatcacaaacatgttgcagtcttttacaccacaaaaagaacatcaataacatgtgcagcaaatgaacagacaatagtgattggattagcagcagattccgggtgcggaaagagcacattcatgaggagattaacaagtgtttttgggggagcagcagagcctccaaagggtggaaacccagattcaaacacattgataagtgacacaacaactgtcatttgtttggatgattatcattctttggacagaacaggaaggaaagaaaagggtgtgacagcacttgatccaagagctaatgattttgatcttatgtatgaacaagttaaagctattaaggatggtgttgctgttcagaaacctatttataatcatgttactggattgttggatgctcctgaacttattaagcctcctaagattctggttattgaaggccttcatcctatgtatgatgaacgagtgagggatcttttagacttcagcatatatttggacattagcaatgaggttaaatttgcttggaaaattcagagggatatggcagaaagaggacacagtcttgaaagcattaaagctagtattgaagctcgcaagcctgattttgatgcctttattgatccacaaaagcaatatgcagatgcggtgatagaagtgttgccaacacaactcataccagatgacaatgaaggcaaagttttgagagttaaacttataatgaaagaaggtgttcaatacttcagtcctgtttacttgtttgatgaaggctctaccatttcctggattccctgtggccggaaactcacttgctcctaccccggtatcaagttcgcctatggccccgatgcctatttcggcaacgaggtgtcagtactggaaatggatggacaatttgacagattagatgaattaatatatgtggagagccatttaagcaacatatcaacaaagttctatggagaagtgacacaacaaatgttgaaacattctgatttcccaggaagcaacaatggaactggtcttttccaaaccattgttggattgaaaatcagagatctttttgagcaagttgttgctagcagatctgctaaaactccggccaaagccaatgcctagaattcgtcgacttgtcgacttttttccgttcgatctttctctgtcctgccttacaaaactgttattgaataaggcaattctgagttgttaggaaaatggtgatgataagaaaatgaggaattgatggttgtgtgatgatgttgtaattgtttgtgtaatattatagagaaatttaaagcagtcagttagggctgtttcatataaaaccagtgcctttttggctttatctttctgtatctataaatgctatattgcat

SEQ ID NO: 1261 - DNA, 1651 bp, Actinidia deliciosa
  misc_feature (74)..(74): n is a, c, g, or t
  misc_feature (676)..(676): n is a, c, g, or t
  misc_feature (778)..(778): n is a, c, g, or t
  misc_feature (979)..(979): n is a, c, g, or t
  misc_feature (1096)..(1096): n is a, c, g, or t
  misc_feature (1279)..(1279): n is a, c, g, or t
  misc_feature (1363)..(1363): n is a, c, g, or t
atcaaaattgtttttcccatcatgcaaaactgccatctgtttctgcaaccacaacctctcccttaatctgtgtntttcataaccaaagtgaaaggacccaagaaaacaaccaacatttcatgtcccaataaacccaattcgaactctccaatttctttcaaactcctttctgggtagagagagagagagagagagaatggcaatctgtacattctataccattcaatccctcaactcaatctccacacccacaaaaacccacctgggctttcaccagaaacagctacttttctacagtacaagcaagaaaaacagcaggagagagagtacaacaggaacaatcaaatgctcagcagagaacaagacagtggtgattggcttggcagctgactctggctgtgggaagagcactttcatgaggagactcacaagtgtgtttggtggtgctgccgagccacccaagggtggaaatccagactcaaacacactgatcagtgacatgaccactgtgatctgtttggatgattaccactcactagatagaactgggaggaaagagaaaggggtcactgctcttgacccaagagccaacaactttgatctcatgtatgagcaagtgaaggccctcaagagtggaattgctgttgaaaagcctatttataaccatgtctcaggncttttggaccctcctgagctcaccaagcctcccaagatcctagtcattgaaggattgcacccaatgtatgatgaacgtgtgagggacctcttggacttcagnatctacttggacatcagcaatgaagttaaatttgcatggaaaatccagagggacatggcggagcgaggacacagtcttgaaagcatcaaagccagtatcgaagcccgaaagccagattttgatgcttacatcgatccacaaaagcaatatgctgatgcagtgatagaagtgctgcctacccaactgattccggatgacaangaggggaaagttctgagagtgaggttgataatgaaagaaggggtgaagtatttcaacccggtttacctctttgatgaaggctccaccatcggctggataccgtgtggcaggaaactnacctgctcataccctggcatcaaattttcctacagtcccgacacttactacggcaatgaggtttctgtcttggagatggacggccagtttgacagactggatgagctcatctacgtcgagagccatctcagtaacatctccaccaagttctacggtgaagtcacccaacaaatgctaaagcangccgacttccccggcagtaacaatggtaccggtcttttccaaaccatagttggcttgaagatcagagacctgtacgagcaactnatcgccagtaaggttggagctccattggaagccacaagatcctaaaggcacgaatttgtctaaattttcacttctccatcagccctttccctcattttccttcagagtttcttttcccttccctctgatgtttcagttgagtgtttggctgatcttaagaatgagaaacactccatatgtgtatttgtttcctatttggaactttgtggagacttgtaatatagagacgcaaaagcagaaatgaaattgagttaagaataagaagatcaatcaacatggagtcctttt

SEQ ID NO: 1262 - DNA, 1653 bp, Nicotiana benthamiana
ggacaaaatatcctcaaaggcagaaaaaggaaaaaagaaaaaagaaaaaagaaaaaaagaaattgatcaatgcccattcattcattacatgtcaccccttaaactttagctcatcagatagtaagagagaagggagagggtattccataattctatctctttctctctgaaaaaagaaaaaacctctcaagaggaaaaaatcaagaaaatatggcagtgagtacagtgtacacagctcaatcactgaactctacttgttcaatctccacaccgtcaaaatcccacttaggatttcaccaaaaacaagtgattttctacacaaaattaagaagcaacacaagaagcagtagcactagagtaataacatgttcatctgctgatgatgaaaagacagtggtgattggtttagcagctgattctggatgtgggaaaagtactttcatgaggagattaacaagtgtatttggtggtgctgctgagccaccaaaaggtggaaatccagattcaaacacattaatctcagatatgactactgtgatttgtcttgatgattatcactcacttgatagaactggaaggaaggagaaaggagtgactgctcttgatcctagagctaatgattttgaccttatgtatgagcaagttaaggccattaaggaaggtattgctgtggagaagcctatttataaccatgttagtggtcttcttgaccccccagaactcattaagcctcccaagattcttgttattgaaggattacaccccatgtacgatgaacgtgtgagagaactgttggacttcagtatctacttggatatcagcaatgaggttaagtttgcttggaagattcagagggatatggctgagagagggcacagccttgagagcattaaggccagtattgaagccaggaagccagattttgatgcttacattgacccacaaaagcaatatgcagatgcagtaattgaagtgctaccaactcagctgatcccagatgacaatgaaggcaaagttttgagagtgagattgataatgaaggaaggagtgaagaacttcaacccggtttacctgtttgatgaaggctccaccatctcatggattccttgtggtaggaagttgacttgttcttaccctggcatcaagttcacctatggccctgacacctactttggcaatgaggtaactgtcttggagatggatgggcaatttgacagactggatgagctcatctatgtggagagccatttgagcaacctctcctccaaattctatggtgaagttactcaacaaatgttgaagcatgctgatttccctggtagcaacaatggaacaggtttcttccagaccattgtcggtttgaagatcagagacctctacgagcaaatcgttgccagcagagctgcagctccagttcaagctgcaaaggcctaaacctttgccaaactctattaacagctaggcaccagaatcatctgttgtaccttgttgtttctcccctcttccctaaattttttatttgcccacttctttcatgtttcagttttatggtagataattccccataaatgagaagatacacttgattatgtatttatatctagctggaaatgtgttgagagttgtaacatggcatatcaaggcaagcatcaa

SEQ ID NO: 1263 - DNA, 1885 bp, Glycine max
acctaaaaacttgtccaaaacaaggggtagtcacagaaacacataaacaagaagacacccaccaatattttgctttctcttttcttttcctgcttataactgccttttgttttggttttaattccacctcatattttatatgtgttccaaacttcttcttggaatgtcccttccttaatacccctcaaagaaaagccaccttaacatctcttctctgaaaattctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagcaccttcatgaggaggctgaccagtgtgtttggaggagcagcagagccaccaaagggtggcaaccctgactccaacactctcatcagtgacaccaccactgtcatatgcttggatgattaccactctttggacagaactggaagaaaggagaagggtgtcactgcccttgaccctagagccaatgattttgatctcatgtatgaacaagttaaagctcttaaggatggaattgctgttgaaaaaccaatctacaaccatgtcactggtctcttggatccccctgagctcattaaaccccccaaaatcttagtcattgaaggtttgcacccaatgtttgattcccgtgtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacgcaactcattccagatgacaacgagggtaagattttgagagtgagattgatacagaaagagggggttaagtactttagcccggtttacttgtttgatgatggctctaccatttcatggataccatgtggaagaaagcttacatgctcctaccctggcatcaaattcttctatggacctgagacttactacggaaatgaggtgtcagttgtagaaatggatggacaatttgacagactagatgaactaatatacgttgagagccacctaagcaacctctctacaaagttctatggagaggttactcaacagatgttgaagcatgctgattttcccggcagcaacaatggaacaggtctcttccaaaccatagttggtttgaagataagagatctatatgagcagctaatagccagcaaggctgagactccagtagctgcaaaagcttaggaattgaacctgccataatatatatacatatatcgatcgagcaacgcagccaaattgagttctctcatcatcaaaatcatcattttctttcttctttcatgttttccacaattccactctatttcatgttattttgtcaattgttattaggctgttctgcatgataattaatgaaaaaaacactatgtatgtatgtacttatccgagaagaaaaagcgaggctgagattcagttatgttgatacaagattgagacaataattggcttctctttctctagctagcgttatccatactcgcataacatattttattatcatttttttgtgtgtagtttataaattaatcaaaggggatgatctaattttctatttataggttaactattccctttccactgacccgaaa

SEQ ID NO: 1264 - DNA, 1604 bp, Solanum tuberosum
gataaaaaaattaaaaaaatgcccattcattcattacatgtcacacattaatctatcagaaagtcagtgagaaaaaaaaagagcctcctccataattctatctcaaaaacctctcaagaaacagagaggaaaaaaaatcaagaaaaaatggcagtttgtacagtgtacactgctcaatcactcaattcatcttgttcaatctcaactccatcaaaatcccacttaggatttcaccaaaaacaagtaattttcttcacaaaaagatcaacaaacaaatcaagaaacactgtcataacatgctctgcttctgatgctgaaaaaacagttgtaattgggttagcagctgactctggttgtggtaaaagtacatttatgagaagattaacaagtgtttttggtggtgctgctgaaccaccaaaaggtggaaatccagattcaaacacattgatatcagacatgactactgttatttgtcttgatgattatcattcacttgatagaactggtagaaaagaaaaaggggtaactgctcttgatcctagagctaatgattttgaccttatgtatgaacaagttaaagctattaaagatggtgttgctgttgataaacctatttataatcatgttagtggtcttcttgatcctcctgaggttattaagcctccaaagattcttgtcattgaaggattacaccccatgtatgatgaacgtgtgagagacctcttggacttcagtatctacttggatatcagcaatgaggtcaagtttgcttggaaaatccagagggatatggctgagagaggacacagccttgagagcattaaggccagtattgaagccagaaaaccagattttgatgcttacattgatccacaaaagcaatatgcagatgcagtcattgaagtgctcccaactcagctaatcccagatgacaatgaaggcaaagttttgagagtgagattgataatgaaggaaggagtgaaaaacttcaatccagtttacctgttcgatgaaggatcgacaatctcatggattccttgtggtaggaagttgacttgttcttaccctggcatcaaattcacctatggccctgatacctactttggcaatgaggtatctgtcttggagatggatggccaatttgacagactagatgaactcatctatgtagagagccatttgagcaacctctccagcaaattttatggtgaagttactcaacaaatgttgaagcatgctgacttccctggcagcaacaatggaacaggtttcttccagaccattgtcggtttgaagatcagagacctctacgagcaaatcgttgccagcagagctggagctccagtcacagctgcaaaggcctaaactttgccaaactatattaacagctaggccccagaatcatctgttgtacctagttgtttcccttcttccctaaattttatttgccgacttcttttctccactttcatgtctcagtttcatggtagataattccccataaatgagaaaaatacactttgttatgtattattgtagctggaaatgtgttgagagttgtaacatggataataaaatggtgaaatgaatttcaattccaagca

SEQ ID NO: 1265 - DNA, 1619 bp, Solanum phureja
aaaaaaattaaaaaaatgcccattcattcattacatgtcacacattaatctatcagaaagtcagtgagaaaaaaaaaagagcctcctccataattctatctcaaaaacctctcaagaaacagagaggaaaaaaaatcaagaaaaaatggcagtttgtacagtgtacactgctcaatcactcaattcatcttgttcaatctcaactccatcaaaatcccacttaggatttcaccaaaaacaagtaattttcttcacaaaaagatcaacaaacaaatcaagaaacactgtcataacatgctctgcttctgatgctgagaaaacagttgtaattgggttagcagctgactctggttgtggtaaaagtacatttatgagaagattaacaagtgtttttggtggtgctgctgaaccaccaaaaggtggaaatccagattcaaacacattgatatcagacatgacaactgttatttgtcttgatgattatcattcacttgatagaactggtagaaaagaaaaaggggtaactgctcttgatcctagagctaatgattttgaccttatgtatgaacaagttaaagctattaaagatggtgttgctgttgataaacctatttataatcatgttagtggtcttcttgatcctcctgaggttattaagcctccaaagattcttgtcattgaaggattgcaccccatgtatgatgagcgtgtgagagacctcttggacttcagtatctacttggatatcagcaatgaggtcaagtttgcttggaaaatccagagggatatggctgagagaggacacagccttgagagcattaaggccagtattgaagccagaaaaccagattttgatgcttacattgatccacaaaagcaatatgcagatgcagtcattgaagtgctaccaactcagctaatcccagatgacaatgaaggcaaagttttgagagtgagattgataatgaaggaaggagtgaaaaacttcaatccagtttacctgttcgatgaaggatcgacaatctcatggattccttgtggtaggaagttgacttgttcttaccctggcatcaaattcacctatggccctgatacctactttggcaatgaggtatctgtcttggagatggatggccaatttgacagactagatgaactcatctatgtagagagccatttgagcaacctctccagtaaattttatggtgaagttactcaacaaatgttgaagcatgctgacttccctggcagcaacaatggaacaggtttcttccagaccattgtcggtttgaagatcagagacctctacgagcaaatcgttgccagcagagctggagctccagtcacagctgcaaaggcctaaactttgccaaactatattaacagctaggccccagaatcatctgttgtacctagttgtttcccttcttccctaaattttatttgccgacttcttttctccactttcatgtctcagtttcatggtagataattccccataaatgagaaaaatacactttgttatgtatttatttgtagctggaaatatgttgagagttgtaacatggataataaaatggtgaaatgaatttcaattccaagcaatttctgcaccaact

SEQ ID NO: 1266 - DNA, 1633 bp, Flaveria ramosissima
gggtagtcatagaaacccataaaactaattaacctctgaatccatcaaccacctttgtatactttcatctgttttttttacttcaaagggagttgtaccctgtgaagcttaacttgtacactgcctatatatcccacacccttctctctcacttatgcattatttcaacacacatatgataacaagttaaccacacaaaaatcttgaaattccacattgaaaagctccaaactttatacctctttctctctaaagacttcaagaaacaagagagtaacaatggcagcgtgcacagtgtacacactgcaacctctcaactcatcatgctcaatctcatcacccacaaaaacccacatgggattcacccaaaagcaagtctttttctactccaatggtagtaaaaagactaaaagcaacaggtttagaacaggtggtgagatcacatgctcaggggacacaatagtaataggacttgcagcagactcagggtgtggtaaaagcaccttcatgaggaggttaaccagtgtgtttggtggtgcagcctctccaccaaagggtgggaaccctgactcaaacacactcataagtgacaccaccactgtcatatgtttagatgactatcattcattagatcgcacaggaagaaaagaaaagggtgtgactgcacttgacccacgagccaatgactttgatctgatgtatgaacaggttaaggcgcttaaagatggtgtggctgttgagaagcccatttataaccatgtttcggggcttttagaccctcctgaactcattaaaccacccaagattcttgttattgaaggtctgcacccaatgtatgatcagagagtaagagacctgctggacttcagtatttacttggacatcagtaacgaggttaaattcgcatggaaaatccagagagatatggcggaaagaggacacagtcttgaaagcattaaagctagcattgaggcccgaaaaccagattttgatgcttatatcgacccgcaaaagcaatacgcggatgcagtaatcgaagtgttgcctacacagctaattcctggtgacaatgagggaaggtgctgagagtgaagctcatcatgaaaggaaggagttaagtacttcaaccctgtctacttattcgatgaaggttccactgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccatttgagcaacatttcgacgaaattctatggtgaaatcacccaacagatgttgaaacatgctgatttcccaggtagcaataatggtactggtttgtttcaaaccattgtcgggttgaagatccgagacttgtttgaacaaattgcggccaataagggatcagctctacttgaagctaacaaaagcttgatcaataaatgaagagttattatgagtgatgttgttatcacatatgtatttagctagttccatttgtgtattatgtggagatatgtaatgtaagtataccagttcaataaatagaaaccctgagtgagattgt

SEQ ID NO: 1267 - DNA, 1644 bp, Artemisia annua
ctcacaaaaactatcacttggaagaaaatgaccaaaaaaccatttccagtgacacattaaaaagctattatctcattccctctctctcttaaacttcacaaagtttagagaaaaaatggcagtgtccactgtatacacagtccaatctcttaactcaacatgctcaatctcaacaccaacaaaaaccaatttaggaattcagcaaagacaagtgttgtttttcaatgttggtagaaagactactaggggcagagtgagaggtggtgtgataagatgtgcaggggacactatcgtaattggactagcagcagactcagggtgtgggaagagtaccttcatgagaaggttgacgagtgtgtttggaggtgcagcagagccaccaaagggaggcaatcctgattcaaacacacttataagtgacacaactactgttatatgtttggatgattaccattcgttggatagaacggggaggaaagtggaaggtgtgacagcacttgatccaagagccaataactttgatcttatgtatgaacaagttaaggctcttaaggatggcactgctgttcagaagcctatctataaccatgtcagtggtcttttggaccctccagagctcatcaagccacctaagatccttgtcattgaaggtttgcacccaatgtatgatgagagagtaagagacctcttggatttcagtatctacttggacattagtgacgacgttaaatttgcctggaaaattcagagggacatggcagagagaggacacagccttgaaagtatcaaagctagtattgaagccagaaagccagattttgatgcctatattgacccacaaaagcaatacgcagatgcagttatagaggtattgcctacacagctcattccagatgacaacgagggaaaggttttaagagtgaagctcataatgaaagagggagtgaaatacttcagccctgtttacttgtttgatgaaggctccaccatctcatggatcccatgtgggagaaagctcacctgttcttaccccggaatcaaattcgcctatggccctgattcttactacgacaatgaggtctcagtgttggagatggatggacaatttgacagactggacgagctcatctatgttgagagccatttgagcaacatctccacaaaattctatggagaaattacccaacaaatgttaaagcatgccgacttccctggtagcaacaacgggactggtctcttccaaaccattgttggtttgaaaatccgagacctctttgaacaaatcacagccagcagggcctcagctccattggaagctacaaaagcttaaaagtaaaaaagaagtggtttaacatggaacaaaaaagtccgttgatttttatttcctctaccacctcttttttcatgtaaaattccgagtgttaggctttatcacgagtctcatgagagttacactgcactcccatatgtatttagttacatttgtctattccaaggagatctgtattatagggaatcaaattcataaatgaaatcttgagaagataaaaaaacacctctaatatcatcaagattatctgcatattcctaatatgataaagtacagactcgctttcaatatagaactgtctaaataagttcgct

SEQ ID NO: 1268 - DNA, 1794 bp, Glycine max
ttataactgccttttgttttggttttaattccacctcatatttcatatgtgttccaaacttcttcttggaatgtcccttcctaaataaccctcaaacaaaagccaccttaacatctcttctctgaaaattctctttagagagatagagagagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcaacaggggcaacagcagcagcagaagaagctatgtgataacatgtgcagcaggtgactcacagacagtggtgattggtcttgctgcagactcagggtgtgggaagagcaccttcatgaggaggctgacaagtgtgtttggaggagcagcagagccaccgaagggtggcaaccctgactcaaacacactcatcagtgacaccaccactgtcatatgcttggatgattaccactctttggatagaactggcagaaaggagaagggtgtcactgcccttgaccctagagccaatgattttgatctcatgtatgaacaagttaaagctcttaaggatggaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacccaactcattccagatgacaacgagggtaagattttgagagtgaggttgatacagaaagaaggggttaagtactttagcccagtttacttatttgatgatggctctaccatttcatggataccatgtggaaggaagcttacatgctcctaccctggcatcaaattcttctatggaccagagacttactacggaaatgaggtgtcagttgtagaaatggatggacaatttgacagactagatgaactaatatacgttgagagccacctaagcaacctctctacaaagttctatggagaggttactcaacagatgttgaagcatgctgatttccccggcagcaacaatggaacaggtctcttccaaaccatagttggtttgaagataagagatttatatgagcagctaatagccaccaaggctgagactccagtggctgcaaaagcttaggaattgaattgaacctgccataataatatatatacatatcgaccgagcaacgcagtcaaattgcatgagttctcatcaaaatcatcattttctttcttctttcatgttttccacaatttcactgtgtttcatgttattttgtctattgttattaggctgttctgcatcataattaatgaaaaaaacacatatgtatgtatgtatgtacttatccgagaaaaaaaagtgaggctgagattcagttatgttgatacaagattgagacaataattggcttctctttctctagctttatccatactggcatcgcatattttcttatcaaactttttgtgtgtagtttgtaaattaatcaaagggaatgatctaatattctatttgttggttaactttcttttc

SEQ ID NO: 1269 - DNA, 1788 bp, Eucalyptus grandis
cccaaaaggacacataagcctccatccgtcaagctgacagtcttcatttttgtattccatcaaaaagacactgcacctcactctccatccaaaattcacctcgctcaggaacttgtgttccaaattggttcattgaaaccagaggccattctatccaagaacctacctggtatatacccaccaaccaagatcatataacaactctcgccctgttcaaagacttagaattgctctctaggcagagagagggagggaacgagaatcaagagaaatggcggtttctacagtctacacaacccaatccttccactcgacatgctcaatctccacaccctccaagacccacttgggattcaaccagaagaagcaaatcttgttctacaacagtggcaagaaggtcaccaacagaggcatcgccgcagtcccatatgtgatcaggtgctcaggggacacgctggtgattggcctagcagctgactcaggctgtggcaagagcaccttcatgaggaggctgaccagcgtcttcgggggcgccgccgagccgccgaagggaggcaacccggactcgaacaccctcatcagtgacacaaccaccgtgatatgcctcgacgactaccattccctggacaggactggaaggaaagagaagggagtgactgcacttgacccaagggccaacgactttgatctcatgtacgaacaggttaaggcaatgaaggaaggcaaggctgtggacaagcctatctataaccatgtcactggcctcttggaccctcctgagctcatcaagcctcccaagatcctggtcattgagggacttcacccaatgttcgaccagcgcgttagggacttgctggacttcagcatatatttggacatcagcaatgaggtcaaatttgcatggaaaatccagagggacatggccgagcgaggacacagtctcgagagcatcaaagctagcattgaagcccgaaagccagattttgaagcctatatagacccacagaagcagtatgcagatgcagtgattgaagtgctgccaacacagctaatccctggtgataatgaagggaagattcttagagtgaggttgataatgaaagagggtgtgaagtatttcaacccggtatacctgtttgacgagggctcgaccatctcttggatcccgtgtggaagaaagctcacttgctcttaccccggcatcaagttcacttatggcccggagagttacttcggccacgaggtgtctgtgttggagatggatgggcaatttgacagactagatgagctcatctatgtggaaagccatttgagcaacctctccacaaaattctatggtgaagtcacccagcagatgctgaagcactccgaattccccggaagcaacaatggcactggtctcttccagaccatagttgggctaaaaatcagagacctctatgagcaaatcacagccagcaaagcagctgcaccattacaagccactaaagcttaggaacttccatatactagttccccctcttctttcttcaatccttattcagtccttctgttttcactgttcattcatccttcaaaatgagtattagggttgttgagaagggaaggatctgcatgtattttgtcatcaggataatttgttgtatggagatgtaacatagacaaaaaggggcagagagatcagttacttggtaaaattcaaaaaagagattggtacacccggccctgcccgctttctttgcataaattctccgtggtcttgaatcatatttaggtcccactgaaaag

SEQ ID NO: 1270 - DNA, 1380 bp, Flaveria ramosissima
ttccacattgaaaaagctccaacctttatacctctttctctctcaagacttcaagaatcaagagtaacaatggcagtgtgcacagtgtacacactgcaacctctcaactcatcatgctcaatctcatcacccataaaaacccacatgggattcacccaaaagcaagtcttttctactccaatggtggtaaaaagactaaaagtaacaggtatagaacaggtggtgaaatcacatgctcaggggacacaatagtaataggacttgcagcagactcagggtgtggtaaaagcaccttcatgaggaggttaaccagtgtgtttggtggtgcagcctctccaccaaagggtgggaaccctgactcaaacacactcataagtgacactacaactgtcatatgtttagatgactatcattcattagatcgcacaggaagaaaagaaaagggtgtgactgcacttgacccacgagccaatgactttgatctgatgtatgaacaggttaaggcgctcaaagatggtgtggctgttgagaagcccatttataaccatgtttcggggcttttagaccctcctgaactcattaaaccacccaagattcttgttattgaaggtctgcacccaatgtatgatcagagagtaagagacctgctggacttcagtatttacttggacatcagtaacgaggttaaattcgcatggaaaatccagagagatatggcggagagaggacacagtcttgaaagcattaaagctagcatcgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccatttgagcaacatttcaacgaaattctatggtgaaatcacccaacagatgttgaaacatgctgatttcccaggtagcaataatggtactggcttgtttcaaaccattgtcgggttgaagatccgagatttgttcgaacaaattgcagccaataagggatcagctccacttgaagctacaaaagcttgatcataaatgaagagttattatgagttgatgttgttatcacatatgtatttagctagttccatttgtgtattatgtggagatatgtaatgta

SEQ ID NO: 1271 - DNA, 1486 bp, Senecio madagascariensis
ctatattagaaaatgagtaaatgaccaaaaagccatttctagtgagatacattaaaaagaaagctaattctcattctcattctttaacaaagttaaaatggcaatgtccacagtctacacagtccaatctctaaactcaacatgttcaatctcaaaaaacacaaaaaccaagttaggaattcaacaaaaacaagtgttgtttttcaatgttggtaaaaagactaatacctataagggtaggattagtagagtgagatgtgcagcaggaggggacacaatagttattggactagctgcggattctgggtgcggaaagagtaccttcatgagaaggttaactagtgtgtttggtggtgcagccgaaccaccaaagggaggaaaccctgattcaaacacacttataagtgacacaacaacagttatatgtttggatgattatcattcattggatagaacggggaggaaagtcgaaggtgtgaccgcacttgatccacgagccaataactttgatcttatgtatgaacaagttaaggctcttaaaagcggaatcgcggttgagaagcctatttataaccatgttagtggtcttttggaccctccagagctcatcaaaccacctaagatccttgtcattgaaggtttgcatccaatgtatgatgagcgagtgagagaccttttggacttcagtatctacttggacatcagtaacgatgttaagtttgcgtggaaaattcagagggacatggcagagagaggacatagtcttgaaagtattaaagctagtattgaggcgcgaaagccagattttgatgcatatattgacccacaaaagcaatatgcggatgcagttatagaagtgttgccgacgcagttgattccagatgacaacgaggggaaggtgttgagagtgaagctgataatgaaagaaggagtgaaatacttcagcccggtttacttgtttgatgaaggatccaccatttcatggatcccttgtggaaggaagctaacttgttcttatcccggtatcaaatttgcatatggtcctgattcttactacgaccatgaggtgtccgtgttggagatggatggaatgttcgacagactagacgagctcatttacgttgagagccatttgagcaacatttccaccaaattctacggagaaattactcaacagatgttgaagcattccgacttccctggtagcaacaacggaactggtttgttccagaccattgttggtttgaaaatcagagacctctttgaacaaatcaccgccaacagggtctctgctccactcgaagctacaaaagcttgatttttctttcgtctacaacctctgtttattcatgtaaaatttcgagtgttagagtctcgtgagaattacactcccatatgtatttagttgcattcctctgtgtaatatagggaaacaaattcttaaatataatctttacaagattaaagaatacctctatctattatc

SEQ ID NO: 1272 - DNA, 2006 bp, Glycine max
acctccaaacttgtccaaaacaaggggtagtcacagaaacacaaacaagaagacaccaatattttctttttctcttttcttttcctgcttataactgccttttgttttggttttaattccacctcatatttcatatgtgttccaaacttcttcttggaatgtcccttcctaaataaccctcaaacaaaagccaccttaacatctcttctctgaaaattctctttagagagatagagagagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcaacaggggcagcagcagcagcagaagaagctatgtgataacatgtgcagcaggtgactcccagacagtggtgattggtcttgctgcagactcagggtgtgggaagagcaccttcatgaggaggctgacaagtgtgtttggaggagcagcagagccaccgaagggtggcaaccctgactcaaacacactcatcagtgacaccaccactgtcatatgcttggatgattaccactctttggatagaactggcagaaaggagaagggtgtcactgcccttgaccctagagccaatgattttgatctcatgtatgaacaagttaaagctcttaaggatggaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacccaactcattccagatgacaacgagggtaagattttgagagtgaggttgatacagaaagaaggggttaagtactttagcccagtttacttatttgatgatggctctaccatttcatggataccatgtggaaggaagcttacatgctcctaccctggcatcaaattcttctatggaccagagacttactacggaaatgaggtgtcagttgtagaaatggatggacaatttgacagactagatgaactaatatacgttgagagccacctaagcaacctctctacaaagttctatggagaggttactcaacagatgttgaagcatgctgatttccccggcagcaacaatggaacaggtctcttccaaaccatagttggtttgaagataagagatttatatgagcagctaatagccaccaaggctgagactccagtggctgcaaaagcttaggaattgaattgaacctgccataataatatatatacatatcgaccgagcaacgcagtcaaattgcatgagttctcatcaaaatcatcattttctttcttctttcatgttttccacaatttcactgtgtttcatgttattttgtctattgttattaggctgttctgcatcataattaatgaaaaaaacacatatgtatgtatgtatgtacttatccgagaaaaaaaagtgaggctgagattcagttatgttgatacaagattgagacaataattggcttctctttctctagctttatccatactggcatcgcatattttcttatcaaactttttgtgtgtagtttgtaaattaatcaaagggaatgatctaatattctatttgttggttaactttcttttccactgaggaccagaatattctattggtcaaattaataaaaaaatcatggtaggccaatgcaatgatcttctcttagtaaaaggatggattcactatattgattattgacactttttaaaatgga

SEQ ID NO: 1273 - DNA, 1537 bp, Euonymus alatus
cggccggggcttcttacacaatctgccatctgtttctccctaaaccttttcctccacatatttgtgttccaaaaattttcctgagaaaaagtagatgcaaatgagctgaagattgcctagagaacacaattcagcagcatccacttcctctctcaattccagagagagagagagagagaatggcagtctgcaccgtctacacaacccaatctctcaactcaacatgctcaatctccacactaacaaaaaccaacttgggttttcaccgaaaacaggttgtgttctatagcacttctggtaagagaagcagaggtaataacactactgtgataacctgctcagcaggtgactcacagacagttgtgattggcctggcagcagactcaggatgtgggaagagtacattcatgaggaggctaacgagtgtttttggaggagcagcagagccaccaaaaggaggaaatccagactcaaacacactgattagtgacacaacaactgtgatatgcttggatgattttcattctcttgacagaactggagggaaagaagggagtgactgcacttgacccaagagccaacaactttgatctcatgtatgagcaggttaaggccatcaaggatggaattgctgttcagaaacccatctataatcatgtgagtggtcttcttgaccctcctgagctcatcaagcctcccaagatccttgtcattgaaggacttcacccaatgtatgatcacagagtaagggacctgttggactttagtatctacttggatatcagtaatgaagttaagtttgcatggaaaattcagagggacatggctgagcgagggcgcagccttgaaagcattaaagctagtattgaagcgagaaagccggactttgatgcttatattgatccgcaaaagcaatatgcggatgctgtgattgaagtacttccaacccaacatatcccggatgacaacgaggggaaggtcttgagagttaggttgataatgaaggaaggtgtgaagtacttcaaccctgtttacttgtttgatgaaggctccactatttcatggataccctgtggaaggaaactcacctgctcttatcccggcatcaagttctcctatgggcccgatagttactacggccacgaggtgtctgtactggagatggatgggcaatttgacagattagatgagctaatctatatagagagccatttgagcaacatttcgaccgagttctatggtgaagtcacccaacaaatgttgaaacatgatgattttcctggcagtaacaatggaaccggtctcttccaaactatagttggattgaaaatcagagatctctacgaacagcttgttgcgagcaaggccagacgtccagtagaagcaaaggcctaagcacaaagccacttcctcttgttcatgttttttcttcgctctttttttcttttccatcgggcctcttcggggtgttactcgttaaaatgcgaatcacagtgtgtacctatttcaatttataattgtattgggagtttgtaaa

SEQ ID NO: 1274 - DNA, 1568 bp, Epimedium sagittatum
ctccaaaatttttgtctagtaacaaacatacatcatcaatattctatcttcaaaaatctccataactacttgtattcctctctttctcttttcctttgatccccagagggaaagaagaagaagaagaagcagccgccatggctatctgcacactctacacacccaattctctaaactcaaccttcttcacaccatcaaaccaaaaacactttctcttctccaccaccacaaccacaaccagaagactcaacaacagtaacaccaccaccttctcaactatttcatgttcagcagaagaaaaaacaatcgtgatcggcctcgcagccgactcaggatgcggaaagagcacgttcatgagaagactaaccagtgtgtttggtggtgcagctgaaccaccaaagggtggtaacccggactcgaatactctgattagtgataccactactgtgatttgtttggatgattatcattctcttgatagatatggaaggaagaaggaaggtgtgactgctcttgacccaaaggccaataactttgatcttatgtatgatcaggttaaggctcttaaggatggtgttgctgttgagaagcctatttataatcacgttagtggtcttttggatcctcctgagcttattaagcctcctaagattcttgttattgaagggttgcacccaatgtttgattctcgcgtaagggacctcctcgacttcagtatctacctagacatcagtaatgaagtcaagttcgcttggaaaattcagagggacatggcggaacgtggtcacagtcttgagagtattaaagctagtattgaagctcgaaaaccagacttcgacgcttatattgatccacagaagcaatatgcagatgccgttatagaagtcctgccaacggaactcattcctgacgacaatgagggaaaggtcctaagggttcgtatgataatgaaagaaggggtcaagtttttcaacccaacttacttgtttgacgagggttccacaatctcgtggattccttgtggaaggaaattgacatgttcatatcctggaatcaagtttagctacggtcctgacgcttactacagccatgaggtgtcggtgttggaaatggacggacagtttgacagactagacgagctcatatatgttgagagccatctaagcaacatttcgaccaagttctacggtgaggttacacagcaaatgctaaagcattccgacttcccaggtagtaacaatggtacaggtctcttccagaccattattgggttaaagattagagacctgtacgagcagcttatcgctagcagggctgaggttccattacaagcaaccaaagcctagtcacgtaaatgaatcaccatttgctgcaatttttcttcgacgagtgtaggtttctcatgatgttgagcacactcttatgtgtattgttcatgttgtaatcttatggaatttgtaaaatagaggagcgaaatagatataaaaatgcaattaaaaatgatcaaacactctgattttggggtggtgtttgtttgttagaacaaaactttgagaaaactgtcttac

SEQ ID NO: 1275 - DNA, 1547 bp, Arachis hypogaea
ctttctttgtatagagagagagagagtggggaaagggaaagagtaacaatggcaacttgcactctctactccacacaatgtttcaacacaatctcatcaaccccatcatcaaaaacacatttaggattccaccaaagacaagtagtgttctacacaacaaccaataacaaaagaagcagcaacaagagaagcggaaacaacaataccggccgctatgtaataacatgcgcggccggggacacggtggtgattggtcttgccgcagactcaggctgcggcaagagtaccttcatgagaaggctaacaagtgtgttcgggggcgcggccgagccgcccaagggcggaaacccggactcgaacacacttattagtgacacaaccaccgtgatatgcttggatgattaccattcattggatagaaccggaagaaaagagaagggtgtgactgcacttgatccaagagccaatgattttgacctcatgtatgaacaagttaaggctcttaaggaaggaattgcagttgagaaacctatttacaaccatgtcactggtctcttggatccaccagaagtcatcaaacctcccaaaatcttggtcattgaaggtttgcatccaatgtttgatgctcgggtcagagatctcttggacttcagcatctacttagacattagtaatgaggttaaattcgcatggaaaattcagagagacatggcagagcgtggacacagtcttgaaagcatcaaggctagcattgaagcaaggaagcctgattttgatgcttatattgatcctcaaaagcaatatgcagatgcagtgatagaagtgttgccaactcagctgatcccagatgacaatgaagggaagattctaagagtgaggctgatacagaaagaagggattaaacactttagccctgtttatttgtttgatgatggttccaccatttcttggattccatgtggaaggaagcttacatgctcttaccctggcatcaaattcttctatggacctgatacttactttggaaatgaggtgtcagttgtagaaatggatggtcaatttgacagattagatgaactaatatatgtagagagccatctaagcaacctgtcaacaaagttctatggagaagtgactcaacagatgttgaagcatgctgacttccctggaagcaacaatggtactggtctcttccaaaccattgttggtctcaagattagagacttatatgaacagatcataacctccaaggctgagactcctgttggagcagctaaggcttagatccatttcatatatatacagccattgaatttgatgatatcatgagatgaaatcaatcattttcttcttcttcttttaatcaatgttggcttcttgttttggtgagagcttcttcataatgtaaaacactcttctgtatgtatctatctctatatatatatgtatgtacaattatcttatctcttgtaactcataatatccagaaaataaaaaagttaaaaacaaaaggagctgagatttttcagttatatatgttgatatga

SEQ ID NO: 1276 - DNA, 1468 bp, Arachis hypogaea
gagtggggaaagggaaagagtaacaatggcaacttgcactctctactccacacaatgtttcaacacaatctcatcaaccccatcatcaaaaacacatttaggattccaccaaagacaagtagtgttctacacaacaaccaataacaaaagaagcagcaacaagagaagcggaaacaacaataccggccgctatgtaataacatgcgcggccggggacacggtggtgattggtcttgccgcagactcaggctgcggcaagagtaccttcatgagaaggctaacaagtgtgttcgggggcgcggccgagccgcccaagggcggaaacccggactcgaacacacttattagtgacacaaccaccgtgatatgcttggatgattaccattcattggatagaaccggaagaaaagagaagggtgtgactgcacttgatccaagagccaatgattttgacctcatgtatgaacaagttaaggctcttaaggaaggaattgcagttgagaaacctatttacaaccatgtcactggtctcttggatccaccagaagtcatcaaacctcccaaaatcttggtcattgaaggtttgcatccaatgtttgatgctcgggtcagagatctcttggacttcagcatctacttagacattagtaatgaggttaaattcgcatggaaaattcagagagacatggcagagcgtggacacagtcttgaaagcatcaaggctagcattgaagcaaggaagcctgattttgatgcttatattgatcctcaaaagcaatatgcagatgcagtgatagaagtgttgccaactcagctgatcccagatgacaatgaagggaagattctaagagtgaggctgatacagaaagaagggattaaacactttagccctgtttatttgtttgatgatggttccaccatttcttggattccatgtggaaggaagcttacatgctcttaccctggcatcaaattcttctatggacctgatacttactttggaaatgaggtgtcagttgtagaaatggatggtcaatttgacagattagatgaactaatatatgtagagagccatctaagcaacctgtcaacaaagttctatggagaagtgactcaacagatgttgaagcatgctgacttccctggaagcaacaatggtactggtctcttccaaaccattgttggtctcaagattagagacttatatgaacagatcataacctccaaggctgagactcctgttggagcagctaaggcttagatccatttcatatatatacagccattgaatttgatgatatcatgagatgaaatcaatcattttcttcttcttcttttaatcaatgttggcttcttgttttggtgagagcttcttcataatgtaaaacactcttctgtatgtatctatctctatatatatatgtatgtacaattatcttatctcttgtaactcataatatccagaaaa

SEQ ID NO: 1277 - DNA, 1561 bp, Capsicum annuum
tcagaaagagcctccataattctatctctttctctctagaaaacagaaaaaaagaacgacctctcaagaaactgagaggaaaaatcaagaaaatatggcagtatgtacagtgtacacagctcaatcactgaactcaacatgttcaatctccaccccatcaaaatcccacttaagatttcaccaaaaacaagtaattttctacacaaaaagaacaaacaacaaaacaagaatctccacaagtaataatatcataacatgttcagctggtggtgatgagaagacagttgttattggtttagcagctgattcaggttgtggtaaaagtacatttatgaggagattaacaagtgtatttggtggtgctgctgagccaccaaaaggtgggaatccagattcaaacacattgatatcagacatgactactgttatttgtcttgatgattatcattcacttgatagaactggaaggaaggaaaaaggggttactgctcttgatcctagagctaatgattttgatcttatgtatgaacaagttaaggctattaaagaaggtgttgctgttgataagcctatttataatcatgttactggtcttcttgatcctcctgagctcattaagccaccaaagattcttgtcattgaaggtttacaccccatgtttgatgagcgtgtgagagagctcttggacttcagtatctacttggatatcagcaatgaggttaagtttgcttggaagatccagagggatatggctgagaggggacacagccttgagagcattaaggccagtattgaagccaggaaaccagattttgatgcttacattgatccgcaaaagcaatatgcagatgcagttattgaagtgctaccaactcagctcatcccagatgacaatgaaggcaaagtattgagagtgaaattgataatgaaggaaggagtgaaaaacttcaatccagtttacctgtttgatgaaggctccacaatctcatggattccttgtggtaggaagttgacttgttcttaccctggcatcaagtttacctatggccctgacacctactttggcaatgaggtatctgtcttggagatggacggccaatttgacagattagatgagctcatctatgtagaaagtcatttgagcaacctctccaccaaattctatggtgaagttactcaacaaatgttgaagcatgccgacttccctggcagcaacaatggaacaggtttcttccagaccattgttggtttgaagatcagagacctctacgagcaaatcgttgccagcagagctggagctccagtcacagctgcaaaggcctaaactttcacaaaactctataaacagctaggcaccagaatcatctgttgtaccttgttgtttcccctctcatccctgaaattttatttgccgacttcttccccactttcatgtttcagtttcatggtagataattccccataaatgagaaaacacactttgctatgtatttatttgtagctggaaatgtgttgagagttgtaacatggataataaaaggtgaaatgaatttcttttccc

SEQ ID NO: 1278 - DNA, 1551 bp, Zostera marina
agaagaacacttacttctagttccaaaccaacattttctcttcttcctcaaagagctagaaggaagcttggtggccagaagagaaaaaatggcagtctgcacagtctactctcctcattctctcaaatccacatgcccaattccaaatacatcaagaatccaattgggttctcatcagaagcaagttattttcttcacaaggagaaaaggcggcaactacagaagcaataagttatccggtaccatcacctgtgaagcaaacacaattgttatcggtcttgcagcagattcaggatgtggaaagagcacattcatgaggagacttactagtgtatttggtggagcagcatcacctcccaagggtgggaatccagactcaaacacgcttatcagtgacacgacaactgtgatatgtcttgatgactaccactctctcgatagatatggaagaaaggagcagggtgttactgcacttgatccaaaagccaacaactttgatctcatgtatgaacaagttaaggcacttaaacaaggtattgctgtggagaaaccaatttataatcatgttactggaattctcgatcctcctgagctcattcaacctcccaagatcctggttattgaaggactgcacccaatgtacgattctcgtgtccgtgatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaagggaaggtgttgagagttaagctggtgatgaaggaaggagtgaaatatttcagtccctcgtacctctttgatgaaggatcaaccatcgattggatcccatgtggaagaaaattgacttgttcatatccaggaattaagttctcttatggtccagacagttactactcaaacgaggtatctgtgttggagatggatgggcaattcgacaaattagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattgcagaaaagaaaggcagttcactgcaagcagccaaaatgtagaaaatgttcttttaccaatctaattttttccctctcttcttatttacttatgttgttccagtaaatacccaaactggtaaaaatgagattaccagtatataaatatacagacttatgattgtgaattcgaaatcaaatcgtattgtggctagcatgtggtagttttgtgttcgaaataagacgatcttcatcaaatcacagtaatttgaaggaaagtaatgattgaatgaatgaaatcaagtagg

SEQ ID NO: 1279 - DNA, 1542 bp, Antirrhinum majus
  misc_feature (24)..(24): n is a, c, g, or t
  misc_feature (693)..(693): n is a, c, g, or t
  misc_feature (696)..(696): n is a, c, g, or t
  misc_feature (714)..(714): n is a, c, g, or t
  misc_feature (736)..(736): n is a, c, g, or t
  misc_feature (747)..(747): n is a, c, g, or t
  misc_feature (1236)..(1236): n is a, c, g, or t
caaacccaaaaaaagagtatcgcnaattcggcaccgaaaaaaaaaaaatctcactccaggagaggaagaaaaaaaaaagaaagaatggcagtgtgtactacttttgccacagtccaatccctcaactcaacatactcaatctccactagtccatcaaaaacacacttggtaggattcaacacaaaaaatgtcctattctacaacacttccaagaaaacattcaccaccaccactagaaaaatatcatgctccgcagacgaaaagcccattgttatcggtctagccgccgactctggatgcggtaagagtacattcatgaggcggctcaccagcgtattcggtggcgctgccgagccgccaaagggcggtaacccggactcaaacactctcatcagcgacacgacaacggtgatttgtttagatgactatcactcactcgacaggaccggaaggaaggagaagggagtgaccgctcttgacccgagagcaaacgactttgatctcatgtacgagcaggttaaggctattaaagatggagttgcggtggagaaacctatttataaccatgttacaggcttgttggatcctccggagttgatcaagccacctaagatttttgttattgaaggattgcacccaatgtacgatgcccgtgttagagacctattggacttcagtatatatttggacatnagnaatgaagttaaattcgcntggaaaattcagagagacatgnctgaaagaggncacagtctagaaagcatcaaggctagtattgaagccagaaaaccagattttgatgcatacattgatccacaaaagcaatacgctgatgcggttattgaagttttgccgacccaactcattccagatgacaacgaggggaaagtcctaagagtacgactgataatgaaagaaggcgttaaatacttcaacccggtttacctgtttgatgagggatccactatctcatggataccttgtggaaggaagctcacatgctcgtaccctggcatcaagttcacctatggtcccgaaacttactttggcaatgaggtttccgtattggaaatggatggccaatttgacagactagatgaacttatttacgtcgaaagccatctgagcaacatttccaccaagttctatggtgaagttacacagcaaatgttgaagcatgcggatttccctggaagcaacaatggaaccggtcttttccagacaattgttggattnaagataagagaccttttcgagcagcttactgcaggcagggccgctgcccctttggaagctacaaaggcctaagtaatgcttgaaatgaatggagataggcagtgtgccatctaaaattttcttaagaattttactgtgattgttaaatgctagaatatcttcatacattgaggagttctccattgtgtacttattttcagttggaactctgtcgagacttgtatcatagagaaacaaaagcacatgtgagatcgaacatatggacatgcaaatattttgttgataaaaaaattaagtgtctttttc

SEQ ID NO: 1280 - DNA, 1607 bp, Arnica chamissonis
accctttgccagtgacacattaaaaagctattttctcattctctctctctctaaaccttcacaaagttgagagagaaaaatggcagtgtccacagtgtacacagcccaatctctgaactcaacatgctcaatctcaacacccacaaaaacccacttaggaattcagcaaagacaggtgttgttctatagtaaaaagaccaataggggcagggtgagaggtggtgagataagatgctcagggggcacaatagtaattggactagcagcagactcagggtgtgggaagagtaccttcatgaggaggttgactagtgtgtttggaggtgcaggagagccaccaaagggaggcaaccctgattcaaacacactcataagtgacacaacaacagttatatgtttggatgattaccattcactggataggacagggaggaaagtggaaggagtgaccgcacttgatccgagagccaataactttgatcttatgtatgaacaagtgaaggctctgaaagatggtgttgctgttgagaagcctatttataaccatgttagtggtcttttggaccctcctgagctcatcaagccacctaagatccttgttattgaaggtttgcacccaatgtatgatcagagagtaagagacctcttggacttcagtatctacttggacatcagcaatgatgtcaaatttgcctggaaaattcagagggatatggcagaaagaggacacagccttgaaagtatcaaagctagtattgaggccagaaagccagattttgatgcttatattgacccccaaaagcaatatgcagatgcagttatagaagttttgcctacacagctgattccaggtgacaatgaagggaaggtgttgagagtcaagctgataatgaaagagggagtgaaatacttcagccctgtttacttgtttgatgaaggctccaccatctcatggattccatgtgggaggaaacttacctgttcttaccctggtatcaagtttgcctacggccctgattcttactacggtcatgaggtctctgtgttggagatggatgggcaatttgacagactggatgagctcatctatgttgagagccatttgagcaacatttccaccaaattctatggagaaatcacccagcaaatgttgaagcattctgacttccctggtagcaacaatgggactggtctctttcagaccattgttggtttgaaaatcagagatctctttgaacaaatcacatccaccaaggcctcagctacattggaagctacaaaagcttaaaccaaagaaacaaaagaagtcccttgattttctttcctcctttttcatgtaaaattctgagtgttaggcttttatcacgagtctcatgagagttacactcccgtatgtatttagttgtatttatgtattccatgggtatctgtattatagggattcaaattcttatatataatgttgacaagactaaaaaatacagctatatacgaatataccaaaagtaatatgaattgtcaataagttccggcaagaacttgaacctgaaccaaatttccttgatacctgtaacaatttcctcttattttagagtatatgacatttt

SEQ ID NO: 1281 - DNA, 1407 bp, Fagopyrum esculentum
atggcagcatgcacactatacgcagctctacccacaacccatttgggttcactaacaaacattccgcggtcgtgttctacaccaacaccaagctaagaagcattagaagaacgaacacgacggtgataacatgctcggtaggtgactcacagacgattgttattggtctagccgcggactctgggtgtgggaagtcaacattcatgaggcggttaactagtgtattcggaggagcggccgagccaccaaagggtgggaatccggattcaaacacgcttattagcgacactacgacggttatttgcttggatgactaccattcacttgatagaaccgggaggaaggagaaaggagtgacggctcttgacccaagagcaaatgacttcgatttgatgtatgaacaagttaaagctttgaaggaaggtaaggccgtcgataagcctatttataaccatgttactggattacttgatcctcccgaggttatccagcctcctaagatccttgtcattgaaggcttgcaccccatgttcgaccaacgtgtaagagacttgttggacttcagtatctacctagacatcagcaatgaagtcaagtttgcttggaagattcagagggatatggcggagagaggacacagcctagagagcatcaaggctagtatcgaagcccgaaagcccgatttcgacgctttcattgatccacagaagcaatatgcggatgcagtgattgaagttctacccacacaactaatcccggacgacaccgagaagaaggtgttgagagtaaggctgataatgaaggaaggagccaagtatttcagcccggtttacctcttcgatgaaggatcaaccatctcatgggtaccttgtggcaggaagctcacttgctcgtacccgggaatcaagtttgcttacggacccgacacttacttcggcaatgaggtgactatccttgaaatggatggacagtttgacagactagatgagctgatctatgtggagagtcacctgagcaatttgtcgacgaaattctatggagaagtgacgcaacaaatgttgaagcacgcggattttccgggaagtaacaacgggacgggcttcttccagacgatagtcgggttgaagatccgagacttgtttgagcagattgttgctagcaggcaaccaaccgcagctgctgcagcaaaagcctgaatatgatgcaacctgagcattgctattttcttgttgtggtttcattatttagggtttctatgatcctttacaaaaggagaggctcaagagctgtaattatgtgaaaaattcttacagatgtagagttgaagggaagatgaaatgctgtacaagtgtaaactatttcggacctacttctctaatctcatcgaatcgttctaaggattttatt

SEQ ID NO: 1282 - DNA, 1439 bp, Flaveria ramosissima
aaaaagtttagagagagagaatggcagtgtgcacagtgtacacagtgcaatctctgaactcaacatgttcaatctcaacaccaacaaaaacccatttgggaattcagaaaagacaagtgttgttctatagtaaaaagaccaataagggcagagtgagaagtggtgagataagatgctcaggggacacaatagtaattggactagcagcagactcagggtgtgggaagagtaccttcatgaggaggttgactagtgtgtttggaggtgcagcagagccaccaaagggcggcaatcctgattcaaacacacttattagtgacacaacaacagttatatgtttggatgattaccattcattggatagaacaggtaggaaagtggaaggggtgaccgcacttgatccgagagccaataactttgatcttatgtatgagcaagtcaaggctttaaaagatggtgttgctgtacagaagcctatttataaccatgttagtggtcttttggaccctcctgagctcatcaagccacccaagatccttgtcattgaaggcttgcacccaatgtttgatcagagagtaagagacctcttggacttcagtatctacttggacatcagcaacgacgttaaatttgcctggaaaattcagagggacatggcagagagaggacacagccttgaaagtatcaaagctagtattgaggccagaaagcctgattttgatgcctatattgacccacaaaagcaatatgcagatgcagttatagaagttttgcctacacagctgcttccggacgacaatgaggggaaggtgttgagagtgaagttgataatgaaagagggagtgaaatatttcagcccagtttatttgtttgatgaaggctccaccatttcatggattccctgtgggaggaagctcacttgttcttacccgggtatcaaattcgcctatggccctgatacttactatggtcatgaggtgtctgtgttggagatggatgggcaatttgacaaactggatgagctcatctatgttgagagccatttgagcaacatctccaccaaattttatggagaaattacccaacaaatgttgaagcatgccgacttcccaggcagcaacaatggcaccggtctcttccaaaccattgttggtttgaaaatcagagatctctttgaacaaatcacagccagcaaggcctcggctcaattggaagctacaaaagcttaattcaataagtgacaaataaagtccatttttctttctcctaccaactctttctttcatgtaaaatccgagtgttaggcttttatcacgagtctcatgagagttacactcccatatgtattcatttgcgtttgtctattccatggagatctgtgatacagagaatcaaaaaactaaatgagatcttgagaagattaaagaacacctccgtta

SEQ ID NO: 1283 - DNA, 1377 bp, Flaveria ramosissima
tgacacatttaaaaacctattttctcattctatctctctcttaacattctttacaaagtttagagggaaaaaatggcagtgtccacagtgtacacagcccaatctctcaactcaacatgttcaatctcaacacccacaaaaacccatttgggaattcagcaaagacaagtgttgttctatactaaaaagaccaataggggcagggtgaggggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccaccacagtcatatgtttggatgattaccattcattggatagaacagggaggaaagttgaaggggtgacagcacttgatccaagagccaataactttgatcttatgtatgagcaagttaaggctttgaaagatggtattgctgttgaaaagcccatttataaccatgttagtggtcttttggaccctcctgagaccatcaagccacctaagatccttgtcattgaaggtttgcacccaatgtatgatcagagagtaagagacctcttggatttcagtatctacttggacatcagcaatgatgttaaatttgcctggaaaattcagagggacatggcagaaagaggacacagccttgaaagtatcaaagctagtattgaggccagaaagccagattttgatgcttatatcgacccacaaaagcaatatgcagatgctgttatagaagtgttgcctacacagctcattccaggtgacaatgaggggaaggtgttgagagtcaagctgataatgaaagagggagtgaaatacttcagccctgtttacttgtttgatgaaggctccaccatctcatgggttccatgtgggaggaaactcacctgttcttaccctggtatcaaatttgcctatggccctgatacttactacggtcatgaggtctctgtgttggagatggatgggcaatttgatagactggatgagcttatctatgttgagagccatttgagcaacatttccaccaaattctatggagaaatcacccagcaaatgttgaagcattcagatttccctggtagcaacaatggcactggtctcttccaaaccattgttggtttgaaaatcagagatctctttgaacaaatcacagccagcaaggcctcagctacattggaagctacaaaagcttaaactgaagaaacataaagaagccctttgaaatttctttcctctacaaccctttttttcatgtaaaattctgagtgttaggcttttatcacgagtctc

SEQ ID NO: 1284 - DNA, 1430 bp, Flaveria ramosissima
acacattaaaaagctattttctcattctctctctctaaacttcaaaaagtttagagagagaaaatggcagtgtgcacagtgtacacagtgcaatctctgaactcaacatgttcaatctcaacaccaacaaaaacctatttgggaattcagaaaagacaagtgttgttctatagtaaaaagaccaataagggcagagtgagaagtggtgagataagatgctcaggggacacaatagtaattggactagcagcagactcagggtgtgggaagagtaccttcatgaggaggttgactagtgtgtttggaggtgcagcagagccaccaaagggaggcaatcctgattcaaacacactcataagtgacaccacaacagttatatgtttggatgattaccattcattggatagaacaggtaggaaagtggaaggggtgaccgcacttgatccgagagccaataactttgatcttatgtatgagcaagtcaaggctttaaaagatggtgttgctgtacagaagcctatttataaccatgttagtggtcttttggaccctcctgagctcatcaagccacccaagatccttgtcattgaaggcttgcacccaatgtttgatcagagagtaagagacctcttggacttcagtatctacttggacatcagcaacgacgttaaatttgcctggaaaattcagagggacatggcagagagaggacacagccttgaaagtatcaaagctagtattgaggccagaaagcctgattttgatgcctatattgacccacaaaagcaatatgcagatgcagttatagaagttttgcctacacagctgcttccggacgacaatgaggggaaggtgttgagagtgaagttgataatgaaagagggagtgaaatatttcagcccagtttatttgtttgatgaaggctccaccatttcatggattccctgtgggaggaagctcacttgttcttacccgggtatcaaattcgcctatggccctgatacttactatggtcatgaggtgtctgtgttggagatggatgggcaatttgacaaactggatgagctcatctatgttgagagccatttgagcaacatctccaccaaattttatggagaaattacccaacaaatgttgaagcatgccgacttcccaggcagcaacaatggcaccggtctcttccaaaccattgttggtttgaaaatcagagatctctttgaacaaatcacagccagcaaggcctcggctcaattggaagcaacaaaagcttaattcaataagtaacaaataaagtccatttttcttctcctaccaactctttctttcatgtaaaatctgagtgttaggcttttatcacgagtctcatgagagttacactcccatatgtattcatttgcgtttgtctattccatggagatctgtgatacaga

SEQ ID NO: 1285 - DNA, 1482 bp, Flaveria ramosissima
cccatagccagtgacacatttaaaagcctattttctcattctatctctctcttaacattcttcacaaagtttagagggaaaaaatggcagtgtccacagtgtacacagcccaatctctcaactcaacatgttcaatctcaacacccacaaaaacccatttgggaattcagcaaagacaagtgttgttctatactaaaaagaccaataggggcagggtgaggggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccaccacagtcatatgtttggatgattaccattcattggatagaacagggaggaaagttgaaggggtgacagcacttgatccaagagccaataactttgatcttatgtatgagcaagttaaggctttaaaagatggtattgctgttgaaaagcccatttataaccatgttagtggtcttttggaccctcctgagaccatcaagccacctaagatccttgtcattgaaggtttgcacccaatgtatgatcagagagtaagagacctcttggatttcagcatctacttggacatcagcaatgatgttaaatttgcctggaaaattcagagggacatggcagaaagaggacacagccttgaaagtatcaaagctagtattgaggccagaaagccagattttgatgcttatatcgacccacaaaagcaatatgcagatgctgttatagaagtgttgcctacacagctcattccaggtgacaatgaggggaaggtgttgagagtcaagctgataatgaaagagggagtgaaatacttcagccctgtttacttgtttgatgaaggctccaccatctcgtgggttccatgtgggaggaaactcacctgttcttaccctggtatcaaatttgcctatggccctgatacttactacggtcatgaggtctctgtgttggagatggatgggcaatttgacagactggatgagcttatctatgttgagagccatttgagcaacatttccaccaaattctatggagaaatcacccagcaaatgttaaagcattcagatttccctggtagcaacaatggcactggtctcttccaaaccattgttggtttgaaaatcagagatctctttgaacaaatcacagccagcaaggcctcagctacattggaagctacaaaagcttaaactgaagaaacataaagaagccctttgaaatttctttcctctacaaccctttttttcatgtaaaattctgagtgttaggcttttatcacgagtctctcccatatgtatttagttgtatttatctattctatggatatctgtattatagggattcaagttcttaaataaaatcttgacaagataaaagact

SEQ ID NO: 1286 - DNA, 1437 bp, Flaveria ramosissima
ttaaaaacctattttctcatcctatctctctcttaacattcttcacaaagtttagagggaaaaaatggcagtgtccacagtgtacacagccaaatctctcaactcaacatgttcaatctcaacacccacaaaaacccatttgggaattcagcagagacaagtgttgttttatactaaaaagaccaataggggcagggtgaggggtggtgagataagatgcgcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccaccacagtcatatgtttggatgattaccattcattggatagaacagggaggaaagttgaaggggtgacagcacttgatccaagagccaataactttgatcttatgtatgagcaagttaaggctttgaaagatggtattgctgttgaaaagcccatttataaccatgttagtggtcttttggaccctcctgagaccatcaagccacctaagatccttgtcattgaaggtttgcacccaatgtatgatcagagagtaagagacctcttggatttcagcatctacttggacatcagcaatgatgttaaatttgcctggaaaattcagagggacatggcagaaagaggacacagccttgaaagtatcaaagctagtattgaggccagaaagccagattttgatgcttatatcgacccacaaaagcaatatgcagatgccgttatagaagtgttgcctacacagctcattccaggtgacaatgaggggaaggtgttgagagtcaagctgataatgaaagagggagtgaaatacttcagccctgtttacttgtttgatgaaggctccaccatctcatgggttccatgtgggaggaaactcacctgttcttaccctggtatcaaatttgcctatggccctgatacttactacggtcatgaggtctctgtgttggagatggatgggcaatttgacagactggatgagcttatctatgttgagagccatttgagcaacatttccaccaaattctatggagaaatcacccagcaaatgttgaagcattcagatttccctggtagcaacaatggcactggtctcttccaaaccattgttggtttgaaaatcagagatctctttgaacaaatcacagccagcaaggcctcagctacattggaagctacaaaagcttaaactgaagaaacataaagaagccctttgaaatttctttcctctacaaccctttttttcatgtaaaattctgagtgttaggcttttatcacgagtctctcccatatgtatttagttgtatttatctattctatggatatctgtattatagggttcaagttcttaaa

SEQ ID NO: 1287 - DNA, 1516 bp, Flaveria ramosissima
gggagtgacacatttaaaaacctattttctcattctctctctctcttaacattcttcacaaagtttagagggaaaaaatggcagtgtccacagtgtacacagcccaatctctcaactcaacatgttcaatctcaacacccacaaaaacccatttgggaattcaacaaagacaagtgttgttctatagtaaaaagaccaataggggcagggtgagaggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccaccacagtcatatgtttggatgattaccattcattggatagaacagggaggaaggtggaaggggtgacagcacttgatccaagagccaataactttgatcttatgtatgagcaagttaaggctttgaaagatggtattgctgtcgaaaagcccatttataaccatgttagtggtcttttggaccctcccgagaccatcaagccacctaagatccttgtcattgaaggtttgcacccaatgtatgatcagagagtaagagacctcttggatttcagcatctacttggacatcagcaatgatgttaaatttgcctggaaaattcagagggacatggcagaaagaggacacagccttgaaagtatcaaagctagtattgaggccagaaagccagattttgatgcttatattgacccacaaaagcaatatgctgatgctgttatagaagtgttgcctacacagctcattccagatgacaatgaggggaaggtgttgagagtcaagctgataatgaaagagggagtgaaatacttcagccctgtttacttgtttgatgaaggctccaccatctcatgggtcccatgtgggaggaaactcacctgttcttaccctggtatcaaatttgcctatggtcctgatacttactatggtcatgaggtctctgtgttggagatggatgggcaatttgacagactagatgagcttatctacgtagagagccatttgagcaacatttccaccaaattctatggagaaatcacccagcagatgttgaagcattctgacttccctggtagcaacaatggcactggtctcttccaaaccattgttggtttgaaaatcagagatctctttgaacaaatcacagccagcaaggcctcatctaaattggaagctacaaaagcttaaactgaagaaacaaaagaaacccttagaaatttactttccttctacaaccctttttttcatgtaaaattctgagtgttaggcttttatcatgagtctctcccatatgtatttagttgtatttatctattctatggaaatctgtattatagggattcaagatcttaaagtaaatacttgacaagataaaagaataacctcatatctagtaatatagactacaaatattacta

SEQ ID NO: 1288 - DNA, 1319 bp, Ambrosia trifida
gatttaaaattggcttgttaccactttctaagctacctcttctttcattctgtatctcacataaactatcacttactcattaaaaagctatctatcattctatttctctctaaaagtttataaaatttagagagaaataatggcagtgtctacagtgtacacagtccaatctctcaactcaacatgttcaatctcaacaccaacaaaagcccatttaggaagtcatcaaagacaagtgttgttctatagtaaaaggaccaataagggcagggtgagaggtggtgagataagatgtgcaggggacacaatcgtaattgggctagcggcagactccggatgtgggaagagtactttcatgaggaggttgactagtgtgtttggaggtgcggcagagccacccaagggcggcaaccctgattcaaacacactcataagtgacacgacgacggttatatgtttagatgattaccattcgttggatagaacagggaggaaggtggaaggtgtgactgcgcttgatccgagagccaataactttgatcttatgtatgaacaggttaaggctttgaaagacggtattgctgtagataagccgatttataaccatgttagtggtcttttggaccctcctgagctcatcaagccacctaagatccttgtcattgaaggtttgcacccaatgtatgatgaaagagtaagagacctcttggacttcagtatctacttggacatcagcaacgatgttaaatttgcatggaaaattcagagagacatggcagagagaggacacagccttgaaagtatcaaagctagtattgaggccagaaagccagattttgatgcttatattgacccacaaaagcaatacgcagatgcggttattgaagtgttgcctacacagctgattccagatgacaatgaggggaaggtgttgagagtgaagttgataatgaaagagggagtgaaatacttcagcccggtttacttgtttgatgaaggttccactatctcatggattccttgtgggaggaagctcacttgttctttcccgggtatcaagttcgcctatggcccggatagttactacggtcaagaggtttctgtgttggagatggatggtcaatttgacaaactggatgagctcatctatgttgaaagccatttgagcaacatctccaccaaattctatggagaaattacccaacaaatgttgaagcatgccgacttcccgggcagcaacaacggaaccggtctcttccaaaccattgtcggtttgaagatcagagatctctttgaacaaatcacagccagcaaagcct

SEQ ID NO: 1289 - DNA, 1878 bp, Sesamum indicum
gtaatatgttaaaatgacaaaaatacccttagagaggtgagaaatgccaaccaagtctccttctttgtcaccttaaaatcacctccaaatttgtctaacgcaaagggtagtcagagaaacccataaacagtgacacatcacattaccctcggcctctcccatccaagaactccccttctttcatcttagtatcctttcctcacactttctttcatttgtgtccctataaagaaaacaacacagcccatttttcatgtctctaaacccatttcacaactcagagtaacacactagagaaacacctccaagcaagacagagagaggagaagagaaaaagcatggcagtttctactgtctacacagttcaaattcaatccctcaactcaatctccacaccatcaaaatcccacttgggattcaaccaacttctctacagctctggcaagaaaaccaggagggctactcacatatcatgctcagctgataatgacaagactgtggtgatcggcctggctgcggactccggatgtgggaagagcaccttcatgcgacgcctgaccagcgtcttcggcggtgcagcagagccaccaaagggcggcaaccctgactccaacaccctcatcagtgatatgactactgtcatatgtttggatgattatcactcactcgacagaaatggaaggaaagagaagggagtcacagcacttgaccccaaagccaatgactttgatctcatgtatgagcaggttaaggctgtcaaagaaggaattgctgtggataagcctatttacaatcatgtcactggcttgatagatcctcccgagttgatcaaacctcccaagattttcgtcatcgaaggtttacacccaatgtatgatgcacgtgttagagaactcttggacttcagtatttacctggacatcagccctgaagttaaattcgcatggaaaattcagagggacatggctgaaagagggcacagtcttgagagcatcaaagctagtattgaagcccggaaaccagattttgacgcttacattgatccgcagaagcaatatgctgatgcagtgatagaagtgttgcctacccaactcatcccagatgatgaggggaaggttttgagagtgagattgataatgaaagaaggcgtgaagtacttcaatccagtgtacctgtttgatgaaggctccaccatctcatgggtaccctgtggcaggaagttgacttgctcttaccccggcatcaaatttgcctatggtcctgagacttactttggccatgaggtctcagttttggagatggacggacaatttgacagactagacgagctcatttatgttgaaagccacctgagcaacatttccaccaagttctacggtgaagtcacccaacaaatgttgaagcatgcagattttccaggcagcaacaatggaacagggctcttccaaacaatcgtcggcttgaagatcagagacctttacgagcagattgtcgcaagcaaggttgctgctccattggaagccacaaaggcctaagaaatgcctaaaactattgagataggcaccagccctctaatttttctgtatgttgtatgagttgagtgagggtaatcctcataaaaattgagatattctccgttgtgtatctatttttcagttggctctctggagacctgtaacatagagaaacgaaagcacatatgaaatggagacatgtataaaacatatttcagtgatcaaagaagctccggtagtcaaacagaagatcggagcaggctaaagtagtgccagtaacaaaaagaatatatttttgtatgaagcaccagtagaaagatttaggcataaaaggaatccaaaagtggttgatttcaagattcac

SEQ ID NO: 1290 - DNA, 1451 bp, Zostera marina
ggggataaaaaagaagggagaagaacacttacttctagttccaaaccaacattttctcttcttcctcaaagagctagaaggaagcttggtggccagaagagaaaaaatggcagtctgcacagtctactctcctcattctctcaaatccacatgcccaattccaaatacatcaagaatccaattgggttctcatcagaagcaagttattttcttcacaaggagaaaaggcggcaactacagaagcaataagttatccggtaccatcacctgtgaagcaaacacaattgttatcggtcttgcagcagattcaggatgtggaaagagcacattcatgaggagacttactagtgtatttggtggagcagcatcacctcccaagggtgggaatccagactcaaacacgcttatcagtgacacgacaactgtgatatgtcttgatgactaccactctctcgatagatatggaagaaaggagcagggtgttactgcacttgatccaaaagccaacaactttgatctcatgtatgaacaagttaaggcacttaaacaaggtattgctgtggagaaaccaatttataatcatgttactggaattctcgattctcctgagctcattcaacctcccaagatcctggttattgaaggactgcacccaatgtacgattctcgtgtccgtgatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaagggaaggtgttgagagttaagctggtgatgaaggaaggagtgaaatatttcagtccctcgtacctctttgatgaaggatcaaccatcgattggatcccatgtggaagaaaattgacttgttcatatccaggaattaagttctcttatggtccagacagttactactcaaacgaggtatctgtgttggagatggatgggcaattcgacaaattagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattgcagaaaagaaaggcagttcactgcaagcagccaaaatgtagaaaatgttcttttaccaatctaattttttccctctcttcttatttacttatgttgttccagtaaatacccaaactggtaaaaatgagattaccagtatataaatatacagacttatgattgtgaatt

SEQ ID NO: 1291 - DNA, 1410 bp, Zostera marina
ataaaagaagggagaagaacacttacttctagttccaaaccaacattttctcttcttcctcaaagagctagaaggaagcttggtggccagaagagaaaaaatggcagtctgcacagtctactctcctcattctctcaaatccacatgcccaattccaaatacatcaagaatccaattgggttctcatcagaagcaagttattttcttcacaaggagaaaaggcggcaactacagaagcaataagttatccggtaccatcacctgtgaagcaaacacaattgttatcggtcttgcagcagattcaggatgtggaaagagcacattcatgaggagacttactagtgtatttggtggagcagcatcacctcccaagggtgggaatccagactcaaacacgcttatcagtgacacgacaactgtgatatgtcttgatgactaccactctctcgatagatatggaagaaaggagcagggtgttactgcacttgatccaaaagccaacaactttgatctcatgtatgaacaagttaaggcacttaaacaaggtattgctgtggagaaaccaatttataatcatgttactggaattctcgatcctcctgagctcattcaacctcccaagatcctggttattgaaggactgcacccaatgtacgattctcgtgtccgtaatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaagggaaggtgttgagagttaagctggtgatgaaggaaggagtgaaatatttcagtccctcgtacctctttgatgaaggatcaaccatcgattggatcccatgtggaagaaaattgacttgttcatatccaggaattaagttctcttatggtccagacagttactactcaaacgaggtatctgtgttggagatggatgggcaattcgacaaattagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattgcagaaaagaaaggcagttcactgcaagcagccaaaatgtagaaaatgttcttttaccaatctaatttttcctctcttcttatttacttatgttgttccagtaaatacccaaactggtaaaaatgagattacca

SEQ ID NO: 1292 - DNA, 1428 bp, Ambrosia trifida
ttataaagttccaacctttttccctctttctctctctaaaacctttagaaacaagagagagaagcaatggcagtgtgcacagtctatacagtccaacctctcaacacatcatgctcaatctcaacacacacaaaaccccacatgggattcaaccaaaagcaagtctttttcttaaccaaaagtaataataaaaacagcaaaaacaacaggtttagaggcaacaaaatcacatgctcaggtgacacaatagttataggactagcagcagattcaggatgtggaaaaagcaccttcatgagaaggttaaccagtgtgtttggtggtgcagcttcaccaccaaagggtggtaaccctgactcaaacacactcataagtgacacaaccacagtcatatgtttagatgattatcattcattggatagaactggaaggaaagaaaagggtgtcactgcacttgatcctagagccaatgactttgatcttatgtatgaacaagttaaagctattaaagatggtgtggctgttgaaaagcctatttataaccatgtttctggtcttttggaccctcctgagctcattaaaccacccaagattcttgttattgaaggtttgcacccaatgtacgatcagagagtaagagacctcctggacttcagtatttacttggacatcagtaacgaggttaaattcgcatggaaaattcagagagacatggcagagagaggacacagtcttgaaagcattaaggctagcattgaggctagaaaaccagattttgatgcctatattgacccacaaaagcaatatgcagatgcagttatcgaagtgttgcccactcagctgatcccggatgacaacgagggaaaagtgttgagagtgaagctaatcatgaaagaaggcgttaaatacttcaacccggtttacttattcgatgaaggttccactgtttcatggatcccatgtggaagaaagctcacttgctcctatcctggcatcaaatttgcctatggtccagacgcttatttcggccatgaggtttctgtgctggagatggatggacagtttgacagattagatgaactcatctacgtcgaaagccatttgagcaacatttcaaccaaattttacggtgaaatcacccaacaaatgttgaaacatgctgacttccctggtagcaacaacggcactggtttgtttcaaaccatcgttgggttaaagatccgagatttgtttgaacaaatcgcagccagtaaggcctcggctccacttgaagctaacaaaagcttgatttttaatcaagaggttactatgagtgttgtgatcccatatgcatgtattcaattccctttgtgtattccatggacatatgtaacataaatatatatataagttcataaatgaaatcctacataggatcaaaaataagat

SEQ ID NO: 1293 - DNA, 1643 bp, Primula obconica
acctctcatttccttcaaccttctcctctcacaaccaaaagaaaaaatgaataaataataaatataacaaaaaaaccaaagccaaggactagaaaaatacacattcttgattcttccctctctctcaaaatccagagagagagagaccaagaaaaatggcaatctccactgcttgctcaactcactactccctcaactcaacatactcaatctcaacacccacaaaaacccacctaggttcaacccaaacaagtacttttctacaccacaaccaagaaaaacaccacaaaacatacaaacacaacaacaatatcatgctctcaaaaaacagtagttatcggcttagccgcagactcgggatgtggaaaaagcactttcatgaggagattaacaagcgtttttggtggggccgctgagccacctaaggggggtaaccccgattctaacacgcttataagcgatacgacgactgttatatgtttagatgattatcattcacttgataggacaggtagaaaagtggaaaaggtcactgcacttcacccaaaggcaaatgactttgatctaatgtatgagcaagtgaaggctattaaggatggtgtggctgtggataagcctatttataaccatgttagtgggttattagaccctcctgagcttattaagcctcctaagatccttgtcattgaagggctgcacccaatgtatgatgaacgtgttagggaccttttggacttcagcatctacttggatattagcaatgaggtcaaatttgcatggaagattcagagggacatggcagaaagagggcacagccttgaaagcatcaaagctagtattgaagcaaggaaaccagattttgatgcttacattgacccgcagaagcaatatgccgatgcagtgatagaggtgttgcctacgcaattgataccagatgacaatgagggaaaagtgttgagagtgaggcttataatgaaagaaggggttaaatttttcaacccagtgtatctctttgacgaaggctccaccattaactggataccttgtgggagaaaactcacttgctcataccccggtatcaagttctcatatggccccgagagctactacggccatgaggtgtcagttgtcgagatggatgggcaattcgacagattagatgagctaatctacgttgagagccacctcagcaatatctcaaccaagttctatggagaaatcacccaacaaatgctaaagcactcagatttcccaggtagtagcaatggcactggtcttttccagaccattgttggcctaaagatcagagacctctacgaacaaatcatcgccagcagagcagcagctccactcgaagcgacaaaagcctaaaaagaagaacgagacttctatgttaataagccaaggcatgtacttacttcctattttttgtctcacgatatttgatgtttcggttgagtgctgggctgttaatcgaaaacaatgcgaaaactcaaacagtttgtatattagtggttgaatttgtggagactacttgtgaaatagaaaaccaaaagctgaaataatgcaattaagaaagaacaaggaacttgggaacctatcagcatgtgtaactgcatttgcagcttgaaatacattacttc

SEQ ID NO: 1294 - DNA, 1783 bp, Gossypium raimondii
gttccatatttttccttggaaatctaaaggagacaaagaggacaaactcatttttaagtggtctttttattgcccatgtaagcaccattttaacattctcttcctgtctaaaaagctctctaaattccctttcccgagctgaaagataaacaaggtgagcctaaaagagctgaagcaatggcagtttgctcagcatacaccacccagtccctcaattcaacgtgttcaatctccacaccagcgaaaacccatttaggttttcaccaaaagcaagtagttttctataggagaagcagcaagagaggtggcagcggcagcagcagcggcccatgcgtgataacatgctcggccggtgattcacaaactgttgtgattggtttggccgcagactcaggatgtgggaagagtaccttcatgaggaggctaacaagtgtgtttggtggtgcagccgagccaccgaagggaggcaaccctgattcaaacacgctcattagcgatatgaccactgtgatatgcttagatgattaccattcactcgacagaactggaaggaaagagaagggggtgacagcacttgacccaagagctaacgactttgacctcatgtatgagcaagttaaggctatcaagagcggtgttgctgtggacaagcctatctacaaccatgttactggtctcttagatcctcctgagctcatcaagcctcctaagatccttgtcatcgaaggactacaccctatgttcgatgagcgtgtgagggatctgttggacttcagcatctatttggacatcagcaatgaggtcaaatttgcatggaaaattcagagggacatggctgagagagggcacagccttgaaagcattaaagctagtattgaagccaggaaacccgatttcgatgcctatattgatccccaaaagaaatatgctgatgcagtgatcgaagtgctgccaactcagctcattccagacgacaatgaagggaaggttttgagagttaggttgataatgaaagaaggggttaagcatttcagtcctgtttacctgtttgatgaaggctcaaccatctcatggataccatgcggaaggaagctcacttgctcttaccctggcatcaaattccactatggccctgacacttactttggcaacgaggtttctattctggagatggacggccaatttgatagattagatgaacttatttatgttgaaagccatttgagcaacatctccaccaagttctatggagaagtcacccagcaaatgttgaagcatgcggatttcccaggaagtaacaacggaactggcctcttccaaaccattgtcgggttgaagataagagatctctatgagcaaattacttccagcaaaactgcagctccactagaagcaacaaaagcctaagactattagagtttcttcatacattggactagaccttgggtccataacaaattatcctctttccagctttcctctatcgaaggtttatttgagtgttaggctgttgttgctttcataagagtcgagtatgatcctgtgcatttattttatgtttgtaattcagtggagatatgtaatatagagaaacaaaatcagagttcaatttcaacattgagaagttcatataagacaaagcctttcgacatcatctctccacttctatttccccatattgctgcttcttgttgtaagttgtaaccatttatgatgtcatgatctttggtttttttactccaaataaagaggatttggctatggaagcgtggccataatgtga

SEQ ID NO: 1295 - DNA, 1458 bp, Flaveria ramosissima
cacaaaaactaatacacttaaaaaagaaaaatagaccaaaaacccaatagccagtgacacatttaaaaacctattttctcattctctctctctcttaacattcttcacaaagtttagagggaaaaaatggcagtgtccacagtgtacacagcccaatctctcaactcaacatgttcaatctcaacacccacaaaaacccatttgggaattcaacaaagacaagtgttgttctatagtaaaaagaccaataggggcagggtgagaggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccaccacagtcatatgtttggatgattaccattcattggatagaacagggaggaaggtggaaggggtgacagcacttgatccaagagccaataactttgatcttatgtatgagcaagttaaggctttgaaagatggtattgctgtcgaaaagcccatttataaccatgttagtggtcttttggaccctcccgagaccatcaagccacctaagatccttgtcattgaaggtttgcacccaatgtatgatcagagagtaagagacctcttggatttcagcatctacttggacatcagcaatgatgttaaatttgcctggaaaattcagagggacatggcagaaagaggacacagccttgaaagtatcaaagctagtattgaggccagaaagccagattttgatgcttatattgacccacaaaagcaatatgctgatgctgttatagaagtgttgcctacacagctcattccagatgacaatgaggggaaggtgttgagagtcaagctgataatgaaagagggagtgaaatacttcagccctgtttacttgtttgatgaaggctccaccatctcatgggtcccatgtgggaggaaactcacctgttcttaccctggtatcaaatttgcctatggtcctgatacttactatggtcatgaggtctctgtgttggagatggatgggcaatttgacagactagatgagcttatctacgtagagagccatttgagcaacatttccaccaaattctatggagaaatcacccagcagatgttgaagcattctgacttccctggtagcaacaatggcactggtctcttccaaccattgttggtttgaaaatcagagatctctttgaacaaatcacagccagcaaggcctcatctaaattggaagctacaaaagcttaaactgaagaaacaaaagaaaccccttagaatttactttcctctacaaccttttttcatgtaaaattctgagtgttaggcttttatctatgagtctctcccatatgtatttagttgtatttattct

SEQ ID NO: 1296 - DNA, 1568 bp, Castanea mollissima
ccatcttctaaaaccaaaactgccttctgctttcattaaaaccttttacccctcttattttgtgttccaaattctccgtataaattcaagaggacaagaagccaaacttatttcatgtctactactactcaaaacaccaactaaatagaaccatagctcttgctctctcagagcactctgtgaattccttttctgtgtagagagacagagagaatggcaatttgcacagtctacaccaccccatctctcaattccacatgctcaatctccaccacatcaaaaacccaattgggatttcaccaaaaacaggtagttttctattctagtggcaagaaaactagcaagagaggcagcaacacaaccagcccatatgtgataacatgctcaacaacagtaggtgattcaaagacagttgtgataggcctggcagcagactcaggatgtgggaaaagtaccttcatgaggaggctgaccagtgtgtttggtggggctgcagagccaccaaaggggggtaacccagactccaacacactcatcagtgacactaccactgtgatatgcttggatgactatcactctctggataggactggaaggaaacagaagggtgtcactgcacttgaccctagagccaacgactttgatctcatgtatgaacaagttaaggctatcaaggatgggattcctgttgagaagcctatttacaatcatgttactggtctcttggatcctcctgagctcatcaagccccctaagattcttgtcattgaaggtttgcacccaatgttcgattcacgagtaagggacctgttggacttcagtatctacttggacatcagcaatgaggttaagtttgcatggaaaattcagagggacatggctgaacgtggacacagtcttgaaagcatcaaagctagtattgaagccaggaagcctgattttgacgcatatatcgatccacaaaagcaatatgcagatgcagtgatagaagtgttgccaacccaattgattccggatgataacgaggggaagatattgagagtgaggttgataatgaaagaaggggtcgagtttttcaacccagtttacctgtttgacgaaggctctactgtctcatggataccatgcggaagaaagcttacatgctcataccctggcatcaagttttactatggccctgacacttatttcggccacgaggtgtctgtgctggagatggatggtcaatttgaccgattagatgagctgatatacgtggaaagccatctaagcaacatatctaccaagttctatggagaagtgacccaacaaatgttgaagcatgctgatttccctggcagtagcaatggaactggtcttttccaaaccattgttggtttgaagataagagacctgtacgagcaactcatctccaccaaggctaaaactcctgtagaagcaacaaaggcctaattaagaagcaccatcatgcctagccagtagccaacccttgccttgccctgccttgcctgcacggacaaattaaacccccaccaacaatttaattaagtctctctctctctctctct

SEQ ID NO: 1297 - DNA, 1243 bp, Flaveria ramosissima
aaagcaagtcttttcttactccaatggtagtaaaagaactaaaagccaagaggtatagaacaggtggtgaaatcacatgctcaggggacacaatagtcataggacttgcagcagactcagggtgtggtaaaagcaccttcatgaggaggttaaccagtgtgtttggtggtgcagcctctccaccaaagggtgggaaccctgactcaaacacactcataagtgacaccacaactgtcatatgtttagatgactatcattcattagatcgcacaggaagaaaagaaaagggtgtgactgcacttgacccacgagccaatgactttgatctgatgtatgaacaggttaaggcgcttaaagatggtgtggctgttgagaagcccatttataaccatgtttcggggcttttggaccctcctgaactcattaaaccacccaagattcttgttattgaaggtctgcacccaatgtatgatcagagagtaagagacctcctggacttcagtatttacttggacatcagtaacgaggttaaattcgcatggaaaatccagagagatatggcggagagaggacacagtcttgaaagcattaaagctagcattgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccatttgagcaacatttcgacgaaattctatggtgaaatcacccaacagatgttgaaacatgctgatttcccaggtagcaataatggtactggtttgtttcaaaccattgtcgggttgaagatccgagatttgttcgaacaaattgcggccaataagggatcagctccacttgaagctacaaaagcttgatcataaatgaagagttattatgagttgatgttgttatcacatatgtatttaggtagttccatttgtgtattatgtggagatatgtaatgtaagtataccaattcataaat

SEQ ID NO: 1298 - DNA, 1299 bp, Flaveria ramosissima
atctcataaaactatcacttgggagaactgaccataaacccaattccagtgacacattaaaaggctattttctcattctctctttaaaacttgaataagttgagagagagagagaatggcagtgtgcacagtgtacacagtgcaatctctgaactcaacatgttcaatctcaacaccaacaaaacccatttgggaattcagcaaagacaagttttgttctatagtaaaaagaccaataggggcagggtgagaggtggtgagataagatgctcaggggacacaatagtaattggactagcagcagactcagggtgtgggaaaagtaccttcatgaggaggttgactagtgtgtttggaggggcagcagagccaccaaagggaggcaatcctgattcaaacacactcattagtgacaccacaacagttatatgtttagatgattaccattcattggatagaacaggtaggaaagtggaaggggtgaccgcgcttgatccgagagccaataactttgatcttatgtatgagcaggtcaaggctttaaaagatggtattgctgtagagaagcctatttataaccatgttactggtcttttggaccctcctgagctcatcaagccacccaagatccttgtcattgaaggtttgcacccaatgtttgatcagagagtaagagacctcttggacttcagtatctacctggacatcagcaacgatgttaaatttgcctggaaaattcagagggacatggcagagagaggacacagccttgaaagtatcaaagctagtattgaggccagaaagcctgattttgatgcctatattgacccacaaaagcaatatgcagatgcggttatagaagttttgcctacacagctgattccagacgacaatgaggggaaggtgttgagagtgaagttgataatgaaagagggagtgaaatatttcagcccagtttatttgtttgatgaaggttccaccatttcatggattccctgtgggaggaagctcacttgttcttacccgggtatcaaattcgcctatggccctgatacttactacggtcatgaggtgtctgtgttggagatggatgggcaatttgacaaactggatgagctcatctatgttgagagccatttaagtaacatctccaccaaattctatggagaaattacccaacaaatgttgaagcatgccgacttcccaggtagtaacaatggcaccggtctcttccaaaccattgttggtttgaaaattagagatctctttgaacaaatcacagccagcaaggcctcagct

SEQ ID NO: 1299 - DNA, 1538 bp, Mesembryanthemum crystallinum
caatcccaactgatcaaaaatcccaaatacccacctcccattcctctctcattcctccccattctctctcctcccctgttttaaaacagagagaggtagagtaaacagaggagctaaaacaggggaaaacagagcatacagaaaacaatggcagtatcagcatacacagttcccaccacatcccacttgggattcaaccaaaaaaagcaactattcttctgcaacaagagtgcatacaagagggtgagtttcagcagcagaccatgtgtgataacatgcttagcaggtgactcacagacaattgtgattggtctagcagcagactcagggtgtggtaagagtaccttcatgaggaggttaacaagtgtatttggaggtgcagcagagccaccaaggggaggaaaccctgattcaaataccttaattagtgacacaaccactgtgatttgtttggatgattaccattcccttgataggacagggaggaaagagaaaggagttactgctttggatccaagagccaatgattttgacctcatgtatgagcaagttaaggctttgaaagaaggtaaggctgttgagaagcctatttacaaccatgttactggcttgttggatgcacctgagctcatcaagccacctaagatcttggtcattgaaggtttgcaccctatgtttgactcacgtgtgagggacttgctggacttcagtatctatttggacatcagcaatgaagtgaaatttgcctggaaaattcagagagacatggctgagagaggacacagtcttgagagcatcaaagccagtattgaagccagaaagcctgactttgatgcttacattgatccacagaagcagtatgcagatgcagtgattgaggtgttgccaacccagctcatccctggtgacaatgaaggcaaagtgttgagagtgaggttgattcagaaggaaggggtgcaatatttcagcccagtttacttgtttgatgaaggatcttctattacctggatcccttgtggcagaaaattgacatgttcttaccctggtatcaaatttttctacggccccgacacttacttcggcaatgaggtgactgtgctagagatggatgggcaatttgacagattagatgaattgatctacgttgaaagccatttgagcaacctatcaaccaagttctatggtgaagtcacccaacaaatgttgaagcaccaagacttccctggaagcaacaacggaaccggtctcttccaaaccattgttgggttgaagatcagagacctgttcgagcagcttatcgccagcaagacagcagctcctgcagcagctactaaggcctgaagctccatttgataaataaaaagcatctgaatctcattttttctccactactttcctcatttgtaacttctattaccatttctcctctataagtcggttatgtacttatgttaggctactctgaaattctataattatatagatatgcacaaaagcagagataaaaaatgcagttcaaaaaaattcatagcttctga

SEQ ID NO: 1300 - DNA, 1408 bp, Tripterygium wilfordii
agagagagagagagagagaatggcagtctgcacagtctacacaacccaatctctcaactcaacatgctcaatctccacaccaacaaaaccacttggtttcaccaaacagttgtgttctatagtacttctggtaagagaagcagcaagagaggtggtagtaccactactgtgataacctgctcagtaggtgactcacagacagttgtgattggtctggcagcagactctggatgtgggaagagtactttcatgaggaggctaactagtgtttttggaggagcagtagagccacccagaggaggaaatccaggctcaaacacactgataagtgacacaactactgtgatatgcttggatgattatcactctcttgatagaactggaaggaaagagaagggagtgactgctcttgacccaagagccaataactttgatctcatgtatgaacaggttaaggcaatcaaggatggaattgctgttgagaaaccaatctataatcatgtaactggtcttcttgaccctcctgagctcatcaagcctcccaagatatttgtcattgaaggacttcaccctttgtatgatgagagagtaagggacctgttggactttagtatttacttggacatcagtaatgaagttaagtttgcatggaaaattcagagggatatggccgagagagggcacagtcttgaaagcattaaagctagtattgaagcaagaaagccagactttgatgcttatattgatccgcagaagcaatatgcagatgctgtgattgaagtactcccaaccctactcatcccggacgacaatgaggggaaggtgttgagagtgaggttgataatgaaggaaggagtgaagtacttcaaccctgtttacttgtttgatgaaggctccactatttcatggataccctgtggaaggaaactgacctgctcttatcctggcatcaagttctcctatggccccgatacttacttcggccacgaggtgtctgtaatggagatggatgggcaatttgacagattagatgagctaatctatgtagagagccatttgagcagcatttccaccaagttttatggagaagtcactcaacaaatgttgaagcatgctgatttccctggtagtaacaatggaactggtctcttccaaactataattggattgaaaataagagaactctacgaacagcttgtcaccagcaaggtccgagccccagtagaagccaaagcctaaacacaagcataaacacaaaagcacttcctcttattcagtctttttttgccttttccagtggctatttaggctgctggttaaaatgagaaacactctatgtacctatttcatgttgtaattgtgttgggagttagtaatatagagaagaaataacagatggaattgagtt

SEQ ID NO: 1301 - DNA, 1900 bp, Hordeum vulgare
tgtccagggaaagaatacagacaaaatactattgtttggaattgtaggaagaactcattttcagatcactataagctgcccctgatatcaccagaaaagaaaaggaaaaaaagaaggaaaataggggtaccacatcatcaccatctcatttccctccttatgttttcttagctcttatctccacagttctttcatcaagctctctcttctcctcaagcctcagttacaaggcttgaaggggagaagagcagctccaagaggttgggcagcaaacatggcattctgcagcccacacaccaccacatccctgcgctccccatgcaccaccatcccaaactcaggcttcaggcagaaccaagtcatcctcttcacaaccagaagcagcaggaggagtaccacgaggcatggagcaaggaccttccaggtctcatgcgcagttgagaagccaatagtgattggcctggcagcagactcgggatgtgggaaatccaccttcatgcgccggctcaccagcgtgtttggaggtgctgcagagccacccaagggcggcaacccagactcgaacacgctcatcagcgacacgacgacggtcatatgccttgatgactaccattccttggacagaaccgggaggaaggagaaaggtgtgactgccctggaccccaaggcaaacgactttgatctcatgtatgagcaagtgaaggcaatcaaagaaggcaaggctattgagaagccaatctacaaccacgtcactggcctcctcgacccggcggagctcatccagccccccaagatcttcgtcatcgagggtttgcacccaatgtatgacgaacgtgtgagagacctccttgacttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcgttaagttcttcaacccggtttacctcttcgatgaaggatcaaccatcaactggatcccttgtggaagaaagcttacatgctcttaccctggcatcaaattttcctatggcccagacacttacttcggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccaaactatcgtaggactgaagattagagatctctatgaacagatcattgctgagagggccggcgttcctgctgaagcagcaaaagtttgatgagccccaaattcaagttcatgaatcatttcatcaccaactcaatgagaatgagcatcctcacgtttcttgtgactagtttgaatatattacagctagaagacggtagaaagttcactgcagaactcatgaaaacctgcattttgaacttctcgaaaatcctctccatgatgagagtctcttatgtctcctcttaacacatttcaatgtacatcttctcccatgtttcaatgcagaaaatacatgtgcttgctagaatcaaaagcggttgcttttatctagcgtgtcctttttttggctgttactgctgatcacgactaacattcataaaaggccatttaagaaatctgaaaaaatggaggtggatttgtagagaattgtgaaaaattatgaggacatttggatattcgg

SEQ ID NO: 1302 - DNA, 1723 bp, Phaseolus vulgaris
acttcaaagcttgtccaagacaaggggtagtcacagaaactcaaacaggaagatacctttttttttgttttcctgcttaactgccttttgttttggttttagttccacctcatattttatatgtgttccaaacttcttcttggaatgtaacttccttaataacccttgaacaaaggccacttcaacatctcttccctgaaaattctctagagggagagagaatggcagcttgcactgtgtactcaacacaatctctgagcacaaattgctccatctcaaccccatcaaaaacacaattcagttttcaccaaaagcaggtagtattctacaccacaggcagaaggaacagcaagaggggcagcaacagtggcagaagctatgtgataacatgtgcagcaagtgaccaacagacagtggtgataggtctggcagctgactcagggtgtggaaagagtaccttcatgaggaggctgaccagtgtgtttggaggagcagcagaaccaccaaagggtgggaaccctgattccaacactctcatcagtgacaccaccacagtcatatgcttggatgattaccactcattggatagaactggcagaaaggagaagggagtcactgcccttgacccaagagccaacgattttgatctcatgtatgagcaagttaaagcaatcaaggatggaatttctgttgaaaagccaatctacaaccatgtcactggtctcttggatccccctgaactcattaaacctcccaaaatcttagtcattgaaggtttgcacccaatgtttgattcccgtgtcagagacctcttggactttagcatctacctagacattagcaatgaggtgaaattcgcttggaaaattcagagagacatggcagagcgtggacatagtcttgaaagcatcaaggctagcattgaagcaagaaagcctgattttgaagcatacattgatccacaaaagcaatatgcagatgctgtgatagaagtgttgccaactcaacttattccagatgacaatgagggtaagattctaagagtgaggttgatacagaaagagggagttaagaacttcagtccagtctacttgtttgatgatggctctaccatttcatggataccatgtggaaggaagcttacatgctcctaccctggcatcaaattctcctatggaccagacacttactacggaaatgaggtgtcaattgtagaaatggatggacaatttgacagattagatgaactaatatatgttgagagtcacctaagcaacctctctaccaagttctatggagaggttactcaacagatgttgaagcatgctgatttccccggcagcaacaatgggacaggtctcttccaaaccattgttggtttgaagataagagatctatatgaacagataatagccagcagggctgagactccagtagctgcaaaagcttaggaactgaacctgccatatataacatattgagcaaggcagccattgagttccaaaagtctttttcttcttcatgctttccacaattccactgtatttcatcttattttgtcttctgttaggctgttctgcatgatgataatgaaaacactgtatgtatctatgtatgtacttatccgagaagaaaaaaggaggctgagattaattcagttgtgttgatacaatatattcgctggcattatgacatatataataaccatgaattttttttctta

SEQ ID NO: 1303 - DNA, 1571 bp, Phaseolus vulgaris
tccttaataacccttgaacaaaggccacttcaacatctcttccctgaaaattctctagagggagagagaatggcagcttgcactgtgtactcaacacaatctctgagcacaaattgctccatctcaaccccatcaaaaacacaattcagttttcaccaaaagcaggtagtattctacaccacaggcagaaggaacagcaagaggggcagcaacagtggcagaagctatgtgataacatgtgcagcaagtgaccaacagacagtggtgataggtctggcagctgactcagggtgtggaaagagtaccttcatgaggaggctgaccagtgtgtttggaggagcagcagaaccaccaaagggtgggaaccctgattccaacactctcatcagtgacaccaccacagtcatatgcttggatgattaccactcattggatagaactggcagaaaggagaagggagtcactgcccttgacccaagagccaacgattttgatctcatgtatgagcaagttaaagcaatcaaggatggaatttctgttgaaaagccaatctacaaccatgtcactggtctcttggatccccctgaactcattaaacctcccaaaatcttagtcattgaaggtttgcacccaatgtttgattcccgtgtcagagacctcttggactttagcatctacctagacattagcaatgaggtgaaattcgcttggaaaattcagagagacatggcagagcgtggacatagtcttgaaagcatcaaggctagcattgaagcaagaaagcctgattttgaagcatacattgatccacaaaagcaatatgcagatgctgtgatagaagtgttgccaactcaacttattccagatgacaatgagggtaagattctaagagtgaggttgatacagaaagagggagttaagaacttcagtccagtctacttgtttgatgatggctctaccatttcatggataccatgtggaaggaagcttacatgctcctaccctggcatcaaattctcctatggaccagacacttactacggaaatgaggtgtcaattgtagaaatggatggacaatttgacagattagatgaactaatatatgttgagagtcacctaagcaacctctctaccaagttctatggagaggttactcaacagatgttgaagcatgctgatttccccggcagcaacaatgggacaggtctcttccaaaccatagttggtttgaagataagagatctatatgaacagataatagccagcagggctgagactccagtagctgcaaaagcttaggaactgaacctgccatatatacacatattgagcaaggcagccattgagttccaaaagtctttttcttcttcatgctttccacaattccactgtatttcatcttattttgtcttctgttaggctgttctgcatgatgataatgaaaacactgtatgtatctatgtatgtacttatccgagaagaaaaaaggaggctgagattaattcagttgtgttgatacaatatattcgctggcattatgacatatataataaccatgaattttttttctt

SEQ ID NO: 1304 - DNA, 1686 bp, Vigna unguiculata
agttccacctcatattttatatgtgttccaaacttgttcttggaatgtaacttccttaataaccctccacttcaacatctcttctctgaaaattctctacagggggaaagagagcaaaaaaaaaaaagaaaaaaatggcagcttgcactgtgtactcaacacaatctctgagcacaaactgctccatctcaaccccatcaaaaacacagctgagttttcaccaaaagcaggtagtgttctacaccacaagcaggaggaacagcaagaggggcagcaacagtggcagaagctatgtgataacatgtgcagccagtgaccaacagacagtggtgattggtcttgctgctgattcaggttgtggaaaaagtaccttcatgaggaggctcaccagtgtgtttggaggagctgcagaacctccaaagggtggcaaccctgattccaacactctcatcagtgacaccaccactgttatatgcttggatgattaccactctttggatagaactggcagaaaggagaagggtgtcactgctcttgaccctagagccaatgattttgatctcatgtatgaacaagttaaagcaatcaaagatggaattgctgttcaaaaaccaatctacaaccatgtcactggtctcttggacccccctgagctcattaaacctcccaaaatcttagtcattgaaggtttgcacccaatgtttgattcccgcgtcagagacctcttggactttagcatctacctagacattagcaatgaggtgaaattcgcttggaaaattcagagagacatggcagagcgtggacacagtcttgaaagcatcaaggctagcattgaagcaagaaagcctgattttgaagcatacattgatccacaaaagcaatatgcagatgctgtgatagaagtgttgccaactcaactgattccagatgacaatgagggtaagattttaagagtgagattgatacagaaagagggagttaatttcttcagtccagtttacttgttcgatgagggctctaccatttcatggattccatgtggaaggaagcttacatgctcctaccctggcatcaaattctcctatggaccagacacttactacggaaatgaggtgtcagttgtagaaatggatggacaatttgacagattagatgaactaatatacgttgagagtcacctgagcaacctctctacgaagttctatggagaggttactcaacagatgttgaagcatgctgatttccccggcagcaacaatggcacaggtctcttccaaaccatcgttggtttgaagataagagatttatatgaacagatagtagccaccagggctgagactgcagtagctgcaaaagcttaggaaccatttatacaatcattttcttcttcatgctttccaccattccactctatttcatcttattttctctcctattaggctcttctgcatcatcataatggaaacactatatctatgtatctatgtatgtacttatccgagatgaaaaaaggaggctgagattgattcagttgtgttgatacaatatatatatatgtgctgtgctgccattgtgacatatacgaataaccatgaatcttctttcttatcatttgtgtgtgtggtttaaatcaagaggagtgaattatctataccagaataaatgttccctctttcaatgaat

SEQ ID NO: 1305 - DNA, 2119 bp, Gossypium raimondii
atcttttttcgtagctaaaaatatctacaacagttttacttttgccaaggaaaatgaaatttgtgaaatgactgtctacccacgtcaaatgagtcaaagccgttcatgtccctttccttcgcgccttattatcaccttcaaacttgtccaaaactaggggcagtcaatggaaatcacaaacaaaagacacctcagcttttccatcactaaagcactcagcagtcactgccatctgttttcttcaaccttttcttcttatttgtgttccatatttttccttggaaatctaaaggagacaaagaggacaaactcatttttaagtggtctttttattgcccatgtaagcaccattttaacattctctccctgtctaaaaagctctctaaattccctttcccgagctgaaagataaacaaggtgagcctaaaagagctgaagcaatggcagtttgctcagcatacaccacccagtccctcaattcaacgtgttcaatctccacaccagcgaaaacccatttaggttttcaccaaaagcaagtagttttctataggagaagcagcaagagaggtggcagcggcagcagcagcggcccatgcgtgataacatgctcggccggtgattcacaaacagttgtgattggtttggccgcagactcaggatgtgggaagagtacctttatgaggaggctaacaagtgtgtttggtggtgcagccgagccaccgaagggaggcaaccctgattcaaacacgctcattagcgatatgaccactgtgatatgcttagatgattaccattcactcgacagaactggaaggaaagagaagggggtgacagcacttgacccaagagctaacgactttgacctcatgtatgagcaagttaaggctatcaagagcggtgttgctgtggacaagcctatctacaaccatgttactggtctcttagatcctcctgagctcatcaagcctcctaagatccttgtcatcgaaggactacaccctatgttcgatgagcgtgtgagggatctgttggacttcagcatctatttggacatcagcaatgaggtcaaatttgcatggaaaattcagagggacatggctgagagagggcacagccttgaaagcattagagctagtattgaagccaggaaacccgatttcgatgcctatattgatccccaaaagaaatatgctgatgcagtgatcgaagtgctgccaactcagctcattccagacgacaatgaagggaaggttttgagagttaggttgataatgaaagaaggggttaagcatttcagtcctgtttatctgtttgatgaaggctcaaccatctcatggataccatgcggaaggaagctcacttgctcttaccctggcatcaaattccactatggccctgacacttactttggcaacgaggtttctattctggagatggacggccaatttgatagattagatgaacttatttatgttgaaagccatttgagcaacatctccaccaagttctatggagaagtcacccagcaaatgttgaagcatgcggatttcccaggaagtaacaacggaactggcctcttccagaccattgtcggattgaagataagagatctctatgagcaaattacttccagcaaaactgcagctccactagaagcaacaaaagcctaagattattagagtttcttcatacattggactagaccttgggtccataaccaattatcctctttccagctttcctctatcgaaggtttatttgagtgttaggctgttgttgctttcataagagtcgagtatgatcctgtgcatttattttatgtttgtaattcagtggagatatgtaatatagagaaacaaaatcagagttcaatttcaactttgagaagttcatataagacaaagcctttcgacatcatctctccacttctatttccccctattgctgcttcttgttgtaagttgtaaccatttatgatgtcaagatcattggttttcttactccaaataaagaggatttggctatggaagcgtggccataatgtgacgttttccttgaatttagtttaaccttttttataattaattcaataagccaaaaagtagaacctgatagaact

SEQ ID NO: 1306 - DNA, 1600 bp, Lotus japonicus
gaaatgcctttgttttggttgtaattccacctcatattatgtgtgttccaaacgtcttcttgagatgtcccttaccataatcctcaaacagaagccaacttaaactcagtgcttctcttaacattctcttttaacatatttctgtagatagagggagagtgagagggagagaatggcagcttttactgtctactctacacaatctctgagatcaaattgctccatcgccaccccatcaaaatcccatgtgggatttcaccaaaaacaacagttagttttctacaagagaggtagtgacagtactagcaccagcagaaggtatgtgataacatgtgcaggtggtgaccaacagacaattgtgattggtctagctgctgactcaggatgtgggaagagcaccttcatgaggaggctcacaagtgtgtttggaggagcagcagagccaccaaagggtgggaacccagattccaacactctcatcagtgacaccaccactgtgatatgtttggatgattaccattcacttgatagaactggtagaaaggaaaagggtgtcactgcacttgacccaaaagctaatgattttgatctcatgtatgagcaagttaaggcaattaaggaaggaatttctgttcaaaagcctatttataatcatgttactggtcttttggatccaccagagcttattaaacctcccaaaatcttggtcattgaaggtcttcacccaatgtatgaccctcgggtcagagaactgttggactttagcatctacttagacattagcaatgaggtgaaattcgcttggaaaattcagagagacatggcagagcgtggacatagtcttgaaagtatcaaggctagcattgaagcaagaaagcctgattttgatgcttatattgatccacaaaagcaatatgcagatgcagtgatagaagtgttgccaacccaactgattcctgatgataatgaagggaagattttaagagtgaggttaatacagaaagagggggtgaagtactttagccctgtttacttgtttgatgatggctccaccatttcttggataccatgtggaaggaagcttacatgctcttaccctggcatcaagttcttctatggaccagacacttactatggaagtgaggtgtcagttgtggaaatggatggacaatttgacagattagatgaactaatatatgttgagagccacctaagcaacctctcttccaagttctatggagaggttactcaacaaatgttgaagcatgctgatttccctggtagcaacaatgggacaggtctcttccaaaccatagttggtttgaagataagagatctttatgagcagatactagccagcagggctgagactccagtaggagcagcaaaagcttaggaacctgcctgccttatatatagttatacatattggacaaggcagtcattgagttcccaaaatcattttcttaattttccaaaatttctgtctttcatgtgagtttgtgtattattgttaggctgttcttcaatgtaatgaaaagactctgcatgtgtacttatactcttaatacagagaagaaatagcagggatgagattcag

SEQ ID NO: 1307 - DNA, 2187 bp, Populus trichocarpa
gacaatcttactcatggacattaaattattcccgtccatgtccccctctatccctgccttagtattacctccggctttgtcaaaaacaaggggtagtcacagaaaaacataaacaagacacgtcagcatcccatcaccagccaaaacagttttttctttcccatacaaactgctatctgtttttcttttcttcaaccttttcctccactcatttgttttcccaacttttcctttgatataatcaaaggaaaagcgtccacaaacccattacatgccaccctttcaaaactagctgaaaagatcagaactcagttcaccaccatctcttccgctctcaagctaaggaaatggcagtttgcacagtatacactacgcagtccctcaattcaacttgctcaatctccaccccaacaaaaacccacttggggtttaaccaaaaacatgtagtgttctatagcactaacaagaaaacaaccaagagggctagcagtgctgtgataacctgctcagctgacacacaaactgttgtgattggcctagcagcagactctgggtgtggtaagagtaccttcatgaggaggttaacaagtgtttttggaggtgcagcagagccaccaagaggtggcaatcctgactcgaacacactcataagcgacactacaactgtaatatgtttagacgattatcactcacttgataggactggaaggaaagagaagggtgtcactgcacttgatccaagagccaacaactttgatctcatgtacgagcaagtaaaggctatcaaagatgggactgctgttgagaaaccaatttacaatcatgttacaggtctcttggatcctcctgagcttattaagcctcctaagattcttgtcattgaaggtttgcatccaatgtatgaccaacgtgtgagggacctcttagacttcagtatctacttggacattagcaacgaggttaaatttgcatggaaaattcagagggatatggctgagcgaggacacagtcttgaaagcattaaagctagtattgaagcacgcaagccagattttgatgcttatattgatccacaaaagcaatatgctgatgctgtcattgaagtgctgccaacccaactcattccggatgacaacgaggggaaggttttaagagttaagctgatcatgaaagaaggggtggaatttttcagccctgtctacttgtttgatgaaggctcttctatttcatggatcccgtgcggtaggaagctcacctgctcttaccccggcatcaaattctcctatgggcccgatgcttactacggccacgaggtgtctgtactggaaatggatgggcaatttgacagattagatgagctcatctatgtcgaaagccatctaagtaacatctctaccaagttctatggagaagtcacccagcagatgttgaagcatgctgatttccccggcagcaacaacggaacaggtctcttccagacaatcgtcggattgaaaataagagacctcttcgagcaaattgttgccagcagggccaaaaccccagttgaagccacaaaagcctaatttacatattgaacaaggcactcattctcaaaagttaccctctttgagtttctctttttcaacgtcctcttgtgcttcagttcagtgataggtcggtcctcataagaatgagatgttgagaacactgtatctatttggtgttatatttctatggagatctgtataatgtagagaatcaaaaacagatgaaattcatttcagaaacttcatagaagatcagaaccttttggcattattttctctcaagttcctgcactgctttttccttcttgcatcacctatttagccactaacattggtgatttgcttgtgctctattttcttcttggaacatgaatggcctaattaaaatgcatgatttttatctttccccttcaatgtgcaaaggaaatgtaagagaacaggaagtccagtgacatggcgtaaagtttgcaagtaacattggccttctctttttgagtgtgtatactgatttagtttgatttcccaagacagtaaaaaaaagtcttcttggttgagattcgacaatcgaatctctgtagggcatgattgccttttcagagacagcatttatacgttgttgcgtttctgtagggaagcaatcgaatgcagagccaccttt

SEQ ID NO: 1308 - DNA, 1270 bp, Papaver somniferum
ttcttacttctcatgttcagctggagattcaaaaacaattgtgataggattggcagctgattcaggatgtggtaaaagtactttcatgagaagattaacaagtgtttttggtggtgccgcagaaccaccaaggggtggcaacccagattcaaatactttgattagtgacacaacaaccgtcatatgtttagatgattatcattcacttgatagaaccggaagaaaggaaaagggtgttactgctcttgacccaagagctaatgattttgacctaatgtatgagcaagttaaagctcttaaaaacggtattgctgttgagaaacctatctacaatcatgtatctggtcttttagatcctccggaacttatccagcctcctaagattcttgtcatcgaaggtcttcacccaatgtacgactctcgggttagagacctcctcgacttcagtatctacttggacattagtaacgaagtcaagtttgcatggaaaattcagagggatatggccgaacgtggtcacagtcttgaaagtattaaagctagtattgaagcccgaaagcctgattttgatgcttacattgatccacaaaagcaatatgcagatgcagttatagaagttttaccaacaacattgattccagatgacaacgaaggaaaagttttgagggttagattgatcatgaaagaaggtgtaaaatatttcagtccagtttacttgttcgacgaaggttccaccatttcatggattccttgtggaaggaaactcacttgttcatacccaggcatcaagttcaactatggtcccgactcttacttcgacaatgaggtgtctgtgttggaaatggatggacagtttgacagattagacgaactgatttacgtggagagtcatcttagcaacatctctaccaagttctacggagaagttacccaacagatgttgaagcacgcagatttccccggtagtaacaatggaactggtctcttccaaaccatggttggattgaagatcagagatctttatgaacagattttggcaagcaaagttggagctttggaagcaagcaaagcttgatagcggaaatacttgatcagaatcacttcaaataaacaattattctacgaagttttcattcttcttctccaacttcatcattgtggagtttaggctttctactttcaactcataagatttaagaacactcttatatgtaattcatgttgtaatactatcatgtggagatttgtaatatagcgaggacacaaggga

SEQ ID NO: 1309 - DNA, 1689 bp, Triticum aestivum
gggaaatagggacaccacatcatcaccatctcatttccctccttatgttttcttagctcttatctccacagttctttcatcaagctctctcttctccccaagtctcagttacaacttacaaggcttgaaggggagaagagcagctccaagaggtcgggcagcaaacatggcattctgcagcccacacagcaccacatccctgcgctccccatgcaccaccatcccaaactctggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcacaagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgagttaaattgatcatgaaagaaggcattaagttcttcaacccggtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccattgtaggactgaagattagagatctctatgaacagatcatcgctgagagggccggcgttcctgctgaagcagcaaaagtttgatgagccccaaattcaagttcacgaatcatttcatcaccaactcaatgagaatgagcatcctcgcatttcttgtacctagtttgaatatattacagctagaagacggtagaaagttcactgcagaactcatgaaaacctgcattttgaacttctcgaaaatcctctccatgatgagggtctcttatgtctcttcttaacaaatttcgatgtacatcttctcccatgtttcaatgcagaaaatacatgtgcttgctagaatcagaagcggctgcttttatctaacgtgtcccttttttggctgttactgc

SEQ ID NO: 1310 - DNA, 1673 bp, Triticum aestivum
ttagctcttatctccacagttctttcatcaagctctctcttctccccaagtctcagttacaacttacaaggcttgaaggggagaagagcagctccaagaggtcgggcagcaaacatggcattctgcagcccacacagcaccacatccctgcgctccccatgcaccaccatcccaaactctggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcacaagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgagttaaattgatcatgaaagaaggcattaagttcttcaacccggtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccattgtaggactgaagattagagatctctatgaacagatcatcgctgagagggccggcgttcctgctgaagcagcaaaagtttgatgagccccaaattcaagttcacgaatcatttcatcaccaactcaatgagaatgagcatcctcgcatttcttgtacctagtttgaatatattacagctagaagacggtagaaagttcactgcagaactcatgaaaacctgcattttgaacttctcgaaaatcctctccatgatgagggtctcttatgtctcttcttaacaaatttcgatgtacatcttctcccatgtttcaatgcagaaaatacatgtgcttgctagaatcaaaagcggctgcttttatctaacgtgtcccttttttggctgttactgctgatcacgactaacattcataaaaggccatttaaga

SEQ ID NO: 1311 - DNA, 1262 bp, Triticum aestivum
gggagaagagcagctccaagaggtcgggcagcaaacatggcattctgcagcccacacagcaccacatccctgcgctccccatgcaccaccatcccaaactctggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcacaagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccggtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccatcgtaggactgaagattagagatctctatgaacagatcatcgctgagagggccggcgttcctgctgaagcagcaaaagtttgatcagccccaaa

SEQ ID NO: 1312 - DNA, 1594 bp, Amsonia hubrichtii
gagaagggaaaaccaaacaaacacagacctcatgacacattgtactcactagctacctcaaaacacctcaaactgaaccacataaaaacttgttttttctctctcaaaattcagttgcactctcaaagagtagagggagaagaaaaaaaatggctgtttgcacagtctacacagttcaatccctcaactctacatgttcaatctcaacaccaacaaaatcccacttgggattcacccaaaaacaccaagttttcttctacagcacaagcaagaaaagcatcaacaccagcaggaggagctgcagtgagatatcatgctcagctgaggataaaacagtggttataggcttagctgcagactcgggatgtgggaaaagtactttcatgagaagattaacaagtgtgtttggaggtgcagcagagcccccaaagggtggaaatcctgactcaaacacactcatcagtgacatgaccactgtgatttgcttagatgattatcattctcttgatagaactggaagaaaagagaagggagttactgcacttgacccaagagccaacgactttgatcttatgtatgagcaagttaaggctttgaaaagtggcgttcctgttgagaagcctatttacaatcatgttactggtcttcttgatcctcctgagctcaccaaacctccaaagattcttgttattgaaggtttacatccaatgtttgatgagcgtgtaagagatcttttggacttcagtatctacctggacatcagtaacgaggtcaaatttgcatggaaaattcagagagatatggctgagagaggacacagccttgagagtattaaggctagcattgaagccaggaaacctgattttgaagcatttattgatccacaaaaacaatttgctgatgctgtgattgaagttttgccaacacaactcattcctgatgacaatggtgggaagattttgagagtgagattgataatgaaagagggagtgaaatatttcgacccagtttacctatttgatgaaggctctacaatctcatggattccttgtggaaggaagttgacatgttcataccctggcatcaaattctcatatggtcctgacacttactatggccatgaggtatctgtcttggagatggatggccaatttgacagacttgacgaactaatctatgtggaaagccatctgagcaacctctcatccaagttctatggtgaagtcactcaacaaatgttgaaacatgctgaattccctggcagcaacaatggaacaggtctcttccaaaccattgttggattgaagatcagagacctctacgagcaaattgtttctacccaggtttcaactccattgcaagcagcaaaggcctaaagaatttgccgagatgtcctgagactagacataaattactccttgctcttaatcctttccactcttttttgtttcagctttcctctccctatgtctgagtgttacttttcatcataaatctgaaacactctaaacatgtacctatttccagtacaaacactctggagacttgtaatatagagaagcaaaaggagaaatgaaatggaaaacgtgaagaa

SEQ ID NO: 1313 - DNA, 1386 bp, Fagopyrum esculentum
ggcagcatgcacactatacgcagctctacccacaacccatttagggttcactaacaaacattccaccgtcgtgttctacaccaacaccaacaacaacaagctaagaagcattagaagaacgaacacgacggtgataacatgctcggtaggtgactcacaaacgattgttattggtctagctgcggactctgggtgtgggaagtcaacattcatgagacggctaactagtgtatttggaggggcggccgagccaccaaagggtgggaatcctgactcaaacacgcttattagcgacactacgacggttatatgcttggatgactaccattcacttgatagaaccgggaggaaggagaaaggagtgacggctcttgacccaagagcaaatgacttcgatttgatgtatgaacaagtcaaggctttgaaggaaggtaaggcggttgataagcctatttataaccatgtttctggattgcttgatcctcccgaagttatcaagccttctaaaattcttgtcatcgaaggcttgcaccccatgttcgaccaacgtgtaagagacttgttggacttcagtatctacctagacatcagcaatgaagtcaagtttgcttggaagattcagagggatatggcggagagagggcacagcctagagagcatcaaggctagtatcgaagcccgaaagcccgatttcgacgctttcattgatccgcagaagcaatatgcagatgcagtgattgaagtgctacccacacaactaattccggacgacaccgagaagaaggtgttgagagtaagactaataatgaaggaaggagccaagtatttcagcccggtttacctcttcgatgaaggctcgacgatctcatgggtaccttgtgggaggaagctcacttgctcctaccccggaatcaagtttgcttacggaccagacacttacttcggcaacgaggttactatccttgaaatggatggacagtttgacagactagatgagctgatctatgtcgagagtcacctgagcaacttgtcgacgaaattctatggagaagtgacacaacaaatgctgaagcacgcggatttcccgggaagtaacaacgggacagggttcttccagacgatagtcgggttgaagatccgagacttgtttgagcagattgttgctagcagggaaccaaccccagctgctgcagcaaaagcctgagcattgctattttttcttgttgtggtttcattatttagggcttctatatgatcctttacaaaaggagaggctcaagagatgtaattatgtgaagaaattcttacagatgtagagttgaagggaagatgaaatgctgtacaagtgtaaactgtttcagacctacttttccaatctcatcgaat

SEQ ID NO: 1314 - DNA, 1872 bp, Quercus alba
atgggagggtagtcacataaacccataaacaaaagacacatcagcctcccatcaccaagccaacattttctttcccatcttccaaaaccaaaactgccttctgctttcatcaaatccttttaccctcttatttgtgtcccaaattctccgtataaattcaagaggacaagaagccaaacttatttcatgtctacttctactactcaaaacaccaactaaatagagttaccaaaagccaattcaaccattgctcttgctctctcagagcactttgtgaattccttttctgagtagagagacggaaagaatggcaatttgcacagtctacaccaccccatctctcaattccacatgttcaatctccaccacatcaaaaacccaattgggatttcaccaaaaacaggtagttttctattctagtggcaagaaaactagcaagagaggcagcaacacaaccagcccatatgtgataacatgcacaacatcagcaggtgattcaaagacagttgtgataggtctggcagcagactcaggatgtgggaaaagtaccttcatgaggaggctgaccagtgtgtttggtggggctgcagagccaccaaaggggggtaaccctgactccaacacgctcatcagtgacactaccaccgtgatatgcttggatgactatcactcactggataggactggaaggaaacagaagggtgtcactgcacttgaccctagagccaacgactttgatctcatgtatgaacaagttaaggctctcaaggatgggattcctgttgataagcctatttacaatcatgtttctggtctcttggatcctcctgagctcatcaagccccctaagattcttgtcattgaaggtttgcacccaatgttcgattcacgagtaagggacctgttggacttcagtatctacttggacatcagcaatgaggttaagtttgcatggaaaattcagagggacatggctgagcgtggacacagtcttgaaagcatcaaagctagtattgaagccaggaagcctgattttgacgcatatatcgatccacaaaagcaatatgcagatgcagtgatagaagtgttgccaacccaattgattccggatgataacgaggggaagatattgagagtgaggttgataatgaaagaaggggttgagtttttcaacccagtttacctgtttgatgaaggctctactatctcatggataccatgcggaagaaagcttacatgctcataccctggcatcaagtttttctatggccctgacacttatttcggccacgaggtgtctgtgctggagatggatggtcaatttgaccgattagatgagctgatatacgtggaaagccatctaagcaacatatccaccaagttctatggagaagtgacccaacaaatgttgaagcatgctgatttccctggcagtagcaatggaactggtcttttccaaaccattgttggtttgaagataagagacctgtacgagcaactcatctccaccacggctaaaactcctgtagaagcaacaaaggcctaattaagaagcaccatcatgcctagccaacccttgccttgcctgcatggacaaattaaagcccacccacaatttaattaagtctctctctctctctctcaaaacattttccacttttttattttattaattttcaactctccccctcttccataatatttcattttgagtgttaggctgttcttaattgataagaattaatgacaacacagtctctgtacctacttattttctattctggagatcaatgtgataattaatgtaatatatagagagaagccaaaagcatagataaaattcagctaagaagaatggtacccttttattct

SEQ ID NO: 1315 - DNA, 1720 bp, Fragaria vesca
ctttccaaactgcctcgtgtcatcaaacttcaatctgttgtagcctcttattttgtgttccaaataacctttcctccacttttttgaaatcaacaccatttcatatatgtgtcatcttcccaaaaccatctgaccaaaataaccataacctctctctctccctccattaaatctctctggtttccaatcccgcattagagatcagagagacaagatggccatttgtgcagttcacacaagcacccagttcaacccaacatgctcatcaatctccaccccttctaaatcccacttgggattctgccaaagacaacaagtagtgttctacaccaagaggactagcaagagatcatccacaccatacgttggcctcatagcttgcgctgcaggcggccaggagacggtggtgattggcctcgctgccgactccggttgcgggaagagcacattcatgaggaggttgacaagtgtgtttggaggagcagcagagccaccaaagggaggcaaccccgactccaacactttgataagtgacaccaccactgtgatatgcttggatgattaccactcacttgacaggactggaaggaaggagaagggagtcactgctcttgacccaagagccaacgacttcgacctcatgtatgagcaagtcaaggccatcaaggatggcaaggctgttgagaaacctatttacaaccatgttagtggactgttagaccccccggagctcatcaagccccccaagatccttgtcattgaaggcttgcacccaatgtacgatcagcgagtcagggacctcttggacttcagtatctacttggacatcagcaatgaggttaagtttgcatggaaaatccagagggacatggccgagcgtggacacagtcttgagagcatcaaagccagtatcgaagcccgaaaacccgatttcgatgcttacattgatccacaaaagcagtatgctgatgcagttatcgaagtgttgccaacccaactcattccaggagataatgagggcaaggttttgagggtgaggttgataatgaaggagggagtcaagttcttcaacccagtctacttgtttgatgagggctctaccatttcatggataccttgcggaaggaagcttacctgctcttaccctggaatcaaattcacctatggtccagacacttattatggccaagaggtgtcagtgttggagatggatggacaatttgacagattagatgagctgatctatgtcgaaagccatctaagcaacatctccaccaagttctacggagaagtcacccaacaaatgttgaagcattccgacttcccaggtagcagcaacgggaccggtctcttccaaaccatcgtcgggttgaagatcagagacctctatgagcagctcattgcaagcaaggccaaaagtccggtagaagcaaaagcttaattaagatgagaaccctctaattgtctattgtatgtatgtactactgcaacactagaattgaagcattggttttgtttcagttttctattctatttttccgctccttcttcctttagtgtttctgttagtgttgggctattcctaacaagaacaaggacactttgtactatcatcatcacgtacctctatgttgtaatctctgcaagatttgtattatacagcatcaaattaattaagaaagatacaaagttcagttcaagaaaaagtttgatggactct

SEQ ID NO: 1316 - DNA, 1359 bp, Flaveria ramosissima
ttccacattgaaaaagctccaacctttatacctctttctctctcaagacttcaagaaacaagagagtaacaatggcagtgtgcacagtgtacacactgcaacctctcaactcatcatgctcaatctcatcacccacaaaaacccacatgggattcacccaaaagcaagtctttttctactccaatggtggtaaaaagactaaaagcaacaagtatagaacaggtggtgagatcacatgctcaggggacacaatagtaataggacttgcagcagactcagggtgtggtaaaagcaccttcatgaggaggttaaccagtgtgtttggtggtgcagcctctccaccaaagggtgggaaccctgactcaaacacactcataagtgacaccaccactgtcatatgtttagatgactatcattcattagatcgcacaggaagaaaagaaaagggtgtgactgcacttgacccacgagccaatgactttgatctgatgtatgaacaggttaaggcgcttaaagatggtgtggctgttgacaagcccatttataaccatgtttcggggcttttggaccctcctgaactcattaaaccacccaagattcttgttattgaaggtctgcacccaatgtatgatcagagagtaagagacctcctggacttcagtatttacttggacatcagtaacgaggttaaattcgcatggaaaatccagagagatatggcagagagaggacacagtcttgaaagcattaaagctagcattgaggcccgaaaaccagattttgatgcttatatcgacccgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggtgaaagctcacttgctcatatcctggcatcaaattcgcctatggtccagacacttatttcggccatgaggtttcagtgttggaaatggatgggcagtttgacagattagatgaactcatctatgttgaaagccatttgagcaacatttcgacaaagttctacggtgaaatcacccaacaaatgttgaaacatgctgatttcccccgggagcaataatggtactggtttgtttcaaaccattgtcgggttgaaggatccgagtatttgtttgaacaaattgcagccaataaggggatcagttaccacttagagctacaaaagcttaatcacaatggaagagttattatgagttcagtgttgttatcacatatgtatttagtctagttcc

SEQ ID NO: 1317 - DNA, 1411 bp, Zostera marina
tcgggtaaagaagggagaagaacacttacttctagttccaaaccaacatttttctcttcttcctcaaagagctagaaggaagcttggtggccagaagagaaaaaatggcagtctgcacagtctactctcctcattctctcaaatccacatgcccaattccaaatacatcaagaatccaattggtctcatcagaagcaagttattttctcacaaggagaaaggcgacaactacagagcaataagttatccggtaccatcacctgtgaagcaaacacaattgttatcggtcttgcagcagattcaggatgtggaaagagcacattcatgaggagacttactagtgatttggtggagcagcatcactcccaaggtgggaatccagactcaaacacgcttatcagtgacacgacaactgtgatatgtcttgatgactaccactctctcgatagatatggaagaaaggagcagggtgttactgcacttgatccaaaagccaacaactttgatctcatgtatgaacaagttaaggcacttaaacaaggtattgctgtggagaaaccaatttataatcatgttactggaattctcgatcctcctgagctcattcaacctcccaagatcctggttattgaaggactgcacccaatgtacgattctcgtgtccgtgatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaaggggaaggtgttgagagttaagctggtgatgaaggaaggagtgaaatatttcagtcccctcgtacctctttgatgaaggatcaaccatcgattggatcccatgtggagaaaattgacttgttcatatccaggaattaagttctcttatggtccagacagttactactcaaacgaggtatctgtgttggagatggatgggcaattcgacaaattaagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattgcagaaaagaaaaggcagttcactgcaagcagccaaaatgtagaaaatgttcttttaccaatctaattttttccctctcttcttatttacttatgttgttccagtaaatacccaaactaggtaaaaatgagattacc

SEQ ID NO: 1318 - DNA, 1314 bp, Ambrosia trifida
cacagtccaacctctcaacacatcatgctcaatctcatcacacacaaaaccccacatgggattcaaccaaaagcaagtctttttcttaaccaaaagtaataataaaaccaccaaaaacagcagctttagaggcagcaaaatcacatgctcaggtgacacaatagttataggactagcagcagactcaggatgtggaaaaagcaccttcatgagaaggttaaccagtgtgtttggtggtgcagcttcaccaccaaagggtgggaaccctgactcaaacacactcataagtgacacaacaactgtcatatgtttagatgattatcattcattggatagaactggaaggaaagaaaagggtgtcactgcacttgatcctagagccaatgactttgatcttatgtatgaacaagttaaagctattaaagatggtgtggctgttgaaaagcctatttataaccatgtttctggtcttttggaccctcctgagctcattaaaccacctaagattcttgttattgaaggtttgcacccaatgtacgatcaaagagtaagagacctcctggacttcagtatttacttggacatcagtaacgaggttaaattcgcatggaaaattcagagagacatggcagagagaggacacagtcttgaaagcattaaggctagcattgaggccagaaaaccagattttgatgcctatattgacccacaaaagcaatatgcagatgcagttatcgaagtgttgcccactcagctgatcccggatgacaacgagggaaaagtgttgagagtgaagctaatcatgaaagaaggcgttaaatacttcaacccggtttacttattcgatgaaggttccactgtttcatggatcccatgtggacgaaagctcacttgctcctttcctggcatcaaatttgcctatggtccagacacttatttcggccatgaggtttctgtgctggagatggatggacagtttgacagattagatgaactcatctacgtcgaaagccatctgagcaacatttcaaccaaattttacggtgaaatcacccaacaaatgttgaaacatgctgacttccctggtagcaacaatggcactggtttgtttcaaaccatcgtcgggttaaagatccgagatttgtttgaacaaatggtagccagtaaggcctcggctccacttgaagctacaaaagcttgatttttaatcaagagtttactatgagtgttgtgatcccatatgcatgtattcaattccctttgtgcattccatggacatatgtaacataaatatatataagttcataaatgaaa

SEQ ID NO: 1319 - DNA, 1427 bp, Euonymus alatus
cagtctgcacagtttacacaacccaatctctcaactcaacatgctcaatatccacaccaacaaaaaccaacttgggtttcaccaaaacaggttgtgttttatactacttctggtaggagaagcagcaagagaagtagaactactactttgataacctgctcagcgggtgactcacagacagttgtgattggtctggcagcagactctggatgtgggaagagtactttcatgaggaggttaacaagtgtttttggaggagcagcagagccacccaaaggaggaaatccagactcaaacacacttataagtgacacaacaacagtgatatgcttagatgattatcattctcttgatagaactggaaggaaagagaagggggtgactgctcttgacccaagagccaacgactttgatctcatgtatgagcaggttaaggcaatcaaggatgggtttgctgttgagaaaccaatctacaatcatgtaagtggtcttcttgaccctcctgagctcatcaagcctcccaagatccttgtcattgaaggacttcacccaatgtatgatcagagagtaagggacctgttggactttagcatttacttggacatcagtaatgaagttaagtttgcatggaaaattcagagggacatggctgagcgaggacacagtcttgaaagcattaaagctagtattgaagcaagaaagccagactttgatgcttatattgatccacagaagcaatatgcagatgctgtgatcgaagtactcccaacccaactcatcccggacgataatgaggggaagaccttgagagttaagttgataatgaaggaaggtgtgaagtacttcaaccctgtttacttgtttgatgaaggctccactatctcatggataccctgtggaaggaaactcacctgctcttatcctggcatccagttcgcctatggccccgatgcttacttcgaccacgaggtgtctgtgctggagatggatggacaatttgacagattagatgagctcatctatgtagagagccatttgagcaacatttccaccaagttctatggagaagtcacccaacaattgttgaagcatgctgatttccccggcagtaacaatggaaccggtctcttccagactatagttggattgaaaataagagatctctatgaacagcttgtagcgagcagggccggagccccagtaaaagccagaacctaagcacaaaagcatgcacttcctcttattcagtcttttgtttccttttccgctgggtctttaggctgcatgtacctatgagtaacactctaggtaacactatgtaccgattcatgtggtaattgtattgggagtttgtaatatagagaagaaataacagatgaaattcagttaagaaattcttgaaggaatggactttctggcattatacc

SEQ ID NO: 1320 - DNA, 1198 bp, Flaveria ramosissima
aaaatggcagtgtccacagtgtacacagcccaatctctcaactcaacatgttcaatctcaacacccacaaaaacccatttgggaattcagcaaagacaagtgttgttctatactaaaaagaccaataggggcagggtgaggggtggtgagataagatgctcaggggacacaatagtaattggactagcagcagactcagggtgtggaaagagtaccttcatgaggaggttgactagtgtgtttggaggtgcagcagagccaccaaagggaggcaatccagattcaaacacactcataagtgacaccaccacagtcatatgtttggatgattaccattcattggatagaacagggaggaaagttgaaggggtgacagcacttgatccaagagccaataactttgatcttatgtatgagcaagttaaggctttgaaagatggcattgctgttgaaaagcccatttataaccatgttagtggtcttttggaccctcctgagaccatcaagccacctaagatccttgtcattgaaggtttgcacccaatgtatgatcagagagtaagagacctcttggatttcagtatctacttggacatcagcaatgatgttaaatttgcctggaaaattcagagggacatggcagaaagaggacacagccttgaaagtatcaaagctagtattgaggccagaaagccagattttgatgcttatatcgacccacaaaagcaatatgcagatgctgttatagaagtgttgcctacacagctcattccaggtgacaatgaggggaaggtgttgagagtcaagctgataatgaaagagggagtgaaatacttcagccctgtttacttgtttgatgaaggctccaccatctcatgggttccatgtgggaggaaactcacctgttcttaccctggtatcaaatttgcctatggccctgatacttactacggtcatgaggtctctgtgttggagatggatgggcaatttgatagactggatgagcttatctatgttgagagccatttgagcaacatttccaccaaattctatggagaaatcacccagcaaatgttgaagcattcagatttccctggtagcaacaatggcactggtctcttccaaaccattgttggtttgaaaatcagagatctctttgaacaaatcacagccagcaaggcctcagctacattggaag

SEQ ID NO: 1321 - DNA, 1572 bp, Elaeis guineensis
caagtcctcttcttcctgctggtgttctctctccaccgcttctcccttctcttggaggaaagcagaacagcagacctcagctgccgacccttaaaagaagacaccaaataggcccatcaaagatggcactttgcacagtcagcaccactccttcccttcactccccattctgcgtatccaacccaacaaagacttgctttggattcagccagaggcagcaggtcatcttctacaccagtggcaggagaagcagcaggaggggaggaaagaataattcggaggtcttctattgctgtgccgaggctaagactgtggtgattggactggcagcagactcggggtgtgggaagagcaccttcatgaggaggctgactagtgtgtttggaggggcagcggaaccacccaaaggagggaacccagactccaacactttgatcagtgacaccaccacagtgatatgtttggatgactaccactccttggacaggactgggaggaaggagaagggagtgacagctctggaccccagagccaacaactttgacctcatgtatgagcaggtgaaggccatcaaggaaggggtggctgtggagaagcctatctacaaccatgtaactggtctgcttgacccccctgagctcatccagcctcccaagatcctggtcatcgaaggactgcatccaatgtatgatccacgtgtgagagatctcttggacttcagcatctacctggatatcagcaatgaggtcaagtttgcatggaagatccagagagacatggctgaacgcgggcatagtcttgaaagcattaaagcaagcattgaggctcgaaaacctgactttgatgcctacattgacccacagaagcaatatgctgatgctgtgattgaggttttgccaacccaattgattcctgatgacaatgaaggaaaagtgttgcgggttcgcttaattatgaaagaagggttgaagcatttcagcccagtttacctctttgatgaaggctccaccatctcttggataccctgtgggaggaaactaacttgctcataccctggaatcaaattcttctatggcccagacacctacttctcccatgaggtttcagtgttggagatggatgggcagtttgacaaattagatgagctcatatatgtggaaagccatcttagcaacatctcaaccaagttctatggggaggtgacgcaacagatgttgaagcatgccgacttcccaggcagcaacaatgggactggtctgttccaaactatcattggtttgaaaataagagatctatatgaacagattatcgcagagagggcagctgctcctgcagaagcagcaaaagtttagtagttcatatttgcatagtcaaattcaaattttcttttcatatttggcctcctaaaatgacataactagtatgtgcatctcatgtaatttatatactatctgtgacaaaaaagcagggggaaagtaatgtggcaaatccccatctgattgtaagcattggggtttatctgaatccccactccctgagtgaattatttcattctcaatcatgatttcctta

SEQ ID NO: 1322 - DNA, 1263 bp, Flaveria ramosissima
aattccacattgaaaaagctccaacctttatacctctttctctctcaagacttcaagaaacaagagagtaacaatggcagtgtgcacagtgtacacactgcaacctctcaactcatcatgctcaatctcatcacccacaaaaacccacatgggattcacccaaaagcaagtctttttctactccaatggtagtaaaaagactaaaagcaagaggtatagaacaggtggtgagatcacatgctcaggggacacaatagtaataggacttgcagcagactcagggtgtggtaaaagcaccttcatgaggaggttaaccagtgtgtttggtggtgcagcctctccaccaaagggtgggaaccctgactcaaacacactcataagtgacaccacaactgtcatatgtttagatgactatcattcattagatcgcacaggaagaaaagaaaagggtgtgactgcacttgacccacgagccaatgactttgatctgatgtatgaacaggttaaggcgcttaaagatggtgtggctgttgagaagcccatttataaccatgtttcggggcttttagaccctcctgaactcattaaaccacccaagattcttgttattgaaggtctgcacccaatgtatgatcagagagtaagagacctgctggacttcagtatttacttggacatcagtaacgaggttaaattcgcatggaaaatccagagagatatggcggagagaggacacagtcttgaaagcattaaagctagcatcgaggcccgaaaaccagattttgatgcttatatcgactcgcaaaagcaatacgcggatgcagtaatcgaagtgttgcctacacagctaattcctgatgacaatgagggaaaggtgttgagagtgaagctcatcatgaaagaaggagttaagtacttcaacccggtctacttattcgatgaaggttccaccgtttcatggatcccgtgtgggagaaagctcacttgctcatatcctggcatcaaattcgcctatggtccagacacttatttcggccatgaggtttctgtgttggaaatggatgggcagtttgacagattagatgagctcatctatgttgaaagccacttgagcaacatttcgacgaaattctatggtgaaatcacccaacagatgttgaaacatgctgatttcccaggtagcaataatggtactggtttgtttcaaaccattttcggttgaagatccgagacttgtttgaacaaattgcggccaataaggga

SEQ ID NO: 1323 - DNA, 1432 bp, Festuca arundinacea
agtggtatcaacgcagagtacgggggatcaagctctctcttctcctcaagtctcagttacaaggcttgaagggaagaagagcaactcccgcaggagcaaaggttgggcagcaaacatggcattctgcagcccacacaccaccacatccctgcactccccacgcaccactatcccaaactcaggcttcaggcagaaccaagtcatcctcttcacgaccagaagcagcaggaggagtaacacgaggaatggagcaaggaccttccaggtttcatgcgcagttgacaagccaatagtgatcggcctggcagcagactcaggatgtgggaaatccaccttcatgcgccggctcaccagtgtgtttggaggtgctgcagagccacccacgggcgggaacccagactcgaacacgctcatcagcgacaccacaacggtgatatgcctcgatgactaccattccttggacagaaccgggaggaaggagaaaggtgtgaccgccctggaccccaaggcaaacgactttgatctcatgtatgagcaggtgaaggcaatcaaagaaggccaggctattgagaagccaatctacaaccatgtcaccggcctcttggacccaccggagctcatccagccccccaagattttcgtcatcgagggtttgcacccaatgtatgatgaacgtgtgagagacctccttgatttcagcatctacttagacatcagcaatgaggttaagtttgcatggaaaattcagagagacatggcagagcgtgggcacagccttgaaagcatcaaggctagcattgaagccaggaaaccagattttgatgcatttatcgatccgcagaagcaatacgccgatgctgtgattgaagttctgccaacccagctgattcctgatgacaatgagggaaaggtgctgcgtgttaaattgatcatgaaagaaggtgtgaagttcttcaacccggtttacctcttcgatgaaggatcaaccatcaactggatcccttgtggaagaaagcttacatgctcttaccctggcatcaaattttcctatggcccggacacttactttggccaagaggtatcggtgctggagatggatgggcaatttgacagactagatgaactcatctatgttgagagccacctaagcaacctctcatccaagttctacggggaggtgacacagcaaatgctaaagcatgcagacttcccaggcagcaacaacggaacaggtctcttccaaaccatcgtaggtctgaagattagagatctctatgaacaaatcatcgcggagagggtcggcgcacctgctcaagcagccaaagtttgatgagccccaaattcagatttcacgaatcatttcatcaccaactcaatgagaatgagcatcctctcttgcaactagtttggaaatattacagctagaagacag

SEQ ID NO: 1324 - DNA, 1574 bp, Cirsium arvense
gaacttcagaaaacttaaaagagagaaaaatggcagtgtccacagtgtacacagtccaagctctcaactcatcatgttcaatctcaacacccacaaaaacccacttaggaattcagcaaaaaagacaagtgttgttctacagcaatgctactggtaaaaagaccaataagggcagggtgagaggtggtggtgtgataagatgtgcaggggacacaatagtaattggactagcagcagactcagggtgtgggaagagtaccttcatgaggaggttgactagtgtgtttggaggtgcagcagaaccaccaaagggaggcaatccagattcaaacacacttataagtgatacaacaactgtgatctgtttagatgattaccattcattggatagaacaggaaggaaagtggaaggggtgactgcacttgatccaagagccaataattttgatcttatgtatgaacaggttaaggctcttaaagatggtattgctgttgataagcctatctataatcatgttagtggtcttttggaccctccagagctcattaagccccctaagattcttgttattgaaggtttgcacccaatgtatgatcagagagtaagagacctcttggacttcagtatctacttggatatcagcaacgatgttaaatttgcctggaaaattcagagggacatggcagaaagaggacacagtcttgaaagtatcaaagctagtattgaggccagaaagccagattttgatgcttatattgacccacaaaagcagtacgcagatgcagttatagaagtgctgcctacgcagctgattccaggtgacaacgaagggaaggttttgagagtgaagctgataatgaaagagggagtgaaatacttcagccctgtttacttgtttgatgaagggtccagcatctcatggatcccatgtggaaggaagctcacctgttcttaccctggtatcaaatttgcctatggccctgattcttactttggcaatgaggtctctgtgttggagatggatgggcaatttgacagactggatgagctcatctatgttgagagccatttgagcaacatctccaccaaattttatggagaaattacccaacaaatgttgaagctttccgactttcctggaagcaacaatggcactggtctcttccaaaccattgttggtttgaaaatccgagacctctttgaacaaatcacagccaccaaggcttcagctacagtggaagctacaagagcttaaagttaaaaaacaagaagtggtttaacatggaacgaaaaagtcccttgatttttctttcctccacaacctcttttgtcatgtaaaatttccgagtgttaggcttttatcgcgagtttcatgagagttgcactcccatatgtatttagttccatttgtctattccatggagatgtgtaaaatagagaatcaaattcttgactgaaatcttgaggagattaaagaacttattattaagattatctgcacatatataagtgcaggtagcaatgttatactatataaaactatctgctaagttccccaaaaaagaaaaaagta

SEQ ID NO: 1325 - DNA, 1939 bp, Citrus clementina
caaatgccatgccattacctcatcatctcatcaacaattccatcccccccctctttttcaattattatttttgcattttctgaggtagccaagttaaataaaatgacaattataccccccacataatcacttaatcccattcattgtcccttcttttctctccttttaacatcacctccaaaatttgtccaaaccaaagggtactcacagaaacccgtaaaactaaaacaaataacacatcactcttccatgacagcaagtaaaactgtttgctttccaaactgccatctgttttctttcatcccatgatttttgtcctttcaattatatatacttgtgctccaaaatttgcctcttaaaaatctaaataagattccaaaaggtatcccatctcatcattttcatgtctcatttcagaatttagctgaaagaatcctaaaacgttcatttctgctctagcagcagcatccctcaccgagccaaaaaaaaaagagaaagaaaatggccatttccctcaactcaccatgctctctttactcgccaacaaaaacccacttgggttttttcaacaaccaaagacaactagcggttttttacaacaagagaagcagcagcagcagcagcagtagcagcagcaagcagagaggatgtcttgtgataacatgctcagcaggtgactcacagacaattgtgattggtctggcggcagactcggggtgtggcaagagcactttcatgaggagactaacaagcgtctttggtggagcagcagagccaccaaagggcggcaaccctgattcaaacactctcatcagtgaaaccaccactgtgatttgcttagatgattatcactcgcttgacagaactggaagaaaagaaaagggtgtcactgcacttgatcctagagccaacaattttgatcttatgtatgaacaggttaaggctatgaaagatggagtgtctgttgaaaagcccatttacaatcatgtcaccggtctcttggacccccccgagctcatcaagccccccaagatccttgtcattgaaggcttgcacccaatgtatgatgctcgggtgagagagctcttggactttagtatctatttggacattagcaatgaggttaaatttgcatggaaaattcagagagacatgacagagcgaggacacagtcttgagagcatcaaggctagtattgaagcccgaaagccagattttgatgcctatattgatccacaaaagcaatatgctgatgcagtgattgaagtgttaccaacccagttgattccggatgataatgaaggaaaggttttgagagttaggttgatcatgaaagaaggagtgaagtacttcagcccggtttatctgtttgatgaaggatcaactatcgaatggataccttgcggaaggaagcttacatgttcttaccccggcatcaaattctcttatggccctgacgcttactttggccatgaggtctcgattttggaaatggatgggaaatttgacaggttagatgagctaatttatgtcgaaagccatctaagcaacttatcaaccaagttctatggagaagtcacccagcaaatgttgaagcatgccgatttccctggcagcaacaacggaaccggtctcttccaaactatagttggattaaagattagggatctctacgaacaaatcatcaccagcaaggctgcggctccggtagaagcgaaagcttaaacactgccttgtaatattaaacaaggcaacacagataagttgccaaaaatccatctattcttttccgagtcccttttcttgtttcagttgagtgctaggccagcattttcctcttaagatactcctatgtatgtatttatttcatgttgtaatctatgaacactttgttaataactcaatataaaaatgcaaaagcagagatgaaattcaatca

SEQ ID NO: 1326 - DNA, 1698 bp, Gossypium hirsutum
agcaccattttaacattctcttcctgtctaaaaagctctctaaattccctttcccgagctgaaagataaacaaggtgagcctaaaagagctgaagcaatggcagtttgctcagcatacaccacccagtccctccattcaacgtgttcaatctccacaccagcgaaaacccatttaggttttcaccaaaagcaagtagttttctataggagaagcagcaagagaggtggcagcggcagcagcagcggcccatgcgtgataacatgctcggccggtgattcacaaacagttgtgattggtttggccgcagactcaggatgtgggaagagtacctttatgaggaggctaacaagtgtgtttggtggtgcagccgagccaccgaagggaggcaaccctgattcaaacacgctcattagcgatatgaccactgtgatatgcttagatgattaccattcactcgacagaactggaaggaaagagaagggggtgacagcacttgacccaagagctaacgactttgacctcatgtatgagcaagttaaggctatcaagagcggtgttgctgtggacaagcctatctacaaccatgttactggtctcttagatcctcctgagctcatcaagcctcctaagatccttgtcatcgaaggactacaccctatgttcgatgagcgtgtgagggatctgttggacttcagcatctatttggacatcagcaatgaggtcaaatttgcatggaaaattcagagggacatggctgagagagggcacagccttgaaagcattagagctagtattgaagccaggaaacccgatttcgatgcctatattgatccccaaaagaaatatgctgatgcagtgatcgaagtgctgccaactcagctcattccagacgacaatgaagggaaggttttgagagttaggttgataatgaaagaaggggttaagcatttcagtcctgtttatctgtttgatgaaggctcaaccatctcatggataccatgcggaaggaagctcacttgctcttaccctggcatcaaattccactatggccctgacacttactttggcaacgaggtttctattctggagatggacggccaatttgatagattagatgaacttatttatgttgaaagccatttgagcaacatctccaccaagttctatggagaagtcacccagcaaatgttgaagcatgcggatttcccaggaagtaacaacggaactggcctcttccagaccattgtcggattgaagataagagatctctatgagcaaattacttccagcaaaactgcagctccactagaagcaacaaaagcctaagattattagagtttcttcatacattggactagaccttgggtccataaccaattatcctctttccagctttcctctatcgaaggtttatttgagtgttaggctgttgttgctttcataagagtcgagtatgatcctgtgcatttattttatgtttgtaattcagtggagatatgtaatatagagaagcaaaatcagagttcaatttcaacattgagaagttcatataagacaaagcctttcgacatcatctctccacttctatttccccctattgctgcttcttgttgtaagttgtaaccatttatgatgtcaagatcattggttttcttactccaaataaagaggatttggctatggaagcgtagccataa

SEQ ID NO: 1327 - DNA, 1940 bp, Citrus sinensis
caaatgccatgccattacctcatcatctcatcaacaattccatccccccctctttttcaattattatttttgcattttctgaggtagccaagttaaataaaatgacacttataccccctcccataatcacttaatcccattcactgccccttctttttctctccttttaacatcacctccaaaatttgtccaaaccaaagggtactcacagaaacccataaaactaaaacaaataacacatcactcttccatgacagcaagtaaaactgcttgctttccaaactgccatctgttttctttcatcccatgatttttgtcctttcaattatatatacttgtgctccaaaattttcctcttaaaaatctaaataagattccaaaaggtatcccatctcatcattttcatgtctcatttcagaatttagctgaaagaatcctaaaacgttcatttctgctctagcagcagcatccctcaccgagccaaaaaaaaaagagaaagaaaatggccatttccctcaactcaccatgctctctttactcgccaacaaaaacccacttgggttttttcaacaaccaaagacaactagcggttttttacaacaagagaagcagcagcagcagcagcagtagcagcagcaagcagagaggatgtcttgtgataacatgctcagcaggtgactcacagacaattgtgattggtctggcggcagactcggggtgtggcaagagcactttcatgaggagactaacaagcgtctttggtggagcagcagagccaccaaagggcggcaaccctgattcaaacactctcatcagtgaaaccaccactgtgatttgcttagatgattatcactcgcttgacagaactggaagaaaagaaaagggtgtcactgcacttgatcctagagccaacaattttgatcttatgtatgaacaggttaaggctatgaaagatggagtgtctgttgaaaagcccatttacaatcatgtcaccggtctcttggacccccccgagctcatcaagccccccaagatccttgtcattgaaggcttgcacccaatgtatgatgctcgggtgagagagctcttggactttagtatctatttggacattagcaatgaggttaaatttgcatggaaaattcagagagacatgacagagcgaggacacagtcttgagagcatcaaggctagtattgaagcccgaaagccagattttgatgcctatattgatccacaaaagcaatatgctgatgcagtgattgaagtgttaccaacccagttgattccggatgataatgaaggaaaggttttgagagttaggttgatcatgaaagaaggagtgaagtacttcagcccggtttatctgtttgatgaaggatcaactatcgaatggataccttgcggaaggaagcttacatgttcttaccccggcatcaaattctcttatggccctgacgcttactttggccatgaggtctcgattttggaaatggatgggaaatttgacaggttagatgagctaatttatgtcgaaagccatctaagcaacttatcaaccaagttctatggagaagtcacccagcaaatgttgaagcatgccgatttccctggcagcaacaacggaaccggtctcttccaaactatagttggattaaagattagggatctctacgaacaaatcatcaccagcaaggctgcggctccggtagaagcgaaagcttaaacactgccttgtaatattaaacaaggcaacacagataagttgccaaaaatccatctattcttttccgagtcccttttcttgtttcagttgagtgctaggccagcattttcctcttaagatactcctatgtatgtatttatttcatgttgtaatctatgaacactttgttaataactcaatatagagatgcaaaagcagagaagaaattcaatca

SEQ ID NO: 1328 - DNA, 1543 bp, Primula obconica
gattcttccctctctctcaaaatccagagagagagagaccaagaaaaatggcaatctccactgcttgctcaactcactactccctcaactcaacatactcaatctcaacacccacaaaaacccacctaggttcaacccaaacaagtactttctacaccacaaccaagaaaaacaccacaaaacatacaaacacaacaacaatatcatgctctcaaaaaacagtagttatcggcttagccgcagactcgggatgtggaaaaagcactttcatgaggagattaacaagcgtttttggtggggccgctgagccacctaaggggggtaaccccgattctaacacgcttataagcgatacgacgactgttatatgtttagatgattatcattcacttgataggacaggtagaaaagtggaaaaggtcactgcacttcacccaaaggcaaatgactttgatctaatgtatgagcaagtgaaggctattaaggatggtgtggctgtggataagcctatttataaccatgttagtgggttattagaccctcctgagcttattaagcctcctaagatccttgtcattgaagggctgcacccaatgtatgatgaacgtgttagggaccttttggacttcagcatctacttggatattagcaatgaggtcaaatttgcatggaagattcagagggacatggcagaaagagggcacagccttgaaagcatcaaagctagtattgaagcaaggaaaccagattttgatgcttacattgacccgcagaagcaatatgccgatgcagtgatagaggtgttgcctacgcaattgataccagatgacaatgagggaaaagtgttgagagtgaggcttataatgaaagaaggggttaaatttttcaacccagtgtatctctttgacgaaggctccaccattaactggataccttgtgggagaaaactcacttgctcataccccggtatcaagttctcatatggccccgagagctactacggccatgaggtgtcagttgtcgagatggatgggcaattcgacagattagatgagctaatctacgttgagagccacctcagcaatatctcaaccaagttctatggagaaatcacccaacaaatgctaaagcactcagatttcccaggtagtagcaatggcactggtcttttccagaccattgttggcctaaagatcagagacctctacgaacaaatcatcgccagcagagcagcagctccactcgaagcgacaaaagcctaaaaagaagaacgagacttctatgttaataagccaaggcatgtacttacttcctattttttgtctcacgatatttgatgtttcggttgagtgctgggctgttaatcgaaaacaatgcgaaaactcaaacagtttgtatattagtggttgaatttgtggagactacttgtgaaatagaaaaccaaaagctgaaataatgcaattaagaaagaacaaggaacttgggaacctatcagcatgtgtaactgcatttgcagcttgaaatacattacttctaatgctta

SEQ ID NO: 1329 - DNA, 1796 bp, Triticum aestivum
cttttcgtagtaagaaagctcagcgtccagggaaagaatacaggcaaaacacgattgtttcattttcagatcactataagctggccctgatatcaccagaattccagaaaagaaaaagagaaaaaaggggaaatagggacaccacatcatcaccatctcatttccctccttatgttctcttggctcttatctccacagttctttcatcaagctctctcttccccccaagtctcagttacaagacttgaaggggagaagagcagctccaagaggttgggcagcaaacatggcattctgcagcccacacaccaccacatccctgcgctccccatgcaccaccatcccaaactcaggcttcaggcagaaccaagtcatcttcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcaccagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtatgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccggtttacctcttcgatgaaggatcaaccatcaactggatcccttgtggaagaaagcttacatgctcttaccctggcatcaaattttcctatggcccagacacttactttggccaagaggtatcggtgctggagatggacgggcaatttgacagactagatgaactcatctatgttgagagccacctaagcaacctctcaaccaagttctacggggaggtgacacagcaaatgctaaagcatgcagactttccaggcagcaacaatggaacaggtctcttccagaccatcgtaggactgaagattagagatctctatgaacagatcatcgctgagagggccggcgttcctgctgaagcagcaaaagtttgatcagccccaaattcaagttcacaaatcatttcatcaccaactcaatgagaatgagcatcctcccatttcttgtacctagtttgaatatattacagctagaagacggtagaaagttcactgcagaactcatgaaaacctgcattttgaacttctcgaaaatcctctccatgatgagggtctcttatgtctcttcttaacacatttcgatgtacatcttctcccatgtttcaatgcagaaaatacatgtgtttgctagaatcaaaagcggctgcttttatctagcgtgtcctttttt

SEQ ID NO: 1330 - DNA, 1655 bp, Triticum aestivum
catctcatttccctcttatgttttcttggctcttatctccacagttctttcatcaagctctctcttccccccaagtctcagttacaaggcttgaaggggagaagagcagctccaagaggttgggcagcaaacatggcattctgcagcccacacaccaccgcatccctgcgctccccatgcaccaccatcccaaactcaggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcaccagcgtgtttggaggtgccgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagggagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccagtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccatcgtaggactgaagattagagatctctatgaacagatcatcgctgagagggccggcgttcctgctgaagcagcaaaagtttgatcagccccaaattcaagtccacgaatcgtttcatcaccaactctatgagaatgagcatcctcgcatttcttgtacctagtttgaatatattacagctagaagacggtagaaagttcactgcagaagtcatgaaaacctgcattttgaacttctcgaaaatcctctccatgatgagggtctcttatgtctcttcttaacacatttcaatgtacatcttctcccatgtttcaatgcagaaaatacatgtgcttgctagaatcagaagcggctgcttttatctaacgtgtcccttttttggctgttactgc

SEQ ID NO: 1331 - DNA, 1662 bp, Triticum aestivum
gggaaatagggacaccacatcatcaccatctcatttccctccttatgttttcttagctcttatctccacagttctttcatcaagctctctcttctccccaagtctcagttacaacttacaaggcttgaaggggagaagagcagctccaagaggttgggcagcaaacatggcattctgcagcccacacaccaccacatccctgcgctccccatgcaccaccatcccaaactcaggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcaccagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagggagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccagtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccatcgtaggactgaagattagagatctctatgaacagatcatcgctgagagggccggcgttcctgctgaagcagcaaaagtttgatcagccccaaattcaagtccacgaatcgtttcatcaccaactctatgagaatgagcatcctcgcatttcctgtacctagtttgaatatattacagctagaagacggtagaaagttcactgcagaagtcatgaaaacctgcattttgaacttctcgaaaatcctctccatgatgagggtctcttatgtctcttcttaacacatttcaatgtacatcttctcccatgtttcaatgcagaaaatacatgtgcttgctagaatcagaagcggctgcttttatcta

SEQ ID NO: 1332 - DNA, 1608 bp, Triticum aestivum
ttctttcatcaagctctctcttctccccaagtctcagttacaacttacaaggcttgaaggggagaagagcagctccaagaggttgggcagcaaacatggcattctgcagcccacacaccaccacatccctgcgctccccatgcaccaccatcccaaactcaggcttcaggcagaaccaagtcatcttcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcaccagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtatgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccggtttacctcttcgatgaaggatcaaccatcaactggatcccttgtggaagaaagcttacatgctcttaccctggcatcaaattttcctatggcccagacacttactttggccaagaggtatcggtgctggagatggacgggcaatttgacagactagatgaactcatctatgttgagagccacctaagcaacctctcaaccaagttctacggggaggtgacacagcaaatgctaaagcatgcagactttccaggcagcaacaatggaacaggtctcttccagaccatcgtaggactgaagattagagatctctatgaacagatcatcgctgagagggccggcgttcctgctgaagcagcaaaagtttgatcagccccaaattcaagttcacaaatcatttcatcaccaactcaatgagaatgagcatcctcccatttcttgtacctagtttgaatatattacagctagaagacggtagaaagttcactgcagaactcatgaaaacctgcattttgaacttctcgaaaatcctctccatgatgagggtctcttatgtctcttcttaacactatttcgatgtacatcttctcccatgtttcaatgcagaaaatacatgtgtttgactacgaatacaaaagtcggctgcttttacctagcgtagtaacct

SEQ ID NO: 1333 - DNA, 1634 bp, Theobroma cacao
ggaaatcaaaggacaagaatccaaactcgtttttgcttggtcttagaggaccatctaaacaatttgccagggcatcccatttcagtaatctctctctgtctcgaagctctctaaattcccctttccggggcagacagaagaggagaaaaaaagagagctaagaaatggcagtctgcacagtatacacaactcaatctctcaattcgacatgttcaatctccacaccaacgaaaacccacttgggttttcaccaaaagcaggtggtgttctacagcactggcaagagaactagcaaaagaggtagcagcagcagcggcggcccgtgtgtcataacctgctcagctgttgattcacaaacagttgtgattggtctggctgcagactcaggatgtgggaagagtaccttcatgagacggctaacaagtgtgtttggtggtgcagcagagccacccaggggaggcaaccctgactcgaacactctcatcagtgacatgaccaccgtgatttgcttggatgattatcattcacttgacagaactggaaggaaagagaagggagtgacagcacttgacccaagagctaacaactttgacctcatgtatgagcaagttaaggctctcaagagtggtgttgctgttgacaagcctatttacaaccatgttactggtctcttggatcctcctgagctcattaagcctcctaagatccttgtcattgaaggactgcaccctatgttcgatgagcgtgtgagggatctgttggacttcagtatctatttggatatcagcaatgaggtcaaatttgcatggaaaattcagagggacatggctgaaagagggcatagccttgaaagcattaaagctagtattgaagccaggaagcccgatttcgatgcctttattgatccacaaaagcaatatgctgatgcagtaattgaagtgctgccaactcagctcatcccaggagacaacgagggaaaggttttgagagtgaggctgataatgaaagaaggggtgaagcatttcagcccggtttatctgtttgatgaaggctcaaccctctcatggataccatgcggaaggaagctcacttgctcttaccctggcatcaaattccattacggccctgacacttactttggcaacgaggtttctattctggagatggacgggcaatttgacagattagatgaactcatttacgttgaaagccatttgagcaacatttctaccaagttctatggagaagttacccagcaaatgttgaagcatgctgatttccctggaagtaacaacggaaccggcctgttccaaaccattgttggattgaagataagagatctgtatgagcaaatcaccacaagcaaaactgcaactccactagaagcaacaaaagcctaaagagctgcctttggggttcataaaattatatcctcttttcagttttcgcctttccacttcctcccttcttcacgtttgactcttgagcgttaggctgttcctctcataagaattgagttatactcttttgtatttattgtctgttgtaattctgtggagatatgtaatatggagaaacaaaaatcagagatcaaattcaagttaagaagttcatagaagacgaagcttttgaca

SEQ ID NO: 1334 - DNA, 1559 bp, Solanum lycopersicum
agtaagtcagtgagcacacaaaaataaaaaataaaaaagcttcctccataattctatctcaaaaacctctcaagaaacagagagatagaggggcaaaaataaaaaaaatggcagtttgtacagtgtacactgctcaatcactgaattcatcttgttcaatttcaactccatcaaaaccccacttaagatttcaccagaaacaagtaattttcctaacaaaaagaccaaggaagatgacatgctctgcttcctctgacggtgaaaaaacagttgtaatcggtctagcagctgattctggttgtggtaaaagtacatttatgagacgattaaccagcgtctttggtggcgctgctgaaccaccgaaaggtggaaatccagattcaaacacattgatatcagacatgactactgtcatttgtcttgatgattatcattcacttgacagaactggtagaaaagaaaaaggggtaactgctcttgatccaagagctaatgattttgatctaatgtatgaacaagttaaagctattaaagatggggttcctgttgataaacctatttataatcatgttagtggtcttcttgatcctcctgaggttattaagcctccaaagattcttgtcattgaaggattacaccccatgtacgatgagcgtgtgagagacctcttggacttcagtatctacttggatatcagcaatgaggtcaagtttgcttggaagatccagagggatatggctgaaagaggacacagccttgagagcattaaggccagtattgaagctaggaaaccagattttgatgcttacattgatccacaaaagcaatatgcagatgcagtcattgaagtgctcccaactcagctaatcccagatgacaatgaaggcaaagttttgagagtgagattgataatgaaggaaggagtgaagaacttcaatccagtttacctgtttgatgaaggatcgacaatctcatggattccttgtggcaggaagttgacttgttcttaccctggcatcaaattcacctatggccctgacacctactttggcaatgaggtatctgtcttggagatggatggccaatttgacagactagatgaactcatctacgtggagagccatttgagcaacctctccagcaaattctatggtgaagttactcaacaaatgttgaagcatgcagacttccctggcagcaacaatggaacaggtttcttccagaccattgtcggtttgaagatcagagacctctacgagcaaatcgttgccagcagagctggagctccagtcgcagctgcaaaggcctaaactttgccaaactatattaacagctaggccccagaatcatctgttgtacctagttgtttcccttcttccctaaattttatttgccgacttcttttctccactttcatgtctcagtttcatggtagataattccccataattgagaaaatacactttgttatgtatttatttgtagctggaaatgtgttgagagttgtaacatggacaataaaatggtgaaatgaatttcaattccaaacagtttctgca

SEQ ID NO: 1335 - DNA, 1337 bp, Triphysaria pusilla
aaaaataaaattatttaaaaagccaaattttcatgaaaaatcacactctctaaataacactcactaatctcctagagagtgaagaagaagaaaaaatggcagtttgtacagtctacacagttcaatccctaaactcaatctcaacaccaccaaaaacccacttaggattcaaccaaaaacaagtgttcttctacagcacaaccaagaaaccgataaaatccaagtctttttcgactgaaatatcttgctcagccgatgacaagactgtagtaatcggcctggcagccgactctggctgtggaaagagcactttcatgcggcggctcacaagcgtgtttggcggtgcggctgaaccgcccaagggcggcaacccggactcgaacacgcttataagcgaaatgacgactgtgatttgtttggatgactatcattcattggacagaaccggacggaaggaaaagggagtcactgcattggatccaagagctaatgactttgatcttatgtatgagcaggttaagtctattaagaatggtgttgctgttgagaagcctatttataatcatgtcactggtttattggacccgccggagctgattaagtctcccaagatttttgtcattgaaggattgcatccattgtacgatgcacgagtgagggatcttttggacttcagcatttacctggacatcagcaatgaagttaaattcgcatggaaaattcagagggacatggctgaaagaggacacagcctcgaaagcatcaaagctagcatcgaagcccgaaaaccagatttcgatgctttcattgacccacagaagcaatatgcggatgcagttatagaagtgttgcctacacaactcatccctgatgacaatgagggcaaatacttgagagttagattgatacaaaaagaaggggttaaatttttcaacccggtttacctctttgacgaaggctccaccatctcatggataccctgtggtcgcaagctgacgtgctcatacccgggcatcaagttcacttatggccccgacacttactatggcaatgaggtctcagtgttggagatggatgggcaattcgacagactagacgagctcatctacgtggaaagccatctgagcaacctttcgtccaaattctatggcgaagtaactcagcaaatgcttaagcacgcagatttcccaggcagcaacaatggcaccggtcttttccagaccatcgtcggcttgaagatcagagacctttacgagcagcttactacaaccaaaacaagcaaaaccgcagctccattgaaagctacaaaggcctaaataaatatcctattttttccc

SEQ ID NO: 1336 - DNA, 1282 bp, Flaveria ramosissima
atttaaaaacctattttctcattctatctctctcttaacattcttcacaaagtttagagggaaaaaatggcagtgtccacagtgtacacagcccaatctctcaactcaacatgttcaatctcaacacccacaaaaacccatttgggaattcagcaaagacaagtgttgttctatactaaaaagaccaataggggcagggtgaggggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccacgacagtcatatgtttggatgattaccattcattggatagaacagggaggaaggtggaaggggtgacagcacttgatccaagagccaataactttgatcttatgtatgagcaagttaaggctttgaaagatggtattgctgttgaaaagcccatttataaccatgttagtggtcttttggaccctcctgagaccatcaagccacctaagatccttgtcattgaaggtttgcacccaatgtatgatcagagagtaagagacctcttggatttcagtatctacttggacatcagcaatgatgttaaatttgcctggaaaattcagagggacatggcagaaagaggacacagccttgaaagtatcaaagctagtattgaggccagaaagccagattttgatgcttatatcgacccgcaaaagcaatatgcagatgctgttatagaagtgttgcctacacagctcattccaggtgacaatgaggggaaggtgttgagagtcaagctgataatgaaagagggagtgaaatacttcagccctgtttacttgtttgatgaaggctccaccatctcatgggttccatgtgggaggaaactcacctgttcttaccctggtatcaaatttgcctatggccctgatacttactacggtcatgaggtctctgtgttggagatggacgggcaatttgacaaactggatgagcttgtctatgttgagaaccatttgagcaacatttccaccaaattctatggagaaatcacccagcaaatgttgaagcattcagatttccctggtagcaacaatggcactggtctcttccaaaccattgttggtttgaaaatcagagatctctttgaacaaatcacagccagcaaggcctcggctacattggaagctacaaaagcttaaactaaag

SEQ ID NO: 1337 - DNA, 1385 bp, Flaveria ramosissima
catttaaaaacctattttctcattctatctctctcttaacattctttacaaagtttagagggaaaaaatggcagtgtccacagtgtacacagcccaatctctcaactcaacatgttcaatctcaacacccacaaaaacccatttgggaattcagcaaagacaagtgttgttctatactaaaaagaccaataggggcagggtgaggggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccaccacagtcatatgtttggatgattaccattcgttggatagaacagggaggaaagttgaaggggtgacagcacttgatccaagagccaataactttgatcttatgtatgagcaagttaaggctttgaaagatggtattgctgttgaaaagcccatttataaccatgttagtggtcttttggaccctcctgagaccatcaagccacctaagatccttgtcattgaaggtttgcacccaatgtatgatcagagagtaagagacctcttggatttcagtatctacttggacatcagcaatgatgttaaatttgcctggaaaattcagagggacatggcagaaagaggacacagccttgaaagcatcaaagctagtattgaggccagaaagccagattttgatgcttatatcgacccacaaaagcaatatgcagatgctgttatagaagtgttgcctacacagctcattccaggtgacaatgaggggaaggtgttgagagtcaagctgataatgaaagagggagtgaaatacttcagccctgtttacttgtttgatgaaggctccaccatctcatgggttccatgtgggaggaaactcacctgttcttaccctggtatcaaatttgcctatggccctgatacttactacggtcatgaggtctctgtgttggagatggacgggcaatttgacaaactggatgagcttgtctatgttgagaaccatttgagcaacatttccaccaaattctatggagaaatcacccagcaaatgttgaagcattcagatttccctggtagcaacaatggcactggtctcttccaaaccattgttggtttgaaaatcagagatctctttgaacaaatcacagccagcaaggcctcggctacattggaagctacaaaagcttaaactaaagaaacaataaagaaagacccttagaatcttctttcctccactaaccttttttcatagtaaattctgagtgttaggctttatcacgagtctctcccatatgtat

SEQ ID NO: 1338 - DNA, 1566 bp, Pteridium aquilinum
cccgaactcttaaaccaaactttagtccacgggcgatcccactttctagtaatactctctctgtctcgaagctctctaaattccctttccgggcagacagaagaggagaaaaaaagagagctaagaaatggcagtctgcacagtatacacaactcaatctctcaattcgacatgttcaatctccacaccaacgaaaacccacttgggttttcaccaaaagcaggtggtgttctacagcactggcaagagaactagcaaaagaggtagcagcagcagcggcggcccgtgtgtcataacctgctcagctgttgattcacaaacagttgtgattggtctggctgcagactcaggatgtgggaagagtaccttcatgagacggctaacaagtgtgtttggtggtgcagcagagccacccaggggaggcaaccctgactcgaacactctcatcagtgacatgaccaccgtgatttgcttggatgattatcattcacttgacagaactggaaggaaagagaagggagtgacagcacttgacccaagagctaacaactttgacctcatgtatgagcaagttaaggctctcaagagtggtgttgctgttgacaagcctatttacaaccatgttactggtctcttggatcctcctgagctcattaagcctcctaagatccttgtcattgaaggactgcaccctatgttcgatgagcgtgtgagggatctgttggacttcagtatctatttggatatcagcaatgaggtcaaatttgcatggaaaattcagagggacatggctgaaagagggcatagccttgaaagcattaaagctagtattgaagccaggaagcccgatttcgatgcctttattgatccacaaaagcaatatgctgatgcagtaattgaagtgctgccaactcagctcatcccaggagacaacgagggaaaggttttgagagtgaggctgataatgaaagaaggggtgaagcatttcagcccggtttatctgtttgatgaaggctcaaccctctcatggataccatgcggaaggaagctcacttgctcttaccctggcatcaaattccattacggccctgacacttactttggcaacgaggtttctattctggagatggacgggcaatttgacagattagatgaactcatttacgttgaaagccatttgagcaacatttctaccaagttctatggagaagttacccagcaaatgttgaagcatgctgatttccctggaagtaacaacggaaccggcctgttccaaaccattgttggattgaagataagagatctgtatgagcaaatcaccacaagcaaaactgcaactccactagaagcaacaaaagcctaaagagctgcctttggggttcataaaattatatcctcttttcagttttcgcctttccacttcctcccttcttcacgtttgactcttgagcgttaggctgttcctctcataagaattgagttatactcttttgtatttattgtctgttgtaattctgtggagatatgtaatatggagaaacaaaaatcagagatcaaattcaagtt

SEQ ID NO: 1339 - DNA, 1739 bp, Solanum lycopersicum
agtcacagaaatccaaatcaacacacttcactatccaaacaaaacagccataaccatagccattaacttcttacaaaaaaattctaagcctcacatattttttttctccaaaatatcctaaaaaccaaaaaaaaaatttaatttttttttaaaaaaaatgcccattcattaatctatcagtaagtcagtgagcacaaaaaataaaaaataaaaaagcttcctccataattctatctcaaaaacctctcaagaaacagagagatagaggggcaaaaataaaaaaaatggcagtttgtacagtgtacactgctcaatcactgaattcatcttgttcaatttcaactccatcaaaaccccacttaagatttcaccagaaacaagtaattttcctaacaaaaagaccaaggaagatgacatgctctgcttcctctgacggtgaaaaaacagttgtaatcggtctagcagctgattctggttgtggtaaaagtacatttatgagacgattaaccagcgtctttggtggcgctgctgaaccaccgaaaggtggaaatccagattcaaacacattgatatcagacatgactactgtcatttgtcttgatgattatcattcacttgacagaactggtagaaaagaaaaaggggtaactgctcttgatccaagagctaatgattttgatctaatgtatgaacaagttaaagctattaaagatggggttcctgttgataaacctatttataatcatgttagtggtcttcttgatcctcctgaggttattaagcctccaaagattcttgtcattgaaggattacaccccatgtacgatgagcgtgtgagagacctcttggacttcagtatctacttggatatcagcaatgaggtcaagtttgcttggaagatccagagggatatggctgaaagaggacacagccttgagagcattaaggccagtattgaagctaggaaaccagattttgatgcttacattgatccacaaaagcaatatgcagatgcagtcattgaagtgctcccaactcagctaatcccagatgacaatgaaggcaaagttttgagagtgagattgataatgaaggaaggagtgaagaacttcaatccagtttacctgttcgatgaaggatcgacaatctcatggattccttgtggcaggaagttgacttgttcttaccctggcatcaaattcacctatggccctgacacctactttggcaatgaggtatctgtcttggagatggatggccaatttgacagactagatgaactcatctacgtggagagccatttgagcaacctctccagcaaattctatggtgaagttactcaacaaatgttgaagcatgcagacttccctggcagcaacaatggaacaggtttcttccagaccattgtcggtttgaagatcagagacctctacgagcaaatcgttgccagcagagctggagctccagtcgcagctgcaaaggcctaaactttgccaaactatattaacagctaggccccagaatcatctgttgtacctagttgtttcccttcttccctaaattttatttgccgacttcttttctccactttcatgtctcagtttcatggtagataattccccataattgagaaaatacactttgttatgtatttatttgtagctggaaatgtgttgagagttgtaacatggacaataaaatggtgaaatgaatttcaattccaaacagtttctgcacaa

SEQ ID NO: 1340 - DNA, 1681 bp, Citrullus lanatus
gaaacaatataacaaaccaaagccaaatcccacaccctcatttcatttctcctccatacacaagaagataaggagaaaaagaaagcacccccaccccaaccccaaccccaacccaccaaaaataacacccaaataaaccaccttcttcttcttcttcactccctcaactactgagagagagagagagaagaaaaaagaaaaaatggcagtttgtacagtgtacacaacccaatctctaaactcaaccttctcctcatcaacaaaatcccacttgggattccaccaaaaaagcctagttttcttgagtagcaatgggaagaaatggggaagcagcaataaaagagatggtcacagcactgtgactaacaacaactcttacttgataacctgctctgcaggtgaccaacagacagtagtaattggtttagcagcagattcaggttgtgggaaaagcactttcatgagaaggctaacaagtgtatttggaggagcagcagagccaccaaagggtggtaatccagattcaaacacactcatcagtgatactactactgtcatttgtttagatgactatcattcattagacagaacaggtagaaaagagaaaggagtcacagcacttgacccaagagccaatgattttgatctcatgtatgaacaagttaaggcaattaaaaatggtgtctctgttgagaagcccatttacaatcatgtcactggccttcttgaccctcctgagctcattaaaccccctaaaatccttgtcattgaaggtttacaccccatgtatgattcaagagtaagagacctgttggacttcagtatctacttggacatcagcaatgaagttaaatttgcatggaaaattcagagggacatggctgagagaggacacagtctggaaagcatcaaagcgagtatcgaagcccgaaaacccgactttgacgcctatatcgacccacagaagcaatatgcagatgcagtgattgaagtgttgccaacaaaactgattccagatgataatgaaggaaaagttttgagagttaggctgataatgaaggaaggggtggaattttttaacccagtttacttgtttgatgaaggctctacaatttcatggataccatgtggaagaaagctcacttgctcttaccctggcatcaaattctcctatggccctgaaacttactatggccatgaggtatcagtgctggaaatggacgggcaattcgacagattggatgagctaatctatgtggaaagccatttaagcaacctgtcgacaaaattctatggtgaagtgactcagcagatgctgaagcattcggacttccctggaagcaacaatggcacaggcttcttccaaactatagttggattgaagatcagagatctgtacgagcagatttccgccagcagggtcaaggcgccggttcaagctgcaaaagcctgaaattagggcatccagccaggaggaggattttctcaggcgttaccccatttctggatttgcctttcaaattcaagctttgtgtttattaggctgttttacaatgaaattgttgctctgaatttcctgatctctggagatttgtattgtaaaagaaaaaaaaaaaaacaaaaaccccaaaagaaatgaatcgaaagtagaattgaaacccaaattgtaccagtttcgatt

SEQ ID NO: 1341 - DNA, 1547 bp, Festuca arundinacea
ctcaagtcccagttacaaggcttgaagggaagaagagcagctccagcaggagcaaaggttgggcagcaaacatggcattctgcagcccacacaccaccacatccctgcactccccacgcaccactatcccaaactcaggcttcaggcagaaccaagtcatcctcttcacgaccagaagcagcaggaggagtaacacgaggaatggagcaaggaccttccaggtttcatgcgcagttgacaagccaatagtgattggcctggcagcagactcaggatgtgggaaatccaccttcatgcgccggctcaccagtgtgtttggaggtgctgcagagccacccaggggcgggaacccagactcgaacacgctcatcagcgacaccacaacggtgatatgccttgatgactaccattccttggacagaaccgggaggaaggagaaaggtgtgaccgccctggaccccaaggcaaacgactttgatctcatgtatgagcaggtgaaggcaatcaaagaaggccaggctatcgagaagccaatctacaaccatgtcaccggcctcctggacccagcggagctcatccagccccccaagatcttcgtcatcgagggtttgcacccaatgtacgacgaacgtgtgagagacctccttgatttcagcatctacttagacatcagcaatgaggttaagtttgcatggaaaattcagagagacatggcagagcgtgggcacagccttgaaagcatcaaggctagcattgaagccaggaaaccagatttcgatgcatttatcgatccgcagaagcaatacgccgatgctgtgattgaagtcctgccaacccagctgattcctgatgacaatgaaggaaaggtgctgcgtgttaaattgatcatgaaagaaggcgtgaagttcttcaacccggtttacctcttcgatgaaggatcaaccatcaactggatcccttgtggaagaaagcttacgtgctcttaccctggcatcaaattttcctatggtccagacacttactttggccaagaggtatcggtgctggagatggatgggcaatttgacagactagatgaactaatctatgttgagagccacctaagcaacctctcgtccaagttttacggggaggtgacacagcaaatgctaaagcatgcagatttcccaggcagcaacaacggaacaggtctcttccaaactatcgtaggtctgaagattagagatctctatgaacaaatcattgctgagagggtcggcgcacctgctcaagcagccaaagtttgatgagccccatattcagatttcacaaatcatttcatcaccaactcaatgagaatgagcatcctcgctgcttgtaactagtttggaaatattacagctaggagatggtagaaagttcattgcagaaactcatgaaaacctgcacttgaacttctcgaaaaccctttccacgaggggactcctacatctcctgttaacacatttcaatgtacatcttctcccacgtttcaatgcagaaaatacatgtgcttgctatattaaaag

SEQ ID NO: 1342 - DNA, 1715 bp, Oryza sativa
atcatcatcctctctcctccttatgttctcctagctctatccccacaattctttcaacctcctctctcttctcatcaagcctcaatcaaaaggcttgaagggaagaagagcaactccagcaggtagaaaggccagaagcaaagatggcgatctccagcctacatgccaccacctccctgcactccccatgcaccaccaacacaagcttcaggcagaaccaggtcatcttcttcaccaccagaagcaacaggaggggtagcacaaggtacggaggagcaagaacctttcaggtttcatgctcagtcgacaagccagtggtgattggccttgcagcagactcaggatgcgggaagagcaccttcatgcgccggctcaccagtgtgtttggtggtgctgcagagccacccaagggtggcaacccagactcaaacacactcatcagtgacacgacaacggtgatatgcctcgatgactaccattccttggacaggactggcaggaaggagaaaggtgtgactgccctggaccctagggcaaacgattttgatctcatgtatgagcaggtgaaggcaatcaaagaaggcaaggcaattgagaagccaatctacaaccatgttactggtctcctagacccaccggagcttatccagccccccaagatttttgtcattgagggcttacatcccatgtttgatgaacgtgtgagggacctcctagatttcagcatctacctggacatcagtgacgaggttaaatttgcatggaaaattcagagggatatggcagagcgcggtcacagccttgaaagcatcaaggctagtatcgaagccaggaaaccagattttgatgccttcattgatccccagaagcaatatgctgatgcagtgattgaagttctgccaacccagcttattcctgatgacaatgaaggaaaggtgctacgtgttaaattgatcatgaaagaaggtgtaaagaacttcaacccagtttacctcttcgacgaaggatcaagcatcacctgggtcccttgtggaagaaaactcacatgttcttatcctggcatcaaatttgcctatggcccagacacttactttgggcatgaggtatcagtgctggagatggatggccaatttgacagactagatgagcttatctatgttgagagccatttaagcaacctctcaaccaaattttatggagaggtgacacagcaaatgctaaagcatgcagacttccccggcagcaacaatggaacaggtctcttccaaactatcgtaggactgaagattagagatctctatgagcagattattgctgagagggccggtgcacctactgaagcggcaaaagtttaatgagctccacattcatatttcgtgaatctcttcatcaccataccatatcaatgacaatgggcatcctcgcatttcttgtaactagttttggaaatattacagctagaagaaagtaggatggtcattgcataacttgtgaaaccatgcaatggaacttctaaaaatccctctccatgagggtgctcctacatctcttcttgacacatttcaatgtacatcttctatatttcaatgtagaaagaaatacggttgctttctactataaaaaataggtccttcctttagtgcctctcttgttggctattgcttctggtcataagtcaacaacatatgatcgacaagggaagaaaatacagacgg

SEQ ID NO: 1343 - DNA, 1640 bp, Artemisia annua
ctaccttaatatcacctccaatttgtccaaaaccaagggtagtcatagaaacccataaagctataatgacaccccatatccattgttaacctcattcctatataatgaagatttttctgctaaacataagttgtaacatgttcatgtaaagttgcacattgcctttttggaccatacctttttcttaattttgtgtatatgagtatacccctatgatcacttaaaagaaaataacctaacagaaccttgattatcccattaaaaagatccaaccttttttctctctaaactttaagaaacaatggcagtgtgcaaagtgaacacagtactccatactccaaactcaatgaactcaatctcaacaccaacaaaaccaatatgggattcaatcaaaaccatgtttttctatacacaactagtggcaaaaagactaatacttgcaagtttagaagtggtgtgatcacatgctcaggagacacaatagtaattggactagcagccgattctggttgtggaaaaagcacttttatgagaaggttaacaagtgtatttggtggtgcagcttcaccaccaaaaggtggtaaccctgattccaatacacttataagtgatacaacaactgttatatgtttagatgactatcattcattagatagaacaggaagaaaacaaaaaggtgtaactgcacttgatccaagagctaatgactttgatcttatgtatgaacaagttaaggctcttaaagatggtaaggctgtcgaaaagccgatttataaccatgtttcaggtcttttggaccctcctgagcttattataccacctaagatacttgtcattgaaggtttgcatccaatgtatgatgaaagagtaagagaccttttggacttcagtatatacttggacatcagtaacgaggttaagttcgcctggaaaattcagagggacatggcagagagaggacacagtcttgaaactattaaagcaagcattgaggcccgaaaaccggattttgatgcttatattgacccgcaaaagcaatatgcagatgcagttattgaagtgttgcctacacaactgattccggacgataacgagggaaaagtattgagagtgaagctcatcatgaaagaaggagttcaatactttaatcccgtttacttattcgatgaaggttccaccatttcatggatcccatgtggaagaaagctcacttgctcgtatcctggcatcaaattcgcctatggtccagatgcttatttcagtcatgaggtttctgttttggaaatggacgggcagtttgacagattagatgaacttgtctatgtcgaaagccatttaagcaacatttcaacaaaattctttggtgaaatcacgcaacaaatgttgaaacatgctgactttcctggtagtaacaatggaactggtttgtttcaaaccattgtcgggttgaagatccgagatttgtttgaacaaatcacaaccaacaaggtctcggctccatttgaagctgcaaaagcatgatcatatttaattatgagtgttgtgaccccttatgtatttaagtccgtttgtgtattgttgcatggagatttgtataatatacagatatcacttcataaataaaatcctaattaagacca

SEQ ID NO: 1344 - DNA, 1612 bp, Linum usitatissimum
gcacacaaaaaaaaagacatatggatccacacaaaccaactcaaaaaacctccatatctctctctcacacaaaagagagctagtatagtgctagtacatactagctctactcttttcaacaatggcgatatgcacatctcacttcctaacctcctcaacaactctaaaccaccttaaccaacccgaaccaatcctcttccggaccacccgccaccattacaccccgcgccgccaaacccacctaaccatatcatgcgctgcggcccacgacacggtggtcataggcctggcggcggactcggggtgcgggaagagcaccttcatgaggcggctcaccagcgtcttcggaggcgcggccgagccgcccaaggggggcaacccggactccaacacgctcattagcgacaccacgaccgtcatttgccttgacgactaccactccctcgacaggaccgggaggaaggagaagggtgtgacggcgcttgaccctaaggcaaatgactttgacctcatgtttgaccaggtcaagaagctgaaagacggcgtggcggttgataaaccgatttataaccatgtttccgggttgctcgacccggctgaggttatccagccgcccaagatcctcgtcattgaaggtctccacccaatgtacgacgaacgggtgagaaagctactcgactttagtatctatttggacatcagcaatgaggtcaaattcgcttggaaaatccagagagacatggcagagagagggcatagcttggagagcatcaaggcgagtatcgaggctcgcaagcccgatttcgacgcctacattgacccgcagaagcagtacgctgacgcggtcatagaggtgcttcccacgaagctgatccccgatgacaacggaggcaaagtgttgagggttaggttgatcatgaaggaaggtgtcaagttcttcaacccggtttacttgtttgatgaaggatccaccattgattgggtcccatgcggtaggaagctcacttgctcttaccccggcatcaagtttacatatggccccgacacctatttcggccaagaggtgtcggtactggagatggacgggcaattcgacaggctagacgagctgatctacgtcgagagccacctgagcaacctctcgaccaagttctacggggaagtgacgcaacagatgttgaagcatgctgacttcccaggaagtaacaacgggacggggctcttccagacgatcgtggggttgaaaatccgggatctctacgagcaactcatcgcagccaaggccaagactccggcacaggccaaagcctaagtgatcgtagacaaatgcattggggaaaattcttggtttttgttcttcttctttgaaatgatatttgtactgtaagaactgaggaagcttattgcagctgatctttgcctgaacaaagcttgtaattagtataaaacagaggggaaacaagtgaaaaaagaaaagagcagagtataaagtaactttctgttgtacaaatgttgatttgcgatcgttagagcttgaactcgaaacctgagatgctcggcttgtttattgtcgagtcaagtttcgatcgaattttttacgagcagacacgac

SEQ ID NO: 1345 - DNA, 1440 bp, Lolium multiflorum
aaggttgggcagcaaacatggcattctgcagcccacacaccaccacatccctgcactccccacgcaccactatcccaaactcaggcttcaggcagaaccaagtcatcctcttcacgaccagaagcagcaggaggagtaacacgaggaatggagcaaggaccttccaggtttcatgcgcagttgacaagccaatagtgattggcctggcagcagactcaggatgtgggaaatccaccttcatgcgccggctcaccagtgtgtttggaggtgctgcagagccacccaggggcgggaacccagactcgaacacactcatcagcgacaccacaacggtgatatgccttgatgactaccattccttggacagaaccgggaggaaggagaaaggtgtgaccgccctggaccccaaggcaaacgactttgatctcatgtatgagcaggtgaaggcaatcaaagaaggcaaggctatcgagaagccaatctacaaccatgtcaccggcctcctggacccggcggagctcatccagcctcccaagatcttcgtcatcgagggtttgcacccaatgtacgacgaacgtgtgagagacctccttgatttcagcatctacttagacatcagcaatgaggttaagtttgcatggaaaattcagagagacatggcagagcgtgggcacagccttgaaagcatcaaggctagcattgaagccaggaaaccagattttgatgcatttatcgacccacagaagcaatacgccgatgctgtgattgaagtcctgccaacccagctgattcctgatgacaatgaaggaaaggtgctgcgtgttaaattgatcatgaaagaaggcgtgaagttcttcaacccggtttacctgttcgatgaaggatcaaccatcaactggatcccttgtggaagaaagcttacgtgctcttaccctggcatcaaattttcctatggcccagacacttactttggccaagaggtatcggtgctggagatggatgggcaatttgacagactagatgagctaatatatgttgagagccacctaagcaacctctcgtccaagttctacggggaggtgacacagcaaatgctaaagcatgcagatttcccaggcagcaacaacggaacaggtctcttccaaactatcgtaggtctgaagattagagatctctatgaacaaatcattgctgagagagtcggcgcacctgctcaagcagccaaagtttgatgagccccatattcagattgcacaaatcatttcatcaccaacccaatgagaatgagcatcctcgcttgtaactagtttggaaatattacagctaggagatggtagaaagttcattgcagaaactcatgaaaacctgcacttgaacttctcgaaaaccctttccatgaggggactcctacgtctcctgttaacacatttcgatgtacct

SEQ ID NO: 1346 - DNA, 1679 bp, Lolium multiflorum
aggaaaatagggataccacatcatcaccatctcatttccctccttatgtttgcttagctcttatctccacaattctttcatcaagctctctcttctcctcaagtcccagttacaaggcttgaagggaagaagagcagctccaacagaaggttgggcagcaaacatggcattctgcagcccacacaccaccacatccctgcactccccacgcaccactatcccaaactcaggcttcaggcagaaccaagtcatcctcttcacgaccagaagcagcaggaggagtaacacgaggaatggagcaaggaccttccaggtttcatgcgcagttgacaagccaatagtgattggcctggcagcagactcaggatgtgggaaatccaccttcatgcgccggctcaccagtgtgtttggaggtgctgcagagccacccaggggcgggaacccagactcgaacacactcatcagcgacaccacaacggtgatatgccttgatgactaccattccttggacagaaccgggaggaaggagaaaggtgtgaccgccctggaccccaaggcaaacgactttgatctcatgtatgagcaggtgaaggcaatcaaagagggcaaggctatcgagaagccaatctacaaccatgtcaccggcctcctggacccggcggagctcatccagcctcccaagatcttcgtcatcgagggtttgcacccaatgtacgacgaacgtgtgagagacctccttgatttcagcatctacttagacatcagcaatgaggttaagtttgcatggaaaattcagagagacatggcagagcgtggacacagccttgaaagcatcaaggctagcattgaagccaggaaaccagattttgatgcatttatcgatccgcagaagcaatacgccgatgctgtgattgaagtcctgccaacccagctgattcctgatgacaatgaaggaaaggtgctgcgtgttaaattgatcatgaaagaaggcgtgaagttcttcaacccggtttacctgttcgatgaaggatcaaccatcaactggatcccttgtggaagaaagcttacgtgctcttaccctggcatcaaattttcctatggcccagacacttactttggccaagaggtatcggtgctggagatggatgggcaatttgacagactagatgagctaatctatgttgagagccacctaagcaacctctcgtccaagttctacggggaggtgacacagcaaatgctaaagcatgcagatttcccaggcagcaacaacggaacaggtctcttccaaactatcgtaggtctgaagattagagatctctatgaacaaatcattgctgagagagtcggcgcacctgctcaagcagccaaagtttgatgagccccatattcagattgcacaaatcatttcatcaccaacccaatgagaatgagcatcctcgcttgtaactagtttggaaatattacagctaggagatggtagaaagttcattgcagaaactcatgaaaacctgcacttgaacttctcgaaaaccctttccatgaggggactcctacgtctcctgttaacacatttcgatgtacatcttctcccacgtttcaatgcagaaaatacatgtgcttgctatattaaaagtaggtgctttcattcagcatctcattttgttggttgttactcc

SEQ ID NO: 1347 - DNA, 1895 bp, Prunus mume
attttttgcaagtggaaaaaaaaagctgtgaaatgacaattatacccatcgcccactggtttaagcccatcctacaaccttagaattagctccaaggttgtccgaaaccaggggtactcagagaaacccacaaaccagaagacgcgtcagcaagcggccttagcatatcaccaagacaacacaaccccctgtcagcagcaacctcttatttatgttccaaacttttcaattttctttgcaacccaaaaaccaaaaaaaaaaaaaaaaagattcaaaacccataaaacttatgtgtcttcttcacaaaaccaagccataacagaagagagagagagagagagagagagagagagagagagtatagtgctccaaaatggcaatttgtgcagtttacacaacccaactgaacccaacatgttcgttttccacaccagcatcaaaaacccaaacccagctgggatttggatttgggttctgccagaagcagcaggtggtgttttacaagagaagtcaaagtagtagcaggagagcaagtgtgagtttgataacatgctccgcgggtggccaagagacggtggtgattggtctagcagcagactcagggtgtgggaagagcacattcatgaggaggctgacgagcgtgttcggaggagcagcggagccacccaagggaggcaacccggactcgaacacgctcatcagcgacactacgacagtcatatgcttggatgattaccactctctggataggacagggaggaaggagaagggggtgactgctcttgacccaagagccaacaactttgatctcatgtatgagcaggtcaaggcaatcaaggaagggaaagctgttgataagcccatttacaaccatgtctctggtctcttggaccctcctgagctcatcaagccccccaagattcttgtcattgaaggcttgcacccaatgtatgatcagcgagttagggacctgttggacttcagcatctacttggacatcagcaatgaggtcaagtttgcatggaaaattcagagggacatggcagagcgcggtcacagtcttgagagcatcaaagccagtattgaagcccggaagcctgatttcgatgcttatattgatccacaaaagcagtatgctgatgcagtgattgaagtgttgccaacccaattgattccaggggataatgaggggaaggtattgagagtgaggttgatcatgaaagaaggtgtgaaatttttcaacccagtctacttgtttgatgagggctccaccatctcctggattccatgtggaaggaagctcacctgctcttaccctggaatcaagttcacctatggccctgacacttactttggcaacgaggtgtctgtgttggagatggatgggcaatttgacagattagatgagctgatctatgtagaaagccatctgagcaacatctccaccaaattctatggcgaagtcacccaacaaatgttgaagctttcggacttccccggcagcaacaacggcactggtctcttccaaaccatagtcggattaaagatccgagacctctttgagcagctcattgcaagcaaggccaaaactccagtagaagcaactaaagcttaaattaaaactatgccttatctttatatctactgtctacgtactttaaggcaacgcaggccactctagaaaagcttgtcttctttcagttttccatttttccactctctctctctctctctctctctctagtgtttctgttagtgttaggctattcctagcaagaacaatgacactttgtaatatcttcatgttgtaattctatggaacatttgtattatagtgaaacaaattttaaaaaagaagagaagaatacaaaattcagttatgaggttcacatcca

SEQ ID NO: 1348 - DNA, 1568 bp, Pseudoroegneria spicata
gttctctcttctcctcaagtctcagttacaaggcttgaaggggagaagagcagctccaagaggttgggcagcaaacatggcattctgcagcccacacaccaccacatccctgcgctccccatgcaccaccatctcaaactcaggcttcaggcagaaccaagtcatcctcttcacaaccagaagcagcaggaggagtaacacgaggcatggagcaaggaccttccaggtctcatgcgcaattgagaagccaatagtgattggcctggcagcagactcgggatgtgggaaatccaccttcatgcgccggctcaccagcgtgtttggaggtgctgcagagccacccaagggcggcaacccagattccaacacgctcatcagcgacacgacgacggtcatatgccttgatgactaccattctttggacagaaccgggaggaaggagaaaggtgtgaccgccctggaccccaaggcaaacgactttgatctcatgtatgagcaggtgaaggcaatcaaagaaggcaaggctattgagaagccaatctacaaccacgtcactggcctcctcgacccggcggagctcatccaaccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccggtttacctcttcgatgaaggatcaaccatcaactggatcccttgtggaagaaagcttacatgctcttatcctggcatcaaattttcctacggcccagacacttactatggtcaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccatcgtaggactgaagattagagatctctatgaacagatcatcgctgagagggccggcgttcctgctgaagcagcaaaagtttgatgagccccaaattcaagttcacgaatcatttcatcaccaactcaatgagaatgagcatcctcgcatttcttgtacctagtttgaatatattacagctagaagacggtagaaagttcactgcagaactcatgaaaacctgcattttgaacttctcgaaaatcctctccatgatgagggtctcttatgtctcttcttaacacatttcgatgtacatcttctcccatgtttcaatccagaaaatacatgtgcttgctagaatcaaaagcggctgctttta

SEQ ID NO: 1349 - DNA, 6566 bp, Oryza sativa
ggttgagtgagattagtactactagtactagtcggttggtcggtcagtccaccccgcgacaccaaccgatttcgcagcgccagcccactgattcctcaccgaattttttcattttttttctctctttccattctccccggcgatcgagtagccggcttctgctcgccgcccgcgcgccggagggaggcgaggtccaaagccggcgaggcgccatgcaccacgaccccaaccccttcgacgagggcgccgacgataaccccttctccaatggaggaggtggtggagcacgtcgtggtggtggtggcggcggtggtggtggcggtggcggaggcaagtctcagttctcgttcgggttcggcggcctcggcggcggcagcaagggcggtgccactgtcgacatccccctcgacaacatgagcgattcgaagggcaaggggaaggagctgttgcaatgggaggcagatctcaagagacgagaggcggatatcaggagaagggaggaagctctcaagagtgccggggtgcccatggaggagaagaactggccaccattcttcccaattatccaccacgacattgccaacgagatacctgccaatgcacagaagttgcagtaccttgcatttgcaagctggcttgggattgtactttgtctcttctggaattttattgctgtcattgtctgttggatcagaggaggagattccaagctctttttcctggctactatctacggtatgcttggaatgcctctgtcatacttgatgtggtataggcctctgtaccgcgcaatgagaactgatagcgcattcagctttggatggtttttcctttgctacatgcttcacattgccttctgtgtatttgctgccatcgctccaccagttatatttcgtggaaaatcattaactggtatattggctgcaattgacaccttctctgatcatgcaatagtcgggatcttttactttgtcggatttgccttgttttgcttggagacacttgtgagcatttgggttcttcagaaagtatacatgtatttcagagggcacaagtgaagtgggccgtggaagaaatattacaaaagcccaccaaatactatctgattgagctgcagttctgtgcatacatatatgtacatgtcgatcttgtatgttatgtagtgatggagatgttctaagtacatgtcaatctatagtgttattttttttaacaggaatactattttatagtgttgttttctgggctgatcggtctgttgtgttgaacctcaattctttacctatacaaattgcactttgttcactcttttgtttgatagttcaattttacggttgattggtctgttggcctacgacaagagccatgctcgttggaaccagaagacagcaacccatctgtctggggatctcatttgtgctttgagacttggaaggaatcttgcactccttggagattcagcttccgccgaacttgggatcaggtgcagtcccaactacaactgctgaacttgggatcaggtgcagtcccaactacaactgcacgttagggactgcacaagatcttgtccattcaatttttcagtggaagatctagattaaatgctacaataaccttgttataataattttgtgctagattgtttgaatgaacagtgtccattaaatttgggctttggatttgcatcccacagccgtagcatgactgtctaagttgcagtcatactggactgcacaggaaccaaattcgtactcttgtgctcaccaatgtttatgtatttttttaacagcaaatacagaaccaaatgaggctgtttatcatatttttcccaggtaataatgttctggtttggcacggtttgtattataagcattgatacaacttgagttgagaatacatgccagaaaatcggcaaacaaataatatacggcacaaacctgacattatatatcatcaatgcataattgattatatcatacggctgaccattaacttgcaagataaaattgcactggaaagtggaaacaaatcgaatttcttcagtttcgtggccgtgggatgttgggcgttggcagccccccagcatatgctttggagatgtcctgcgagtctcggccatctagacatctagtgacatggatgctgacttgtcttggccacacagtgacgcggctgctgatgaagtgatgaggtgctcacctgctgccacgagattacgcgtggactgcgttggtgggctagatgtacatatatggtgcacagcaaacagcaaggttgaagggagcagcatcagcgatatccagcctccagtttccagcctccattccctcatcctcagccagccatccctgcgctgccacgtggcataaccatatctaaattcatgaaaccaccaccaagctttctcccgagcatccctggccatcacaaattcaagcatcgattaatcggcagcacaggaacaagtgcatgtattctccgggacataaaaatgcaggacgtgtaaaataaatctcaaagtacgtccttctcttcgtatcttggcagctagcagacaagcaaaaaagcactgcaactttcagcacataatacttatataaattcagaaattaagtgagaaatgttagaaacatcaccagaaaggatgattgtaagagagccaaaaagcttttcttaacaataaaattcagtgtccatagggagaatgctgacaaaatatgattatttgaaattgaagaactcattttcagttcactataagctgcccttgatatcatcagaaaagaaaggaaaataaggggtaccacatcatcatcatcctctctcctccttatgttctcctagctctatcccctcaattctttcaacctcctctctcttctcatcaagcctcaatcaaaaggcttgaagggaagaagagcaactccagcaggtagaaaggccagaagcaaagatggcgatctccagcctacatgccaccacctccctgcactccccatgcaccaccaacacaagcttcaggcagaatcaggtcatcttcttcaccaccagaagcaacaggaggggtagcacaaggtacggaggagcaagaacctttcaggtttcatgctcagtcgacaagccagtggtgattggccttgcagcagactcaggatgcgggaagagcacctttatgcgccggctcaccagtgtgtttggtggtgctgcagagccacccaagggtggcaacccagactcaaacacactcatcagtgacacgacaacggtgatatgcctcgatgactaccattccttggacaggactggcaggaaggagaaaggtgtgactgccctggaccctagggcaaacgattttgatctcatgtatgagcaggtgaaggcaatcaaagaaggcaaggcaattgagaagccaatctacaaccatgttactggtctcctagacccaccggagcttatccagccccccaagatttttgtcattgagggcttacatcccatgtttgatgaacgtgtgagggacctcctagatttcagcatctacctggacatcagtgacgaggttaaatttgcatggaaaattcagagggatatggcagagcgcggtcacagccttgaaagcatcaaggctagtatcgaagccaggaaaccagattttgatgccttcattgatccccagaagcaatatgctgatgcagtgattgaagttctgccaacccagcttattcctgatgacaatgaaggaaaggtgctacgtgttaaattgatcatgaaagaaggtgtaaagaacttcaacccagtttacctcttcgacgaaggatcaagcatcacctgggtcccttgtggaagaaaactcacatgttcttatcctggcatcaaatttgcctatggcccagacacttactttgggcatgaggtatcagtgctggagatggatggccaatttgacagactagatgagcttatctatgttgagagccatttaagcaacctctcaaccaaattttatggagaggtgacacagcaaatgctaaagcatgcagacttccccggcagcaacaatggaacaggtctcttccaaactatcgtaggactgaagattagagatctctatgagcagattattgctgagagggccggtgcacctactgaagcggcaaaagtttaatgagctccacattcatatttcgtgaatctcttcatcaccataccatatcaatgacaatgggcatcctcgcatttcttgtaactagttttggaaatattacagctagaagaaagtaggatggtcattgcataacttgtgaaaccatgcaatggaacttctaaaaatccctctccatgagggtgctcctacatctcttcttgacacatttcaatgtacatcttctatatttcaatgtagaaagaaatacggttgctttctactataaaaaataggtccttcctttagtgcctctcttgttggctattgcttctggtcataagtcaacaacatatgatcgacaagggaagaaaatacagacggaatatttatagatgaattgggagtaaaatttatgagtggtagtccaatgagtgcctaaccaatctcactctattgtgtggatctgcagtgagaataatgcaattcagtgaatcatattcgttcaccaattaatggagtcatgggatcatcatggttatatgcagctatactttaaacagaagttatatacggtgcacatgatagtttcagataaataacaaacagacaaccatgaaaggaactccagatttcagaacagaaactcataggcttgcatatgtgaatttcaaaagcacattgcataaacatggagtctaagaattgcataaataatatgatgctgagcatgaatatgagacagtgcatgttatgcaagcctaaaagagaagcctacaaactcatacaaaacattggtgatcagcatgtaccggcctaccaggtggtaccaccggaagtcatgacgacaattacaatctgtacttggtgtttccatatgatacaaaaatgtgacttactatgacatgtgttggctgaaagggaattgctagaaaaacactcattatgttggcacaacatgctacggaagtaaaatatccacagtaatagatttacagcaaaacaactgatcatagataaggtttcttcacttgtctcactagttaccatgcatcatcaaaagagaagacgtggataaatccatatctgtgaaggccatggcaagtggttcattgcttgaatggacaatggtccaagcccttgaccaccgagaggcacctcacgcccaggccgccatgcataccagtcacggcacccaggagcagcaatgtaaattcggttcgcctccacgccacagttctccacgtctacacaagcagctgtactcctcccggcgcagtccacaaacaagctgtaagccccaatgttgtccacctcttcccacctcatcttcaccatgtcaagtgcatagacgccaaccttcttcacactcaccaatgtctcaaacatatggcccaatttcggccccatcatgaagagcaccaggagcaatcgatcaccggcggcgaccagatgcgggccgaagtgccaccggtcgaacgtgctgacctcagggaggccggcggcgtgcaacatttgggcggatttgttcggagggttggcatcgaggtggaactccagcagctgcgcgcgatcggtcaagccgaggacgcgcccgcggaattcgaggatggatcgaacgaaggaggcggcacgggggaggctgtgcttggtccaatcgaggcgagggttgtggcccgcgtcgcccacggggagggagaagaaggcgtgcttggaatggaagaggaggaggcggcgggatggcgcgagggcggcgtagtgataggcgaagtgcggggaagggagcggcagcgcgtggcgcgtggcgccggtgagcgcgtcgacgaggtggaggccgtggaaggggtcgcggcggcggaggaggacgaggtggccgcgggaggaggagaggagggtggcgtcgcccgggacggggtaggaggagaggagcgccgcgacgacgagctgggagaaagggacgacgcgataggtggggcagaggaggaggagcggcgggatgcgggggcggacgaggtcggcggcggagtcccggagcaggcggcgccagggctggcacgcggcggcgaaggcgtagacggagcggaggcaggggaggaggccccgtagcacctccgagagcggcagctccggcaggttggcccagtcgcggaactccggcgaaggatccatcaccgcaccgccgccggtgggggaggcgcaaatcatcggagttctcgtggggcgcgccgccggcgaggccttttctccccttcctgcagacgaggaccgtggccggtaaatgggccgggccgttgacgccgccactttaggaataaggtcaccggaggtccctcaacttaacagctagatttttatagatcccttaactacaaaaccagaaatgtgtacccctaaactctcttaaaccgttcaccgaaggtccctc

SEQ ID NO: 1350 - DNA, 1542 bp, Secale cereale
gctctctcgtctcctcaagtctcagttacaaggcttgaaggggagaagagcagctcggagaggttgggcagcaaacatggcattctgcagcccacaagccaccacatccctccgctccccatgcaccaccatcccaagctctggcctcaggcagaaccaagtcatcctcttcacaaccagaagcagcaggaggagtaacaccaggcatggggcaaggaccttccaggtctcatgcgcagtcgagaagccaatagtgattggcctggcagcagactcgggatgtgggaaatccaccttcatgcgccggctcaccagcgtgtttggaggcgctgcagagccaccaaagggcggcaacccagactcgaacacgctcatcagcgacaccacgacggtcatatgccttgatgactaccattccttggacagaaccgggaggaaggagaaaggtgtgaccgccctggaccccaaggcaaacgactttgatctcatgtatgagcaggtgaaggcaatcaaagaaggcaagcctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgccttcattgatccgcagaagcaatacgctgatgctgtgattgaagttctgccaacccagctgattcctgatgacaacgaagggaaggtgctgcgtgttaaattgatcatgaaagaaggcattaagttcttcaacccggtttacctcttcgatgaaggatcaaccatcaactggatcccttgtggaagaaagctcacatgctcttatcctggcatcaaattttcctatggcccagacacttactttggccaagaggtatcggtgctggagatggacgggcaatttgacagactagatgaactcatctatgttgagagccacctaagcaacctctcaaccaagttctacggggaggtgacacagcaaatgctaaagcatgcagacttcccaggcagcaacaatggaacaggtctgttccaaaccatcgtaggactgaagattagagatctctatgaacagatcattgctgagagggccggcgtccctgctgaagcagcaaaagtttgatgagccccaaattcaagatccacggatcatttcatcaccaagtcaatgagaatgaacatcctcgcgtttcttgtaactagtttggatatattacggctagaagacggtagaaagttcactgcagaactcatgaaaacctgcaaattgaacttctccagaatcctctccatgatgagggtctcttatgtctcttaacacatttcaatgtacatcttcacccatgtttcaatgcagaaaatacatgtgcttgc

SEQ ID NO: 1351 - DNA, 1649 bp, Secale cereale
caagtctcagttacaaggcttgaagggaggacgaggcagctcggagaggttgggcagcaaacatggcattctgcagcccacaagccaccacatccctgcgctccccatgcaccaccatcccaagctctggcctcaggcagaaccaagtcatcctcttcacaaccagaagcagcaggaggagtaacaccaggcatggggcaaggaccttccaggtctcatgcgcagtcgagaagccaatagtgattggcctggcagcagactcgggatgtgggaaatccaccttcatgcgccggctcaccagcgtgtttggaggcgctgcggagccaccaaagggcggcaacccagactcgaacacgctcatcagcgacaccacgacggtcatatgccttgatgactaccattccttggacagaaccgggaggaaggagaaaggtgtgaccgccctggaccccaaggcaaacgactttgatctcatgtatgagcaggtgaaggcaatcaaagaaggcaagcctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaatccagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaaattcttcaacccggtttacctcttcgatgaaggatcaaccatcaactggatcccttgtggaagaaagctcacatgctcttatcctggcatcaaattttcctatggcccagacacttactttggccaagaggtatcggtgctggagatggacgggcaatttgacagactagatgaactcatctatgttgagagccacctaagcaacctctcaaccaagttctacggggaggtgacacagcaaatgctaaagcatgcagacttcccaggcagcaacaatggaacaggtctgttccaaaccatcgtaggactgaagattagagatctctatgaacagatcattgctgagagggccggcgtccctgctgaagcagcaaaagtttgatgagccccaaattcaagatccacggatcatttcatcaccaagtcaatgagaatgaacatcctcgcgtttcttgtaactagtttggatatattacggctagaagacggtagaaagttcactgcagaactcatgaaaacctgcaaattgaacttctccagaatcctctccatgatgagggtctcttatgtctcttaacacatttcaatgtacatcttcacccatgcttcaatgcagaaaatacatgtgcttgcttgaatcaaaagcggctgcttttaaaaaaaaaaaagaaaaaaaagaaaaaaaaaaaaaaaagagagagagagagagatatatatacacacgacgacgacgacgacgacgagagagagagag

SEQ ID NO: 1352 - DNA, 1655 bp, Secale cereale
tctcagttacaaggcttgaagggaggacgagcagctcggagaggttgggcagcaaacatggcattctgcagcccacaagccaccacatccctgcgctccccatgcaccaccatcccaagctctggcctcaggcagaaccaagtcatcctcttcacaaccagaagcagcaggaggagtaacaccaggcatggggcaaggaccttccaggtctcatgcgcagtcgagaagccaatagtgattggcctggcagcagactcgggatgtgggaaatccaccttcatgcgccggctcaccagcgtgtttggaggcgctgcggagccaccaaagggcggcaacccagactcgaacacgctcatcagcgacaccacgacggtcatatgccttgatgactaccattccttggacagaaccgggaggaaggagaaaggtgtgaccgccctggaccccaaggcaaacgactttgatctcatgtatgagcaggtgaaggcaatcaaagaaggcaagcctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaatccagagagacatggcagagcgtgggcacagtcttgaaagcatcaaggctagcatcgaagccaggaaacctgattttgatgccttcattgatccgcagaagcaatacgctgatgctgtgattgaagttctgccaacccagctgattcctgatgacaacgaaggaaaggtgctgcgtgttaaattgatcatgaaagaaggcattaagttcttcaacccggtttacctcttcgatgaaggatcaaccatcaactggatcccttgtggaagaaagctcacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaacggaacaggtctgttccaaaccatcgtaggactgaagattagagatctctatgaacagatcattgctgagagggccggcgtccctgctgaagcagcaaaagtttgatgagccccaaattcaagatccacggatcatttcatcaccaagtcaatgagaatgaacatcctcgcgtttcttgtaactagtttggatatattacggctagaagacggtagaaagttcactgcagaactcatgaaaacctgcaaattgaacttctccagaatcctctccatgatgagggtctcttatgtctcttaacacatttcaatgtacatcttcacccatgcttcaatgcagaaaatacatgtgcttgcttgaatcaaaagcggctgcttttatctagcgtctccatttttttggttattactgctgaccatgagactaacattcataaaaggccatttaagaagaaaaaaaatggagctggatttgtctacagaatagtc

SEQ ID NO: 1353 - DNA, 1635 bp, Vitis vinifera
gccccttgtttgtctttttagtgtgttcctctggttccaaaggagaaaaaggccaaacccccatttcatcctcatgtctcctcctcacaaatccttctgagaatcatttcacttcaagaagctcttccatttctcccttgagaaaattcccttgtaggaacaggtagagggaacaaactaacgaaaaatggcaatctgcaccgtgtacacaacccaatctctcaactcaacatgctcagtctctaaaccagcgaaacctcaattgggtttccaccagaagcaggtggttttcttcaccaaaagcaggagaagatcgggcatgagcagctgcggcagcagtgtgataacgtgctcagctggagagcaacggacagtggtcatagggttggctgcagactctgggtgtgggaagagcaccttcatgaggaggctgaccagtgtgtttggaggagctgcggagcctccaaggggtgggaacccagactccaacacactcatcagtgacaccaccactgtcatatgcttggatgactatcactcacttgacagaactggaaggaaggagaagggtgtgactgcgcttgaccctagagccaacgattttgacctcatgtatgagcaggttaaagctatcaaggatggaattgctgttgagaagcccatctacaaccatgtcaccggcctcttggatcctcccgagaccatcaagcctcccaagatcctcgtcattgaaggtttgcaccccatgtacgatgctcgcgtaagagacctcttggacttcagtatctatttggacattagcaatgaggttaaatttgcttggaaaattcagagggacatggctgagcgaggacatagtcttgaaagcatcaaagccagtattgaagcccgaaagcctgattttgatgcttatattgatccacagaagcagtacgcggatgcagtgatagaagtgttacccactcagctcattcccgatgacaacgaaggcaaggttttgagagttcgattgatcatgaaagaaggggtgacgtatttcagcccggtttacttgttcgatgaaggctccaccatctcatggatcccctgtgggaggaagcttacatgctcttaccctggcatcaacttctcctacggccccgacacttactacggccatgaggtttctgttttggagatggatggacaatttgacagattagatgagctcatttatgttgaaagccatctgagcaacatctcgaccaagttctacggtgaaatcacccaacagttgttgaagcactccgatttcccaggaagtaacaacggaactggcctcttccaaaccatagttgggttgaagataagagacctctttgagcaaatcgtcgccagccgggctgcaactcccttagaagcaacaaaagcctaaacccactgccttacatattggacaaatgtcttcttactcattcagcatttccttttttccccacctccctcactaagctctttctcatgtttcaactttgggtgttagcctattcctcataagaatgagaacactctcatatgtatttgtttcctcatgggattctgtggagatatgtagtatagagaagctaaaacagtcaagaacatcattcaacattc

SEQ ID NO: 1354 - DNA, 1694 bp, Musa acuminata
atggaatgtccaccaagctttctccaccccatcctaaccatcaaaaacctcatcccatcgaccacaaaccataccgcagcaaagcctgcagaactcacacacccagcacagcacaaaaaaaagatcttacatgcttgtgattcatcttatttcaagcctctccaaacgtgtccaaacccatggccaccaccaaagaatagaagaaggcagaccacaccatccttctatctttatgctccctcctccccagacttcgccttccaccttctcgtaggggagaagaactgtgcagctccgctgccattcctgagcaagacaccgaaaatggcaacctgcacagtctaccctgctccttccctccactcctcgtgttccttccccggtccggccaagacttacttgggcttccaccaaaggcaggtcatcttcttcaccggtgggaggagaagcggcagcagaggagggaggagtagctcagagatctcctgctctgcggaggccaagacggtggtgataggactggcggcggactcggggtgtggtaagagcaccttcatgaggaggctgacgagtgtgttcggaggcgcggcggagccgcccaagggaggcaacccagactccaacacgttgatcagtgacaccaccactgtcatttgcctggatgactaccactctttggacagaacagggaggaaggagaagggagtcactgctctggatccccgggccaatgacttcgatctcatgtacgaccaagtgaaggctctcaaggaaggagtggccgtggacaagccaatctacaaccatgtcaccggcctgcttgacccccctgagctcatcaatccacccaagattctggtcatcgaaggactgcacccaatgttcgacgcccgggtgagggacctgttggacttcagcatctacttggacatcagcaacgaggtcaagtttgcatggaagattcagagagatatggcggaacgtgggcacagccttgaaagcatcaaagctagcatagaagctcgaaagcctgatttcgacgcttatatcgatccacagaaacagtacgccgacgccgtcatcgaggttctgccgaccctgctgatccccgacgacaacgaaggaaaggtgctgcgcgtgaggctgatcatgaaggaaggggtgaagcacttcagccccgtctacctcttcgacgaaggctccaccatttcctggatcccctgcggccggaagctgacctgctcgtaccccggcatccagttctcttacggcccggacacctactactccaacgaggtctcggtgttggagatggatgggcagttcgacaggttggatgagctgatctatgtggagagccatctgagcaacctgtcgactaagttctacggggaggtgacgcagcagatgctgaagcacgccgacttccccggcagcaacaacggcaccggcctcttccagaccattatcggtttgaagataagagacttatatgagcagatcgttgccgagagggcggctgccgccgttgaggcagccaaagtctgagagcagtcgccattacagagacaagtcttatcatctgctgttcttctgcacatggctatctatgttctcatgtcatgtaatttacttggaattgtaagataggagagatggaatactttcttcagcaatcaattgtgcctttcttt

SEQ ID NO: 1355 - DNA, 1763 bp, Gossypium hirsutum
gacaaactcattttaagtggtctttttattgcccatgtaagcaccatttaacattctctccctgtctaaaaagctctctaaattccctttcccgagctgaaagataaacaaggtgagcctaaaagagctgaagcaatggcagtttgctcagcatacaccacccagtccctcaattcaacttgttcaatctccacaccagcgaaaacccatttaggttttcaccaaaagcaagtagttttctataggagaagcagcaagagaggtggcagcggcagcggcagcggcagcagcagcggcccatgcgtgataacatgctcggccggtgattcacaaactgttgtgattggtttggccgcagactcaggatgtgggaagagtaccttcatgaggaggctaacaagtgtgtttggtggtgcagccgagccaccgaagggaggcaatcctgattcaaacacactcattagcgatatgaccactgtgatatgcttagatgattaccattcactcgacagaactggaaggaaagagaagggggtgacagcacttgacccaagagctaacgactttgacctcatgtatgagcaagttaaggctatcaagagcggtgttgctgtcgacaagcctatctacaaccatgttactggtctcttagatcctcctgagctcatcaagcctcctaagatccttgtcatcgaaggactacaccctatgttcgatgagcgtgtgagggatctgttggacttcagcatctatttggacatcagcaatgaggtcaaatttgcatggaaaattcagagggacatggctgagagagggcacagccttgaaagcattaaagctagtattgaagccaggaaacccgatttcgatgcctatattgatccccaaaagaaatatgctgatgcagtgatcgaagtgctgccaactcagctcattccagacgacaatgaagggaaggttttgagagttaggttgataatgaaagaaggggttaagcatttcagtcctgtttacctgtttgatgaaggctcaaccatctcatggataccatgcggaaggaagctcacttgctcttaccctggcatcaaattccactatggccctgacacttactttggcaacgaggtttctattctggagatggacggccaatttgatagattagatgaacttatttatgttgaaagccatttgagcaacatctccaccaagttctatggagaagtcacccagcaaatgttgaagcatgcggatttccctggaagtaacaacggaactggcctcttccaaaccattgtcgggttgaagataagagatctctatgagcaaattacttccagcaaaactgcagctccactagaagcaacaaaagcctaagactattagagtttcttcatacattggactagaccttgggtccataacaaattatcctctttccagctttcctctatcaaaggtttatttgagtgttaggctgttgttgctttcataagaatcgagtatgatcctatgcatttattttatgttcgtaattcagtggagatatgtaatatagagaaacaaaatcagagttcaatttcaactttgagaagttcatataagacaaagcctttcgacatcatctctccacttctatttccccatattgctgcttcttcttgtaagttgtaaccatttatgatgtcatgatctttggtttttttactccaaataaagaggatttggctatggaagcgtggccataatgtgacgttttcctt

SEQ ID NO: 1356 - DNA, 1445 bp, Flaveria ramosissima
acacatttaaaagcctattttctcattctatctctctcttaacattcttcacaaagtttagagggaaaaaatggcagtgtccacagtgtacacagcccaatctctcaactcaacatgttcaatctcaacacccacaaaaacccatttgggaattcagcaaagacaagtgttgttctatactaaaaagaccaataggggcagggtgaggggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccaccacagtcatatgtttggatgattaccattcattggatagaacagggaggaaagttgaaggggtgacagcacttgatccaagagccaataactttgatcttatgtatgagcaagttaaggctttgaaagatggcattgctgttgaaaagcccatttataaccatgttagtggtcttttggaccctcctgagaccatcaagccacctaagatccttgtcattgaaggtttgcacccaatgtatgatcagagagtaagagacctcttggatttcagtatctacttggacatcagcaatgatgttaaatttgcctggaaaattcagagggacatggcagaaagaggacacagccttgaaagtatcaaagctagtattgaggccagaaagccagattttgatgcttatatcgacccgcaaaagcaatatgcagatgccgttatagaagtgttgcctacacagctgattccaggtgacaatgaggggaaggtgttgagagtgaagctgataatgaaagagggagtgaaatacttcagccctgttcacttgtttgatgaaggctccaccatctcatgggttccatgtgggaggaaactcacctgttcttaccctggtatcagatttgcctatggccctgatacttactacggtcatgaggtctctgtgttggagatggacgggcaattcgacagactggatgagcttgtctatgttgagagccatttgagcaacatttccaccaagttctatggagaaatcacccagcaaatgttgaagcattcagacttccctggtagcaacaatggcactggtctcttccaaaccattgttggtttgaaaatcagagatctctttgaacaaatcacagccaccaaggcctcgcctacattggaagccacaaaagcttaaactaaagaaacataaacaagccctttgaatcttctttcctccacaaccttctttttttcatgtaaaattctgagtgtcgttaggcttttatcacgagtctctcccatatgtattacagggttgtaaaattcggacagggcactgaaatcaatacaatactattaag

SEQ ID NO: 1357 - DNA, 1722 bp, Setaria italica
attttcagctcagtataggacgcccttgatgttatcagaaaaaacaaagtgaaaaatagggacaccacatcatcgacatcctcttgtcctacttatgttcttctagctccacatccaccattccattctcactctcttcttctcttcaagttccactcacgaggcttggagggaagaagagaagcttagcccagaacaaaggccggcaagcaaaaaaatggcgatcagcagcgcgcacaccaccacctctctgcactccccatgcacaaccgtctcgaacgcaggcttcaggcagaagcaagtcatcttcttcaccagcaacaggagaggcggcagaaggcacggaggggcaagaaccttccagatttcatgctccgtcgagaagccagtggtgattggcctggcagcagactcgggatgcgggaagagtaccttcatgcgccggctcaccagtgtgtttggtggtgccgcagagccacccaagggcgggaacccggactccaacacgctcatcagtgacaccacgaccgtgatatgccttgatgactaccattccttggacagaaccgggaggaaggagaagggtgtgacagccctcgacccaagggcgaacaactttgatctcatgtatgagcaggtgaaggcaatcaaagaaggccagacaattgagaagccaatctacaaccatgtcactggcctcctcgacccaccagaggttatcacgcccccaaagatttttgtcattgagggcttgcacccaatgttcgatgagcgtgtgagggacctactagatttcagtatttacttggacatcagtgatgaggttaagtttgcatggaaaattcagcgggacatggcagagcgtgggcacagccttgaaagcatccaggctagtattgaagcgaggaaaccagattttgatgccttcatcgatccgcagaagcaatatgctgatgctgtgattgaagttctgccaacccagttgattcctgatgacaatgaaggaaaggtgctgcgtgttaaattgatcatgaaagaaggcgtgaagcacttcaacccagtttacctcttcgatgaaggatcaagcatcagctgggtaccttgtggaagaaagctcacatgctcttaccctggcatcaaatttgcatatggcccggacacttactttggccatgaggtatcagtgctggagatggatgggcaatttgacagactagatgagctcatctacgtggagagccatctaagcaacctctcaactaaattctacggagaggtgacacagcaaatgctaaagcatgcggacttcccaggaagcaacaatggaacaggtctcttccagaccatcgttggactgaagattagagatctctatgaacagatagttgctgagagggctggtgcaccagctgagtcagcgaaagtttaatgatctccacattcagatttcctacacctcttcaaactcaatgagaatgagaatcctcgcatttcctgtaattagttcggatatatcacagctagaaggaggtagaaatgtcattgcagtactcaggaaaacatgcaatggaatttctagaaatccctcgccatgggggtgctcttgcatctctttttcacatgtttgaatgtatacctcttccatgcttttatgcagaaagaaatacaactgcctggtgcctggtacctctctgaccaggagccaatgtttatgcaagaaca

SEQ ID NO: 1358 - DNA, 1648 bp, Setaria italica
tcgacatcctcttgtcctacttatgttcttctagctccacatccaccattccattctcactctcttcttctcttcaagttccactcacgaggcttggagggaagaagagaagcttagcccagaacaaaggccggcaagcaaaaaaatggcgatcagcagcgcgcacaccaccacctctctgcactccccatgcacaaccgtctcgaacgcaggcttcaggcagaagcaagtcatcttcttcaccagcaacaggagaggcggcagaaggcacggaggggcaagaaccttccagatttcatgctccgtcgagaagccagtggtgattggcctggcagcagactcgggatgcgggaagagtaccttcatgcgccggctcaccagtgtgtttggtggtgccgcagagccacccaagggcgggaacccggactccaacacgctcatcagtgacaccacgaccgtgatatgccttgatgactaccattccttggacagaaccgggaggaaggagaagggtgtgacagccctcgacccaagggcgaacaactttgatctcatgtatgagcaggtgaaggcaatcaaagaaggccagacaattgagaagccaatctacaaccatgtcactggcctcctcgacccaccagaggttatcacgcccccaaagatttttgtcattgagggcttgcacccaatgttcgatgagcgtgtgagggacctactagatttcagtatttacttggacatcagtgatgaggttaagtttgcatggaaaattcagcgggacatggcagagcgtgggcacagccttgaaagcatccaggctagtattgaagcgaggaaaccagattttgatgccttcatcgatccgcagaagcaatatgctgatgctgtgattgaagttctgccaacccagttgattcctgatgacaatgaaggaaaggtgctgcgtgttaaattgatcatgaaagaaggcgtgaagcacttcaacccagtttacctcttcgatgaaggatcaagcatcagctgggtaccttgtggaagaaagctcacatgctcttaccctggcatcaaatttgcatatggcccggacacttactttggccatgaggtatcagtgctggagatggatgggcaatttgacagactagatgagctcatctacgtggagagccatctaagcaacctctcaactaaattctacggagaggtgacacagcaaatgctaaagcatgcggacttcccaggaagcaacaatggaacaggtctcttccagaccatcgttggactgaagattagagatctctatgaacagatagttgctgagagggctggtgcaccagctgagtcagcgaaagtttaatgatctccacattcagatttcctacacctcttcaaactcaatgagaatgagaatcctcgcatttcctgtaattagttcggatatatcacagctagaaggaggtagaaatgtcattgcagtactcaggaaaacatgcaatggaatttctagaaatccctcgccatgggggtgctcttgcatctctttttcacatgtttgaatgtatacctcttccatgcttttatgcagaaagaaatacaactgcctggtgcctggtacctctctgaccaggagccaatgtttatgcaagaa

SEQ ID NO: 1359 - DNA, 2102 bp, Vitis vinifera
cgtggttccactaatatccaaaactccaacaaatcaccaccacgcttctccatgcctctttggttatcacaaacatcacctcatcatcaacaattcaattctcccctgccttttcttttctttttttctttaatgacacatgaatttcaatatccccaagtaattaatagtttctctactatgttttcccttttcctttttttcctttttttcttttgtaattttgaaaggatgatattgcccttatgatggtgagtttaataccactatgccccctttcatcccaccttaaaattaccaccaaatttgtccaaaacaaaagggtagccatagaaaccagagacgcgagcatcagcccaacatcatcaaatcaaacactttcctatcttttgaaactgccccttgtttgtctttttagtgtgttcctctggttccaaaggagaaaaaggccaaacccccatttcatcctcatgtctcctcctcacaaatccttctgagaatcatttcacttcaagaagctcttccatttctcccttgagaaaattcccttgtaggaacaggtagagggaacaaactaacgaaaaatggcaatctgcaccgtgtacacaacccaatctctcaactcaacatgctcagtctctaaaccagcgaaacctcaattgggtttccaccagaagcaggtggttttcttcaccaaaagcaggagaagatcgggcatgagcagctgcggcagcagtgtgataacgtgctcagctggagagcaacggacagtggtcatagggttggctgcagactctgggtgtgggaagagcaccttcatgaggaggctgaccagtgtgtttggaggagctgcggagcctccaaggggtgggaacccagactccaacacactcatcagtgacaccaccactgtcatatgcttggatgactatcactcacttgacagaactggaaggaaggagaagggtgtgactgcgcttgaccctagagccaacgattttgacctcatgtatgagcaggttaaagctatcaaggatggaattgctgttgagaagcccatctacaaccatgtcaccggcctcttggatcctcccgagaccatcaagcctcccaagatcctcgtcattgaaggtttgcaccccatgtacgatgctcgcgtaagagacctcttggacttcagtatctatttggacattagcaatgaggttaaatttgcttggaaaattcagagggacatggctgagcgaggacatagtcttgaaagcatcaaagccagtattgaagcccgaaagcctgattttgatgcttatattgatccacagaagcagtacgcggatgcagtgatagaagtgttacccactcagctcattcccgatgacaacgaaggcaaggttttgagagttcgattgatcatgaaagaaggggtgacgtatttcagcccggtttacttgttcgatgaaggctccaccatctcatggatcccctgtgggaggaagcttacatgctcttaccctggcatcaacttctcctacggccccgacacttactacggccatgaggtttctgttttggagatggatggacaatttgacagattagatgagctcatttatgttgaaagccatctgagcaacatctcgaccaagttctacggtgaaatcacccaacagttgttgaagcactccgatttcccaggaagtaacaacggaactggcctcttccaaaccatagttgggttgaagataagagacctctttgagcaaatcgtcgccagccgggctgcaactcccttagaagcaacaaaagcctaaacccactgccttacatattggacaaatgtcttcttactcattcagcatttccttttttccccacctccctcactaagctctttctcatgtttcaactttgggtgttagcctattcctcataagaatgagaacactctcatatgtatttgtttcctcatgggattctgtggagatatgtagtatagagaagcaaaaacagtcaagaacatcattcaacattcaacacttcttggaattttctatgagcaaccaggatagaagaataaaagacgactctaaatgtacaaatta

SEQ ID NO: 1360 - DNA, 1517 bp, Triphysaria pusilla
attcttcccaactataattcaaaaaataaaattatttaaaaagccaaattttcatgaaaaatcacactctctaaataacactcacttatctcctagagagtgaagaagaagaaaaaatggcagtttgtacagtctacacagttcaatccctaaactcaatctcaacaccaccaaaaacccacttaggattcaaccaaaaacaagtgttcttctacagcacaaccaagaaaccgataaaatccaagtctttttcgactgaaatatcttgctcagccgatgacaagactgtagtaatcggcctggcagccgactctggctgtgggaagagcactttcatgcgacggctcacgagcgtgtttggcggtgcggctgagccgccaaagggcggcaacccggactcgaacacgcttataagcgaaatgacgactgtgatatgtttggatgactatcattcattggacagaaccggacggaaggaaaagggagtcactgcactggatccaagagctaatgactttgatctcatgtatgagcaggttaagtctattaaagatggagttgctgttgagaagcctatttataatcatgtcactggtttattggacccgccggagctgattaagtctcccaagatttttgtcattgaaggattgcatccattgtacgatgcacgagtgagagatcttctggacttcagtatttacctggacatcagcaacgaggttaaattcgcatggaaaattcagcgtgacatggctgaaagaggacacagcctcgaaagcatcaaagctagcatcgaagcccgaaaaccagatttcgatgctttcattgacccacagaagcaatatgcggatgcagttatagaagtgttgcctacacaactcatccctgatgacaatgagggcaaatacttgagagttagattgatacaaaaagaaggggttaagtttttcaacccggtttacctctttgacgaaggctccaccatctcatggataccctgtggtcgcaagctgacgtgctcatacccgggcatcaagttcacttacggccccgacacttactatggcaatgaggtctcagtgttggagatggatggacaattcgacagactagacgagctcatctacgtcgaaagccatctgagcaacctttcgtccaaattctatggcgaagtaactcagcaaatgcttaagcacgcagatttcccaggcagcaacaatggcaccggtcttttccagaccatcgtcggcttgaagatcagagacctttacgagcagcttactacaaccaaaacaagcaaaactgcagctccattgaaagctacaaaggcctaaataaatatcctatttttttccctctttgttcaaaacactgtgttgtgtatcagttgagtgttatataaatactcataaaaacaagtaagattgataatcacttcaaattcaacattctactacggcataacattagataacaacatgtacaatgcaaaagctagctcaaaatcattcata

SEQ ID NO: 1361 - DNA, 1351 bp, Triphysaria pusilla
cacactctctaaataacactcactaatctcctagagagtgaagaaaaaaaatggcagtttgtacagtctacacagttcaatccctaaactcaatctcaacaccaccaaaaacccacttaggattcaaccaaaaacaagtgtttttctacagcactaccaagaaaccaataaaatccaagtctttttcgactgaaatctcatgctcagccgatgacaagactgtagtaatcggcctggctgcagactctggctgtggaaagagcactttcatgcggcggctcactagcgtgtttggcggtgcggctgagccgccaaagggcggcaacccggactcgaacacgcttataagcgaaatgacgactgtgatttgtttggatgactatcattcattggacagaaccggacggaaggaaaagggagtcactgcactggatccaagagctaatgactttgatctcatgtatgagcaggttaagtctattaaagatggagttgctgttgagaagcctatttataaccatgtcactggtttattggacccgccggagctgattaagtctcccaagatttttgtcattgaaggattgcatccattgtacgatgcacgagttagagatcttctggacttcagtatttacctggatatcagcaatgaagttaaattcgcatggaaaattcagagggacatggctgaaagaggacacagtctcgaaagcatcaaagctagcatcgaagcccgaaaaccagatttcgatgctttcattgacccacagaagcaatatgcggatgcagttatagaagtgttgcctacacaactcatccctgatgacaatgagggcaaatacttgagagttagattgatacaaaaagaaggggttaaatttttcaacccggtttacctctttgacgaaggctccaccatctcatggataccctgtggtcgcaagctgacgtgctcatacccgggcatcaagttcacttatggccccgacacttactatggcaatgaggtctcagtgttggagatggatgggcaattcgacagactagacgagctcatctacgtcgaaagccatctgagcaacctttcgtccaaattctatggcgaagtaactcagcaaatgctaaagcacgcagatttcccaggtagcaacaatggcaccggtcttttccagaccatcgtcggcttgaagatcagagacctttacgagcagcttactacaaccaaaacaagcaaaactgcagctccattgaaagctacaaaggcctaaataaatatcctatttttttccctctttgttcaaaacactgtgttgtgtatcagttgagtgttatataaatactcataaaa

SEQ ID NO: 1362 - DNA, 1952 bp, Theobroma cacao
ttgaaatgacccttttatccactgccaattgaaccaagtccatttgagtccctttcattctcaccttaatatcacctccaaacttgtccaaaactaggggcagtcacagaaacccataaattaaagacacctcagctttgcatcaccagagcaatactgttttcttcctttacatactgccatctgttttcttcaatcttttcctcttcattatttgtgttccaaaattttccttggaaatcaaaggacaagaatccaaactcgtttttgcttggtcttagaggaccatctaaacaatttgccagggcatcccatttcagtaatctctctctgtctcgaagctctctaaattcccctttccggggcagacagaagaggagaaaaaaagagagctaagaaatggcagtctgcacagtatacacaactcaatctctcaattcgacatgttcaatctccacaccaacgaaaacccacttgggttttcaccaaaagcaggtggtgttctacagcactggcaagagaactagcaaaagaggtagcagcagcagcggcggcccgtgtgtcataacctgctcagctgttgattcacaaacagttgtgattggtctggctgcaaactcaggatgtgggaagagtaccttcatgagacggctaacaagtgtgtttggtggtgcagcagagccacccaggggaggcaaccctgactcgaacactctcatcagtgacatgaccaccgtgatttgcttggatgattatcattcacttgacagaactggaaggaaagagaagggagtgacagcacttgacccaagagctaacaactttgacctcatgtatgagcaagttaaggctctcaagagtggtgttgctgttgacaagcctatttacaaccatgttactggtctcttggatcctcctgagctcattaagcctcctaagatccttgtcattgaaggactgcaccctatgttcgatgagcgtgtgagggatctgttggacttcagtatctatttggatatcagcaatgaggtcaaatttgcatggaaaattcagagggacatggctgaaagagggcatagccttgaaagcattaaagctagtattgaagccaggaagcccgatttcgatgcctttattgatccacaaaagcaatatgctgatgcagtaattgaagtgctgccaactcagctcatcccaggagacaacgagggaaaggttttgagagtgaggctgataatgaaagaaggggtgaagcatttcagcccggtttatctgtttgatgaaggctcaaccctctcatggataccatgcggaaggaagctcacttgctcttaccctggcatcaaattccattacggccctgacacttactttggcaacgaggtttctattctggagatggacgggcaatttgacagattagatgaactcatttacgttgaaagccatttgagcaacatttctaccaagttctatggagaagttacccagcaaatgttgaagcatgctgatttccctggaagtaacaacggaaccggcctgttccaaaccattgttggattgaagataagagatctgtatgagcaaatcaccacaagcaaaactgcaactccactagaagcaacaaaagcctaaagagctgcctttggggttcataaaattatatcctcttttcagttttcgcctttccacttcctcccttcttcacgtttgactcttgagcgttaggctgttcctctcataagaattgagttatactcttttgtatttattgtctgttgtaattctgtggagatatgtaatatggagaaacaaaaatcagagatcaaattcaagttaagaagttcatagaagacgaagcttttgacatcatctctcctcttctacgtccctattgttcgtaccattgatgatgctataatcttcaaaaaaaaaaaaccattgatgatgct

SEQ ID NO: 1363 - DNA, 1470 bp, Lactuca sativa
agagagagagagagagaatggcagcgtgcacagtatacacactccaagctctcaacacaacatgctcgatctcaacacccacaaaaacccacctgggattcaaccaaaagcgagtctttttctacagcaatggaggtaaagggacaagtagtggcaagatgagaggtggtgaaataacatgctcaggggacacaatagtaatcggacttgcagccgattctgggagtgggaaaagtaccttcatgagaaggttgaccagtgtttttggaggtgcagcttcccctccaaaaggagggaatcccgactcaaatacactcataagcgatacaactacagtcatatgtctggatgattaccattctttggacagaactggaaggaaagaaaagggagtgactgcacttgatccacgagccaatgactttgatcttatgtatgaacaggttaaagctcttaaaaatggtgttgctgttgagaagccgatttataaccatgttactggtcttttggatcctcctgaactcatcaaatcccctaagattcttgtcattgaaggtcttcacccaatgtatgatccgagagttagagatctcctagacttcagtatctacttggacatcagtaacgaagttaaattcgcctggaaaattcagagagacatggcagagagaggacacagtcttgaaagcattaaagctagtatcgaggctagaaaaccagattttgatgcttatattgatcctcaaaagcaatatgcagacgcggttattgaagtgttgcctacacgtctgattccagatgacaacgagggaaaagtgttgagagtgaagctgatcatgaaagaaggagttccatactttaatcctgtgtacttattcgatgaaggttccacaatctcatggatcccatgcgggaggaagctcacttgttcgtatcctggcatcagcttctcatatggcccagacgcttactttgggcatgaggtttcggtgttggagatggatgggcagtttgatagactagatgaactcatctatgttgaaagccatttgagtaacatctcaacaaaattctatggtgaaatcacacaacaaatgttgaagcatgctgactttccgggtagcaataatggcactggtctctttcaaaccattgtagggttgaagatccgggacttgtttgaacaaattgcagctaaaagggagtcgactccacttcaatctacaaaaagttaaatattataaacaagcggtttctgagtgtttcaatcgcatatgtatttaagttccagctgtgtattggagatgtgtacgtaatataaaggaatccaattcataaatgataactttaatttaagatacgtaaaagcagtatcatttgcattttccaggtggcaattttgttgacacttgtcatgatgctgattttagtcaagaaaacatgatataagaaaacatgatataattttag

SEQ ID NO: 1364 - DNA, 1555 bp, Triphysaria pusilla
atttatcacaaacatcatcttctcatcaaaaaaattcacaatccataaataataacaataacactacaatttccttaattttattatattgggaaattcttcccaaccataattcaaaaaagaaaattatttaaaaagccaaattttcttgaaaaatcacactctctaaataacactcactaatctcctagagagtgaagaaaaagaagaagaaaaaaatggcagtttgtacagtctacacagttcaatccctacactcaatctcaacaccaccaaaaacccacttaggattcaaccaaaaacaagtgttcttctacagcacaaccaagaaaccgataaaatccaagtctttttcgactgaaatctcatgctcagccgatgacaagactgtagtaatcggcctggcagccgactctggctgtgggaagagcactttcatgcggcggctcacgagcgtgtttggcggtgcggctgagccgccaaagggaggcaacccggactcaaacacgcttataagcgaaatgacgactgtgatttgtttggatgactatcactcactggacagaaccggacggaaggaaaagggagtcactgcattggatccaagagctaatgactttgatctcatgtatgagcaggttaagtctattaagaatggtgttgctgttgagaagcctatttataatcatgtcactggtttattggacccgccggagctgattaagtctcccaagatttttgtcattgaaggattgcatccattgtacgatgcacgagtgagggatcttctggacttcagtatttacctggacatcagcaatgaggttaaattcgcatggaaaattcagcgtgacatggctgaaagaggacacagcctcgaaagcatcaaagctagcatcgaagcccgaaaaccagatttcgatgctttcattgacccacagaagcaatatgcggatgcagttatagaagtgttgcctacacaactcatccctgatgacaatgagggcaaatacttgagagttagattgatacaaaaagaaggggttaaatttttcaacccggtttacctctttgacgaaggctccaccatctcatggataccctgtggtcgcaagctgacgtgctcatacccgggcatcaagttcacttatggccccgacacttactatggcaatgaggtctcagtgttggagatggatggacaattcgacagactagacgagctcatctacgtggaaagccatctgagcaacctttcgtccaaattctatggcgaagtaactcagcaaatgcttaagcacgcagatttcccaggcagcaacaatggcaccggtcttttccagaccatcgtcggcttgaagatcagagacctttacgagcagcttactacaaccaaaacaagcaaaaccgcagctccattgaaagctacaaaggcctaaataaatatcctatttttttccctctttgttcaaaacactgtgttgtgtatcagttgagtgttatataaatactcataaaaacaagtaagattgataatcacttcaaattcaacaaa

SEQ ID NO: 1365 - DNA, 1563 bp, Vaccinium corymbosum
aaacaacaaaacccaattcaaaattttcatgaaaacaagctaagtattcacatctcttcctcctctctcaaaatcccctcaacctctttatctgggtggaggagagattgagaaaatggctgtctgcacagtctacaccatccaatccctcaactcaaattgctcaatctcaaaacccaacaaaacccacttgggattgcaccagaaacaggtggttttctacaacaaaaccaagagatcacagagcacaatcacctgctctgctgctgatgagaagacagtagtgattggtttggcagctgactcaggttgtggaaagagcactttcatgaggagattgaccaatgtttttggaggggcagctgagccaccaaaggggggaatccagattctaacacactgattagtgatatgaccactgtgatttgtttggatgattatcactcacttgatagaactgggaggaaacagaaaggggtgactgcacttgatccaagggccaatgattttgatctaatgtatgagcaggttaaggcaattaaagatggaattgctgtggacaagcctatttataatcatgttagtgggcttctggatccacctgagctcattaagcctcctaagatccttgtcattgaagggttgcacccaatgtacgatcagcgtgtaagagacctcctggatttcagtatttacttggacataagcaatgacgtcaaatttgcttggaaaattcagagggacatggcagaacgaggacatagtcttgagagcattaaagcaagtattgaagcccggaagccagattttgatgcttacattgatccacagaagcaatatgcagatgcagtgatagaagtattgccaacacaactgattcctggtgacaatgagggaaaagtgttgagagtaaggttgataatgaaagaaggggtgaagtatttcaacccagtatacctgtttgatgaaggctccacaatcaactggataccctgtgggaggaaactcacttgctcctaccctggcatcaaatttacctatggcccagagtcttactttggtcatgaggtttctgtgttggagatggatggccaattcgatcggttagacgagctaatttacgttgagagccatctaagcaacatctcaaccaagttctatggagaagtcacgcagcaaatgttgaagctctctgatttcccaggaagcaacaatggaaccggtctcttccagaccatagttggcttgaagatcagagacctctacgagcaaattatcgctgcaaaagctgcagctccattgcaagccacaaaagcatgaaaagcgccttatagagtaacccaagcaacaacttgttgaaaagtttctctctccaccattgggattttcactcattttcctacatatttttgttttcccctccctctttcatgtttcaggtgagtgttagggtacacccccataaggatgagaaacattccatttgtactaatttgtaagttggaaactttcaggagatttgtaaaatagagaagtgaaaggagaaatgaaattcagttaaga

SEQ ID NO: 1366 - DNA, 1439 bp, Triticum aestivum
ttctttcatcaagctctctcttctccccaagtctcagttacaacttacaaggcttgaaggggagaagagcagctccaagaggttgggcagcaaacatggcattctgcagcccacacaccaccgcatccctgcgctccccatgcaccaccatcccaaactcaggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcaccagcgtgtttggaggtgccgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaggtgctgcgtgttaaattgatcatgaaagaaggcattaagttcttcaacccggtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccattgtaggactgaagattagagatctctatgaacagatcatcgctgagagggccggcgttcctgctgaagcagcaaaagtttgatgagccccaaattcaagttcacgaatcatttcatcaccaactcaatgagaatgagcatcctcgcatttcttgtacctagtttgaatatattacagctagaagacggtagaaagttcactgcagaactcat

SEQ ID NO: 1367 - DNA, 1247 bp, Zostera marina
aaccaacatttctcttcttcctcaaagagctagaaggaagcttggtggccagaagagaaaaaatggcagtctgcacagtctactctcctcattctctcaaatccacatgcccaattccaaatacatcaagaatccaattgggttctcatcagaagcaagttattttcttcacaaggagaaaaggcggcaactacagaagcaataagttatccggtaccatcacctgtgaagcaaacacaattgttatcggtcttgcagcagattcaggatgtggaaagagcacattcatgaggagacttactagtgtatttggtggagcagcatcacctcccaagggtgggaatccagactcaaacacgcttatcagtgacacgacaactgtgatatgtcttgatgactaccactctctcgatagatatggaaaaaggagcagggtgttactgcacttgatccaaaagccaacaactttgatctcatgtatgaacaagttaaggcacttaaacaaggtattgctgtggagaaaccaatttataatcatgttactggaattctcgatcctcctgagctcattcaacctcccaagatcctggttattgaaggactgcacccaatgtacgattctcgtgtccgtaatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaagggaaggtgttgagagttaagctggtgatgaaggaaggagtgaaatatttcagtccctcgtacctctttgatgaaggatcaaccatcgattggatcccatgtggaagaaaattgacttgttcatatccaggaattaagttctcttatggtccagacagttactactcaaacgaggtatctgtgttggagatggatgggcaattcgacaaattagacgaactgatctatgtggagagtcatctgagcaacctctcgacaaagttctacggggaatgactcaacagatgctgagcctttccaacttccctggaagcacaaatggaactggtctcttccagaccattgttgggatgaagataagagacttatatgaacagataattgcagaaaagaa

SEQ ID NO: 1368 - DNA, 1501 bp, Sarracenia psittacina
caaattctctcccaactcctttctggttagagagagaagtgaaaatggcaacctgtactaccactgtctacaccattcaatccctcaactccaccagctcaatctcaacacccacaaaaacccacttgggatctcaccataaacaagtagttttttatagccatggaatcaaaaacagcagaaaaggcactactaatattactactaccaccaccattacatgctcagctgacaaaactgtggtgataggtttggcagctgactctgggtgtgggaagagcaccttcatgaggaggttgacaagtgtgtttggaggggcagctgagccaccaaggggtgggaatccggactcaaacactctcataagtgacacgaccactgtgatatgtttggatgactatcactcattggacaggacagggaggaaagagaagggagtcactgcacttgatccaagagccaacaattttgatctcatgtatgagcaggttaaggccctcaagagtggaattgctgttgaaaagcctatttataaccatgtcactggtcttctagatccacctgagctcatcaagccccctaagatccttgtcattgaagggttgcacccaatgtatgatgagcgtgtaaggaaactattggatttcagtatctacttggacatcagcaatgatgttaatttgcatggaaaattcagaggacatggcagagcggggacacagtcttgaaagtatcaaagctagtatagaagcccggaagccggattttgatgcttacattgatacacaaaagcaatatgctgatgctgtgattgaagtgctgcctactcaactcattccgggcgataatgaggggaaagttctgagggtaaggttgatcatgaaagaaggggtgaagtatttcagcccagtttatctgtttgatgaaggctccaccatcacctggataccctgcggaagaaaactgacgtgctcgtaccccgggatcaaatttttctacggacccgaggcttacttcggtcacgaggtgtcggtgctggagatggatggccagtttgacagattagatgagctcatctatgtggagagccatctcagtaacatctccaccaagttctatggtgaagtcacccaacaaatgttgaagcatactgattttcctggcagtagcaatggaactggtctcttccaaaccatcgtcggcttgaagatcagagacctgtttgagcaaattgtcgccagtaaggttgcagctccattggaagccacaaaagcctgaagggtatcttgtatactaagtcaaagcaccaactcatctgatattacccaaatcagccttttccctcgtttctcttcagattttatttttccttctctccgatatttcaggtgagtgttaggctgctactcataagaatgagaaacactccatttgtacttatttccagttgggagtttgtgtagacttgtacaatagagaaacgaaagcaaaaatgaaattg

SEQ ID NO: 1369 - DNA, 1494 bp, Cucumis melo
tcttcttcttcttcactccctcaactgctgagagagagaagaaaaatagaaaaagaaaaaagaaaaatggcagtttgtacagtgtacacaactcaatccctaaactcaaccttctcatcatcaacaaaatcccacttgggattccaccaaaagaaccaacaactagttttcttgagtagcaatgggaagaaatgggggagcggcaataaaagagatggtcacaacactgtgactaacaacaatccttatcttataacttgctctgcagctgaccaacagacaatcgtgattggtttagcagcagattcagggtgtgggaaaagcactttcatgagaagattaacaagtgtttttggaggagcagcagagccaccaaagggtggtaacccagactcaaacacactcataagtgatactactactgtcatttgtttagatgattatcattcattagacagaacagggagaaaagagaaaggagtcacagcacttgacccaagagccaatgattttgatctcatgtatgaacaagttaaagcaattaaaagtggtgtctctgttgataagcctatttacaatcatgtcactggtcttcttgacccccctgagctcattaaaccccctaaaatccttgtcattgaaggtttacaccccatgtatgattcaagagtaagagatctgttggacttcagtatctacttggacatcagcaatgaagttaaatttgcatggaaaattcagagggacatggctgagagaggacacagtcttgaaagcatcaaagcgagtattgaagctcgaaaacccgactttgatgcctatatcgacccacagaagcaatacgcagatgcagtgattgaagtgttgccaacaaaactgattccagatgataatgaaggaaaagttttgagagttaggctgataatgaaggaaggggttgagttttttaacccagtttatttgtttgatcaaggctctacaatttcatggataccatgtggaagaaagctcacttgctcttaccctggcatcaaattctcctatggccctgaaacttactatggccacgaggtatcggtgcttgaaatggacgggcaatttgacagactggacgagctgatctatgtggaaagccatctaagcaacctgtcgacaaaattctatggtgaagtgactcaacaaatgttgaagcattcggacttccctggaagcaacaatggcacaggcttcttccaaaccatagtcggattgaagatcagagatctgtatgagcagattacagctagtagggtcaaggcgccggttgaggctgcaaaggcctgaacttagtgcctccaacgagaggattttctcagtcgtccgtggccgatttcatctggatttggctttcaatttaagctttgtgtttattaggctgctttacaatgaatttgttgttatgaatgaatttactgatcggtggagatttgtgatgtaaaaaaaaaaaaaaaaaaa

SEQ ID NO: 1370 - DNA, 1596 bp, Avena sativa
ctctctctcttctcctcaagtctcagttacaaggcttgaagggaagaagagcagctccagcaaggagcgaaggttgggcagcaaacatggcattctgcagcccacacaccaccacatccctgcactccccacgcaccaccatcccaaactcaggcttcaggcagaaccaagtcatcctcttcacaaccagaagcagcaggaggagtaacacgaggaatggagcaaggaccttccaggtttcatgcgcagttgacaagccaatagtgattggcctggcagcagactcaggatgtgggaaatccaccttcatgcgccggctcaccagcgtgtttggaggtgctgcagagccacccaggggcgggaacccagactcaaacacgctcatcagcgacaccacaacggtgatatgcctcgatgactaccattccttggacagaaccgggaggaaggagaaaggtgtgaccgccctggaccccaaggcaaacgactttgatctcatgtatgagcaggtgaaggcaatcaaagaaggcaaggctattgagaagccaatctacaaccatgtcaccggcctgttggacccgccggagaccatccagccccctaacatcttcgtcatcgagggtttgcacccaatgtacgatgcacgtgtgagagacctccttgacttcagcatctacttagacatcagcaatgaggttaaatttgcatggaaaattcagagggacatggcagagcgtgggcacagccttgaaagcatcaaggctagcattgaagcccggaaaccagattttgatgcatttattgatccgcagaagcaatacgccgatgctgtgattgaagttctgccaacccagttgattcctgatgacaatgaaggaaaggtgctgcgtgttaaattgatcatgaaagaaggcgtgaagttcttcaacccggtttacctcttcgatgaaggatcaaccatcaattggatcccttgtggaagaaagcttacatgctcttaccctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaacggaacaggtctcttccaaaccatcgtaggtctgaagattagagatctctatgaacaaatcattgctgagagggtcggcgcacctgctcaagcagccaaagtttgatgagccccaaattcagattctgcgaatcatttcatcatcaactcaatgagaatgagcatcctctcttgtaactagtttggaaatattacagctagaagacggtagaaagttcattgcagaactcatgaaaatctgcatttgaacttctcgaaaaccctttccatgagggtggcctacgtatcctgttaacacattcgatgtacatcttctcccatgtttcaatgaagaaaatacatgtgctactttcattgagctcccacgttacaagtagttgcttccattgggaaaaaaaaaa

SEQ ID NO: 1371 - DNA, 1420 bp, Phalaenopsis aphrodite
caaaagcaaacacctttctgctccctctctccctctcttcatccataaacagccataaaaatggcagtttgcacagcctacacctctccttcccatcaccacttcatcttctccactcacagacccaacagaagaataataacagggaaaatctcatgctcttcagaaaccaacacagtagtaatcggccttgctgctgattcaggctgcggaaagagcactttcatgaggagactcaccagcgtttttggaggagcagctgagccgccgaagggagggaatccagattctaatactctgataagcagcactaccactgtaatttgccttgatgactaccattctttggatagaacagggaggaaggagaaaggggtgacagctttggatcccagagccaatgattttgatcttatgtatcagcaagttaaggatttgaaggaagggaaagctgtggagaaacctatttataatcatgttagtggtctgcttgatcctcctgagcttatcaggcctcccaaaatcttagttattgaaggtttgcatccaatgtatgatgctcgtgtgagagaattattggatttcagtatttacttggatatcagcaatgaggtcaaatttgcatggaaaattcagagagacatggcagagcgtggacatagccttgaaagcattaaagcaagcattgaagctcggaaaccagattttaatgcttatattgatccacaaaagcaatatgccgactgcgtgatcgaggtcttgccaacccaactgatccctgatgacaatgaaggaaagattctgagggtgaagttggtgatgaaagaaggtgttaagcacttcagcccagtctacctctttgatgaaggctccaccgtttcatggataccctgtggaaggaaactcacctgctcctatcctggcatcaagttcttctatggacctgacacctactttgatcatgaggtttcagtgcttgagatggatggccaatttgatagattggacgagctcatttatgttgaaagtcatctcagcagtttatcgaccaagttttatggagaggtaacgcagcaaatgctgaagcattcagactttccaggaagtaacaatggaacaggtttatttcaaacaatcgttggtttaaagattagagatttatttgagcaggttatcacagagaattcttctgctccagctgtatctaaagtttgaatcagtactctcttttagtttctatgttttatggtcttacaatgagaggggagcgcaaaacttgttcatattgaatgtaacaggtttctgtaatattgcagggaacataaattcagtgatctcttgttctaaagtgagttatttgtatctgttcttgaattcccaccatcatctgttataaaattgaagtgatgtataaaaaaaa

SEQ ID NO: 1372 - DNA, 1271 bp, Prunus persica
tgctccaaaatggcaatttgtgcagtttacacaaccacccaactgaacccaacatgttcattttccacaccagcatcaaaaacccaaacccagctgggatttggattggggttctgccagaagcagcaggtggtgttttacaagagaagtcaaagtaatagcagaagagcaagtgtgagtttgataacatgctccgcgggtggccaagagacggtggtgattggtctagcagcagactcagggtgcgggaagagcacattcatgaggaggctgacgagcgtgttcggaggagccgcggagccacccaagggaggcaacccggactcgaacacgctcatcagcgacactacgacagtcatatgcttggatgattaccactctctggataggacagggaggaaggagaaaggggtgactgctcttgacccaagagccaacaactttgatctcatgtatgagcaggtcaaggcaatcaaggaagggaaagctgtcgataagcccatttacaaccatgtctctggtctcttggaccctcctgagctcatcaagccccccaagattcttgtcattgaaggcttgcacccaatgtatgatcagcgagttagggacctgttggacttcagcatctacttggacatcagcaatgaggtcaagtttgcatggaaaattcagagggacatggcggagcgtggtcacagtcttgagagcatcaaagccagtattgaagcccggaagcctgatttcgatgcttatattgatccacaaaagcagtacgctgatgcagtgattgaagtgttgccaacccaattgattccaggggataatgaggggaaggtattgagagtgaggttgataatgaaagaaggtgtgaaatttttcaacccagtctacttgtttgatgagggctccaccatctcctggataccatgtggaaggaagctcacctgctcttaccctggaatcaagttcacctatggccctgacacttactttggcaacgaggtgtctgtgttggagatggatgggcaatttgacagattagatgagctgatctatgtagaaagccatctgagcaacatctccaccaagttctatggagaagtcacccaacaaatgttgaagctttcggacttccccggcagcaacaacggcactggtctcttccaaaccatagtcggattaaagatccgagacctctttgagcagctcattgcaagcaaggccaaaactccagtagaagcaactaaagcttaaattaaaactatgcctta

SEQ ID NO: 1373 - DNA, 1362 bp, Utricularia gibba
acacgcttcagtccgtcaactccatctgcagctcctcctttagcttcacccacaaacaccaacagcaacacctcctcgtctgcacgggcaacaagcaccggatatcgtgctccgccacctcatccgatgacaagaccgtcgtcatcggcctcgctgccgattccggatgcggcaaatcgactttcatgcgccgcctcactagcgtcttcggcggagctgctgagcccccgaagggcggcaacccggactccaacacgcttataagcgacaccactaccgtcatctgcctcgacgactatcactcccttgatcgcactgggaggaaggagaagggggtgacggcgcttgacccgagagctaacaacttcgatctgatgtacgaacaagtgaaggcattgaaagatggaatcgcagtggagaagcctatctacaatcatgtcagcggtttgcttgaccccccggagctcattaagcctcccaagattctggtcatagagggcttgcatccaatgttcgatagccgtgtaagagatctgttggatttcagcatctatttggacatcagcaatgaagtcaaattcgcttggaaaattcagagagacatggctgaaagagggcacagcttggagagcatcaaggccagcatcgaagcacgaaagcctgatttcgatgcatatatcgatccgcaaaagcaatatgcagatgcagtcatagaagtgctacctacgcagctgatcccagatgacaatgaggcaaggttctgagagtgaggctgatcatgaaagagggtgtaaaatacttcaaccctgtttatctctttgatgaaggctccacaatttcatggatcccctgtggaagaaagctcacttgctcctaccccgggatcaaatttggctacggcccagatacttattacggccatgaggtctctgtggtggagatggatgggcagtttgatagactggatgagctgatttacgtggagagtcacttgagtaacctttctaccaagttctatggggaggtgacacagcaaatgctgaagcattcagattttcctggcagcaacaatgggacagggctgtttcagacaattgttggtctgaaaatcagggatctctatgagcagatctctgctgcaagaaaatcagctgccccattgcaagctgccaaggcatgatgatgtggggaggagggaaatggagagggtggtggtgttgttgtatttatttattcttcgcttgaaaccgaaaagcaaacccttggagatataacttgtaatcagtgtaaagaaaaggcgaacagcttgaaatgaagacacagcaagattcagtgtttcccattactaaaaaaaaaaaacac

SEQ ID NO: 1374 - DNA, 1383 bp, Medicago truncatula
aaattctttaccttagagagaaagagagaacaataatattgagtgagaatggcagcttgtactgtctactcaacacaacctctaagaacaaacatctcaattccaacatcatcaaaaacacatgttggttttaatcaaaaacaggtagtgttctacacaacaaccaaaaagagcagcaacagaagaactaacagtaacaacagaagatacctgataacatgtggagcaggtgactcacagacaattgtgattggtctagcagctgattcaggatgtggaaaaagtactttcatgagaagactcacaagtgtttttggaggtgcagcagaaccaccaaaaggtggaaatcctgactcaaacacacttatcagtgacacaaccactgtgatatgtttggatgattaccattctttggatagaactggtagaaaagagaaaggtgttactgcacttgatccaagagctaatgattttgatcttatgtatgaacaagttaaagctattaaagagggtgtttctgttcaaaaacctatttataatcatgttactggtcttttagatcctcctgagcttattaaaccacccaaaatcttggtcattgaaggtcttcacccaatgtatgattctcgagttagagatcttttggacttcagtatctacttagatattagcaatgaggtgaaatttgcttggaaaattcagagagacatggcggaacgtggacacagtcttgaaagtatcaaggctagcattgaagcaaggaagcctgattttgaagcttatattgatccacaaaagcaatatgcagatgcagtgatagaagtgttgccaacccaactaattcctgatgataatgaaggaaagattttaagagtgaggttgatccagaaagagggtgttaaatattttagcccagtttacttgtttgatgatggttctacaatttcatggataccatgtggaaggaaacttacatgctcttatcctggcattaaattttcctatggaccagagacttacaaaggaaatgaggtgtcagttgtggaaatggatggacaatttgacagactagatgaactaatatatgttgagagccacttaagcaacctatcttccaaattctatggagaagttactcaacaaatgttgaagcatgctgatttccctggtagcaacaatggaacaggtctcttccaaaccatagttggtttgaagataagagatttatttgagcagatagtagcaagcagggctgagactccagtaggagcagctaaagcttaggaagaacatgccttatatatatatacataatattggacaaggcagccattgaattctatcccaaatcattttctatttttgtgttttccacaattcctg

SEQ ID NO: 1375 - DNA, 1379 bp, Triphysaria pusilla
atcatcttctcatcaaaaaaattcacaatccataaataataacaataacactacaatttccttaattttattatattgggaaattcttcccaaccataattcaaaaaagaaaattatttaaaaagccaaattttcttgaaaaatcacactctctaaataacactcactaatctcctagagagtgaagaaaaagaagaagaaaaaaatggcagtttgtacagtctacacagttcaatccctacactcaatctcaacaccaccaaaaacccacttaggattcaaccaaaaacaagtgttcttctacagcacaaccaagaaaccgataaaatccaagtctttttcgactgaaatctcatgctcagccgatgacaagactgtagtaatcggcctggcagccgactctggctgtgggaagagcactttcatgcgacggctcacgagcgtgtttggcggtgcggctgagccgccaaagggaggcaacccggactcaaacacgcttataagcgaaatgacgactgtgatttgtttggatgactatcactcactggacagaaccggacggaaggaaaagggagtcactgcattggatccaagagctaatgactttgatctcatgtatgagcaggttaagtctattaagaatggtgttgctgttgagaagcctatttataaccatgtcactggtttattggacccgccggagctgattaagtctcccaagatttttgtcattgaaggattgcatccattgtacgatgcacgagtgagggatcttctggacttcagtatttacctggatatcagcaatgaggttaaattcgcatggaaaattcagcgtgacatggctgaaagaggacacagcctcgaaagcatcaaagctagcatcgaagcccgaaaaccagatttcgatgctttcattgacccacagaagcaatatgcggatgcagtgatagaagtgttgcctacacaactcatccctgatgacaatgagggcaaatacttgagagttagattgatacaaaaagaaggggttaaatttttcaacccggtttacctctttgatgaaggctccaccatctcatggataccctgtggtcgcaagctgacgtgctcatacccgggcatcaagttcacttatggccccgacacttactatggcaatgaggtctcagtgttggagatggatggacaattcgacagactagacgagctcatctacgtcgaaagccatctgagcaacctttcgtccaaattctatggcgaagtaactcagcaaatgcttaagcacgcagatttcccaggcagcaacaatggcaccggtcttttccagaccatcgtcggcttgaagatcagagacctttacgagcagcttactacaa

SEQ ID NO: 1376 - DNA, 1551 bp, Triphysaria pusilla
atttatcacaaacatcatcttctcatcaaaaaatttcacaatccataaataataacaataacactacaatttccttaattttattatattgggaaattctttccaaccataattcaaaaaagaaaattatttaaaaagccaatttttcatgaaaaatcacactctctaaataacactcactaatctccgagagagtgaagaaaaagaagaagaaaaaaatggcagtttgtacagtctacacagttcaatccctacactcaatctcaacaccaccaaaaacccacttaggattcaaccaaaaacaagtgtatttctacagcacaaccaagaaaccgataaaatccaagtcattttcgaccgaaatctcatgctcagccgatgacaagactgtagtaatcggcctggcagccgactctggctgtgggaagagcactttcatgcggcggctcacaagcgtgtttggcggtgcggctgagccgccaaagggcggcaacccggactcgaacacgcttataagcgaaatgacgactgtgatttgtttggatgactatcactcactggacagaaccggacgcaaggaaaagggagtcactgcattggatccaagagctaatgactttgatctcatgtatgagcaggttaagtctattaagaatggtgttgctgttgagaagcctatttataatcatgtcactggtttattggaccctccggagctgattaagtctcccaagatttttgtcattgaaggattgcatccattgtacgatgcacgagtgagagatcttctagacttcagtatttacctggacatcagcaatgaggttaaattcgcatggaaaattcagagggacatggctgaaagaggacacagcctggaaagcatcaaagctagcatcgaagcccgaaaaccagatttcgatgctttcattgacccacagaagcaatatgcggatgcagtgatagaagtgttgcctacacaactcattcctgatgacaatgagggcaaatacttgagagttagattgatacaaaaagaaggggttaaatttttcaacccggtttacctctttgacgaaggctcgacaatctcatggataccctgtggtcgcaagctgacgtgctcatacccgggcatcaagttcacttatggccccgacacttactatggcaatgaggtctcagtgttggagatggatgggcaattcgacagactagacgagctcatctacgtcgaaagtcatctgagcaacctttcgtccaaattctatggcgaagtaactcagcaaatgcttaagcacgcagatttcccaggcagcaacaatggcaccggtcttttccagaccatcgtcggcttgaagatcagagacctttacgagcagcttactacaaccaaaacaagcaaaaccgcagctccattgaaagctacaaaggcctaaataaatatcccattttttccctctttgttcaaaacattgtgttgtgtatcagttgagtgttatataaatactcataaaaacaagtaagattgataatcccttcaaattcaag

SEQ ID NO: 1377 - DNA, 1694 bp, Medicago truncatula
ccatttaaaaaatatctatatttactatttattttcctgctaaactccctttgttttgatttaaagttccacctcatatattttatgtgttccaaactttttcttagaatatatgtcccaaataatcctctatccaacttaaactcacttcttcttcaaaaaataaattctttaccttagagagaaagagagaacaataatattgagtgagaatggcagcttgtactgtctactcaacacaacctctaagaacaaacatctcaattccaacatcatcaaaaacacatgttggttttaatcaaaaacaggtagtgttctacacaacaaccaaaaagagcagcaacagaagaactaacagtaacaacagaagatacctgataacatgtggagcaggtgactcacagacaattgtgattggtctagcagctgattcaggatgtggaaaaagtactttcatgagaagactcacaagtgtttttggaggtgcagcagaaccaccaaaaggtggaaatcctgactcaaacacacttatcagtgacacaaccactgtgatatgtttggatgattaccattctttggatagaactggtagaaaagagaaaggtgttactgcacttgatccaagagctaatgattttgatcttatgtatgaacaagttaaagctattaaagagggtgtttctgttcaaaaacctatttataatcatgttactggtcttttagatcctcctgagcttattaaaccacccaaaatcttggtcattgaaggtcttcacccaatgtatgattctcgagttagagatcttttggacttcagtatctacttagatattagcaatgaggtgaaatttgcttggaaaattcagagagacatggcggaacgtggacacagtcttgaaagtatcaaggctagcattgaagcaaggaagcctgattttgaagcttatattgatccacaaaagcaatatgcagatgcagtgatagaagtgttgccaacccaactaattcctgatgataatgaaggaaagattttaagagtgaggttgatccagaaagagggtgttaaatattttagcccagtttacttgtttgatgatggttctacaatttcatggataccatgtggaaggaaacttacatgctcttatcctggcattaaattttcctatggaccagagacttacaaaggaaatgaggtgtcagttgtggaaatggatggacaatttgacagactagatgaactaatatatgttgagagccacttaagcaacctatcttccaaattctatggagaagttactcaacaaatgttgaagcatgctgatttccctggtagcaacaatggaacaggtctcttccaaaccatagttggtttgaagataagagatttatttgagcagatagtagcaagcagggctgagactccagtaggagcagctaaagcttaggaagaacatgccttatatatatatacataatattggacaaggcagccattgaattctatcccaaatcattttctatttttgtgttttccacaattcctgtattgtatgttattttgtgtatgaaaatactttgcatgtacttatttatgtaatatgttgtattaataatatagaggagaaaaagcaggactgagatttcagttatgttgataaaaagatttgaacaatttgtcatcactggctcta

SEQ ID NO: 1378 - DNA, 1801 bp, Cajanus cajan
acctccaaagttgtccaaaacaaggggtagtcacagaaatccctaaacaataacgcaccattttttcttttcctgcttagccttttgttttggttataattccacctcatattttatgtgttccaaacttcttcttggaatgtcccctccataataatcctcaaacaaaagccaccagagagagagcaaagctcattctctttagagagagcaaaaaagaatggcagcttgcactgtctactcaacacaatctctgagcacaaactgctccatctcaaccccagcaaagacacaacatggttttcaccaaagacaggtagttttctacaccacaagcaggaggaacagcaagaggggcagcctcagtggcagcagcaggtatgtgataacatgtgcagctggtgactcacagacagtggtgattggcctggcagctgactcaggttgtggtaagagcaccttcatgaggaggctgacaagtgtgtttggaggagcagcagaaccaccaaagggtggcaaccctgactccaacactctcatcagtgacaccaccactgtcatatgcttggatgattaccactctttggatagaactggcagaaaagaaaagggagtcactgctcttgaccctagagccaacgattttgatctcatgtatgaccaagttaaagccctcaaggatggaattgctgttgaaaaacctatttacaaccatgtcactggcctcttggatccacctgagctcatcaaaccccccaaaatcttagtcattgaagggttgcacccaatgtttgatcctcgagtcagagacctcttggacttcagcatctacctagacattagcaacgaggtgaaattcgcttggaaaattcagagagacatggcagagcgtggacacagtcttgaaagcatcaaggctagcattgaagcaagaaagcctgattttgaagcatatattgatccacaaaagcaatatgctgatgcagtgatagaagtgttgccaactcaactgattccagatgacaatgagggtaagattttgagagtgaggttgatacagaaagagggggttaagtattttagcccagtttacttgtttgatgacggctccaccatttcctggataccatgtggaaggaagcttacatgttcataccctggcatcaaattcttctatggaccagagacttactacggaaatgaggtgtcagtagtagaaatggatggacaatttgacagactagatgaactaatttacgtagagagccacctaagcaacctctcaaccaagttctatggagaggttactcaacaaatgttgaagcatgctgatttccccggcagcaacaatggcacaggactcttccaaaccatagttggtttgaagataagagatctatatgaacagattatatccaccaaggctgagactccagtaggagcagcaaaagcttaggaacctgccataatatatatacacatgccattcatcaattctcattatcattttcttctttcatgttttccactctatttcatgttattttctttatcgttattaggatgttctgcatcataatccaaacactatgtatgtatgtatgtatgtacttatctgagaagaaaaagcgaggctgagattcacttatgttgatacaacattgagacaataatttccttctctttctctgcatagtctgtgctggcattacgcatatatatatatactaataaccatgaataatttttcttgacatttttctgtgtggtttaaaacttaaatcaaagtgaacgatctttt

SEQ ID NO: 1379 - DNA, 1463 bp, Musa acuminata
acctcccaatttctttcctcaaaaaaccttgggaggaaagagcaaaggctcgattcagctgcagctgagctcatagggaatggcaacctgtgcagtctataccactccatccctccactcatgttctatcaccagcccagcaaagacttcattgggcttccaccaaaggcaggtcatcttcttcactagcaggagaattaccaagagaggagggaggagtacctcagaggtcacgtgctctgctgaggctaagacggtggtgatagggctggcagcagactcgggctgcgggaagagcaccttcatgaggaggctgacgagtgtgttcggaggtgcagctgagccacccaagggaggaaacccagactccaacacattgatcagtgacaccaccactgtcatatgcctggatgactaccactccttggacagaaccgggaggaaggagaagggtgtcactgctctggacccgagggccaacaacttcgacctcatgtatgagcaggtgaaggctctcaaggatggagttgccgttgacaagcccatctacaaccatgtcaccggcttgttggacccccctgagctcatccggccacccaagattctggtcatcgaaggtctgcaccccatgtttgatccccgtgtgagggaactgttggacttcagcatctacttggacatcagcgatgaggtcaaattcgcatggaagattcaaagagacatggcggaacgcgggcacagtctcgagagcatcaaagccagcatcgaagctcgaaagcccgacttcgatgcatacatcgacccgcagaagcagcacgccgatgccgtcgtcgaggttctcccgacgcagttgattcccgacgacaacgaaggcaaggtgttgcgggtgaggttgatcatgaaggaagggttgaagcacttcagcccggtctacctgttcgacgaaggctccaccatctcttggatcccatgcgggaggaagctcacctgctcgtaccctggcatcaagttcgcttacgccccggacacctactactccaatgaggtctcggtgttggagatggacggacaattcgacaggttagatgagctgatctatgtggagagccatttgagcaacctctccaccaagttctatggggaggtgacgcagcagatgctgaagcactccgacttccccggcagcaacaacgggaccggtctgtttcagacgatcgtcgggttgaagatcagggatttattcgagcagattgttgccgagagggcagctgctgttgctgaggcagccaaagtctgagactgcactactcccttaccaaagcagtcatcgtcttcttccgtgcctctttgcatgtttattctcctacacttgtacgcactcatgcgatgattttacttggaatagcaacgcaatgcaggagaggtgaagagaaaacgtgatctccatcaattgagaagctccg

SEQ ID NO: 1380 - DNA, 1877 bp, Brachypodium distachyon
ctagcaagatagttcagtgtctggggaaagaatactgacaagatacgattgtttggaattataggaagaattcattttcgtctcactataagctgcccttgatatcatcagaaaagaaaaggaaaatagggataccacatcatcaccatctcatttccctccttatgttttcctagctcttatctccacaattcttccatccaagtctctcttctcctcaagcctcagttacaaggcttgaagtgaagaagagcagctccaaccggagcaaaagttgggcagcaaacatggcaatctgcagcgcacacaccaccacatccctacgctccccatgcaccaccatctcaaacacaggcctcaggcagaaccaagtcatcctcttcacaaccagaagcagcaggaggggtagcacgagacacggagcaaggaccttccaggtttcatgcacagccgagaagccaatcattattggcctggcagcagactcaggatgtgggaagagcaccttcatgcgccggctcaccagtgtgtttggaggcgctgcagagccacccaagggagggaacccagactcaaacacactcatcagcgacacgacaacagtgatttgccttgatgactaccattccttggacagaaccggcaggaaggagaaaggtgtgaccgccctcgatccgaaggcaaacgactttgatctcatgtatgagcaggtgaaggcaatcaaagaaggcaaggccattgagaagccaatctacaaccatgtcaccggcctcctggacccagctgagctcattcagccccccaagattttcgtcattgagggtttgcacccaatgtacgatcaacgcgtgagggacctcctagatttcagcatctacttggatatcagcaatgaggttaagtttgcatggaaaattcagagggacatggctgagcgtgggcacagccttgaaagcatcaaggctagcatcgaagccaggaaaccagatttcgatgcctatattgatccacagaagcaatacgctgatgctgtgattgaagttctcccgacactgctgattcctgatgacaatgaaggaaaggtgctgcgtgttaaattgatcatgaaagaaggcgtgaaatacttcaaccctgtttacctcttcgatgaaggatcaagcatcagttggatcccttgtgggagaaagcttacatgctcttatcctggcatcaaattttcttatggcccagacacttactttggtcaagaggtatcagtgctggagatggacgggcaatttgacagacttgatgaactcatctatgttgagagccacctaagcaacctctccaccaagttctacggagaggttacacagcaaatgctaaagcattcagacttcccaggcagcaacaatggaacaggactcttccaaactattgtaggactgaagattagagatctgtatgaacagatcattgcagagagagccggcgtacctgctgaagcagcaaaagtttgaagaccgcctcccccccccccccaccccacccccaaacacacacacacattgagatttcatgaatcatttcatcaccagctcaatgagaatgagcatccttgcgttcattgtaactagtttggaaatgttacagctagaagacggtagaaagttcattgcagaactcatgtaaacctgcatttgaacttctcgaaaaccctttccacgagggtgctctcacgtctcttcgtaacacatttcaatgtacatcttccatgttccattgcagaaatacaagtgtttgctactatcaaaagtagtttcttcgtttcagagtgttttttgttggttgttactgctgaccgtgactaacattcataaaagttcatttaagaa

SEQ ID NO: 1381 - DNA, 1461 bp, Cucumis sativus
aaaaatggcagtttgtacagtgtacacaactcaatccctaaactcaaccttctcatcatcaataaaatcccacttgggattccaccaaaagaaccaacaactagttttcttgagtagcaatgggaagaaatgggggagcagcaataaaaaagatggccacaacactgtgactaacaacaattcttatcttataacttgctctgcagctgaccaacagacagttgtgattggtttagcagcagattcagggtgtgggaaaagcactttcatgagaagattaacaagtgtttttggaggagcagcagagccaccaaggggtggtaacccagactcaaacacactcataagtgatactactactgtcatttgtttagatgattatcattcattagacagaacaggcagaaaagagaaaggagtcacagcacttgacccaagagccaatgattttgatctcatgtatgaacaagttaaagcaattaaaagtggtgtcacggttgataagcctatttacaatcatgtcactggtcttcttgacccccctgagctcattaaaccccctaaaatccttgtcattgaaggtttacaccccatgtatgattcaagagtaagagatctgttggacttcagtatctacttggacatcagcaatgaagttaaatttgcatggaaaattcagagggacatggctgagagaggacacagtctcgaaagcatcaaagcaagtattgaagctcgaaaacccgactttgatgcctatatcgacccacagaagcaatatgcagatgcagtgattgaagtgttgccaacgaaactgattccagatgacaatgaaggaaaagttttgagagttaggctgataatgaaggaaggggttgagtttttcaacccagtttacttgtttgatgaaggctcgacaatttcatggataccatgtggaagaaagctcacttgctcttaccccggcatcaaattctcctacggccctgaaacttactatggccatgaggtatcggtgcttgaaatggacgggcaattcgacagactggacgagctgatctatgtggaaagccatctaagcaacctgtcgacaaaattctatggtgaagtgactcaacaaatgttgaagcattcggacttccctggaagcaacaatggcacaggcttcttccaaaccatagtcggattgaagatcagagacctgtacgagcagatttcagctagtagggccaaggcaccggttgaggttgcaaaggcctgaacttagggcgtcgaacgaaaggatttgctcagtccgtggccgatttcatctgggtttggctttcaatttaagctttgtgtttattaggctgctttacaatgaatttgttgttatgaatgaatttactgatcggtggagatttgtgatgtaaaaaaaaacaccaaaaaaggaatcgaaagtagaaatgaaatgcaaattgt

SEQ ID NO: 1382 - DNA, 1992 bp, Lippia dulcis
cttagaatgtccttgcgtatcgttataattattttgttagaagggaaataaaataagatttgacaaaaataccctcgagaaaaatcccaattgccgtatcaaatccactcctttcccaccttaagctcaaatcattttctctaaccataatctctaattcttccattatcttcctgccctcaaaggctcaaaaacactctcctcataatctttctcttatttatcaaaaaacaaaagccccattgttatgcactcctaaatcctctccgaggagaaaaatagaaagaaaaaacaaaaatggcagtttcatctgtccacacagttcaatccctcaactcaacaagctcactctccacgccctcgaaaacccattcattattcaaccaaaaacacatctttctcttctcccaagccaagaaaaccgccacgcgtcgcgccaccaccgtgatatcatgctccgccgacaacaagacggtggtcatcggcctagccgcggactccggctgcgggaaaagcaccttcatgcggcggctcaccagcgttttcggcggcactgctgcgccaccgaagggcggcaatcccgactccaacacacttatcagtaacacgacgactgtcatatgcttggatgattatcactctctcgacaggactggcagaaaagagaagggagtaactgcactcgaccccaaagcaaatgactttgacctcatgtacgaacaggttaaggctctgaaagaaggaaaggctgtggataagcccatttacaatcacgtttcaggtttattggaccctccggagctcattaagcctcccaagattctggttattgaaggtttgcacccaatgtatgattcacgagttagagatctcttggacttcagtatttacctggacatcagcaatgaagttaagttcgcatggaaaattcagagggacatggcggaaagaggccacagcctggaaagcattaaggctagtatcgaagcccgaaagcctgatttcgacgcatacatagatccacagaagcaatacgccgatgcagtgatagaagtgttgccgactcaactgattcccgatgaaaacgagggcaatattttgagagtgaagctgataatgaaggaaggtgtcaagtatttcaaccctgtttacctctttgatgaaggctccaccatttcttggataccctgtggcaggaaactgacttgctcttaccccggcatcaagttcacgtactgtcccgacacttattttggcaatgaggtgtcggtgttggaaatggatgggcaattcgacagattagacgagctgatttatgtagaaagccatttgagcaacatttccaccaagttctatggtgaagtcacgcagcagatgttgaagcattccgatttccccggtagcaacaatgggaccgggcttttccagacgattattgggttgaagattagagatctttacgagcaacttactgctaaaaaaggtgctggacgtttgcaagctacgaggtcctaagaatatggggaaagaaacttcattttttccgtacgaccgtgttgtatcagatgagtgtatgggagatcctcgtgaactggggcatggtctccatcctgtatttgcatttcagttgaaactctctgtggagatctgtaacataggaaaacaaaagcacatcgttagagttcgtgtaaatacacactttctgtttgcatcaagagacaaacagcagagagatcaaaacaagactgatgcgatttcaatagataagaagagtgtattttgtataaaggatagctagagatttgcatggaaaatgcatgtggggctgcgtgtaatttcaagatagttgctctcttcatcgtcccgtttcaatataggattttcgctgtacaaatactggtaatatgtggatgtgatcatgcacttaaaggtaagaaaggataatcagcatgtattattattcacttagatcttgtttggctattttacttc

SEQ ID NO: 1383 - DNA, 1411 bp, Zostera marina
gggagaagaacacttacttctagttaccaaaccaactattttctcttcttcctcaaagagctagaaggaagcttggtggccagaagaagaaaaatggcagtctgcacagtctactctcctcattctctcaaatccacatgcccaattccaaatacatcaagaatccaattgggttctcatcagaagcaagttattttcttcacaaggagaaaaggcggcaactacagaagcaataagttatccggtaccatcacctgtgaagcaaacacaattgttatcggtcttgcagcagattcaggatgtggaaagagcacattcatgagaggacttactagtgtatttggtggagcagcatcacctcccaaggtgggaatccagactcaaacacgcttatcagtgacacgacaactgtgatatgtcttgatgactaccactctctcgatagatatggaagaaaggagcagggtgttactgcacttgatccaaaagccaacaactttgatctcatgtatgaacaagttaaggcacttaaacaaggtattgctgtggagaaaccaatttataatcatgttactggaattctcgattctcctgagctcattcaacctcccaagatcctggttattgaaggactgcacccaatgtacgattctcgtgtccgtgatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaagggaggtgttgagagttaagctggtgatgaaggaaggagtgaaatatttcagtccctcgtacctctttgatgaaggatcaaccatcgattggatcccatgtggaagaaaattgacttgttcatatccaggaattaagttctcttatggtccagacagttactactcaaacgaggtatctgtgttggagatggatgggcaattcgacaaattagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattgcagaaaagaaggcagttcactgcaagcagccaaaatgtagaaaatgttcttttaccaatctaattttccctctcttcttatttacttatgttgttccagtaaatacccaaactggtaaaaaagagattaccagtatataaata

SEQ ID NO: 1384 - DNA, 1556 bp, Fagopyrum esculentum
acctcacattgacaattctaccctcaaaacactacactaaactcccaaaaccaaggcaatccaaaagatattcaaacccacaaaatcataaattcatcacataaaccatctacacattcaacccaaattctttcaaacaatggcaatatgtgcagtaaatgcagtaacccatttgagttcaactcaaaacgcagtgttttactacacaaacaagctcaacaacaacaacattccaagacgagcaagagtgataacatgcgccgtcggtgactcacagacggtggtcatcggtttagccgctgactccggttgcgggaagtcaacgttcatgcgacggctcactagcgtttttggcggcgcagctgaaccacctaaaggcggaaatccggattcgaatactcttatcagcgatacgacgacggttatttgcttggatgattatcattctctggaccggaccggacgaaaagagaaaggagtaacggctttggaccctaaagctaacgactttgatcttatgtatgaacaggtgaaagccattaaagaaggcaaagctgttgagaaacctatttataatcatgtttctggcttgcttgatcctcctgagcttattaagccgccaaagattcttgttattgaaggccttcatccaatgttcgaccaacgtgtaagagacttgttggactttagtatctacttagatatcagcaatgaagtgaagtttgcttggaagattcagagagacatggcagaaagagggcacagtcttgagagtataaaggccagcattgaagctagaaaacccgatttcgacgcttacattgatccgcaaaagcaatacgcagatgcggtgattgaagtgctacccacacaactaatcccagacgacaccgagaagaaggtgttgagagtgagattaatcatgaaagaaggagttaagcatttcaatccggtttacctcttcgacgaaggctcaaccgtgacatggattccgtgcggaagaaaactcacttgttcgtacccgggaatcaagttcgcctacggtccagacacctacttcggccaagaggtaaccgttgtagaaatggatgggcagttcgatagattagacgagctgatctatgttgaaagtcatttgagtaacttgtcgacgaaattctatggagaagtgacacaacaaatgttgaaacacgcggattttccgggaagtaacaatgggacgggtttctttcagacgattgttgggttgaagattagggatttgtatgagcaaattgttgctagcagggaaggagcaacaacaacagcaggaaaagcttaaaggaaagaattctttttcttccaactttgtaaaattttcatttttcactttgttcttgtaatttccactagaacatatatatgttcttcccattgtatgattctatatatatacacaaggagaggcctgagagttgtataaaggttttttgctcttcaaattatgtgaagagattcttacacttgctagtgttggagataatggaaacaatgatgaaaatgttgaaggtgaggct

SEQ ID NO: 1385 - DNA, 1771 bp, Humulus lupulus
aagatcaatttactattatacccatggctcagttgccttatccccatccaagtcctcttttctcccaccttaaaatcacctccaaattctctaaaactccaaaaacaaggggtagtcacagaaaacacataaaaattacaaaagtaaaggacatcactcctcacccaataacatcactagccaacaatttcttttgcttccaaaactacattaattaacctccttagcctttatttgtgttcccaaacttttttcttttcatttgaataaagaaacccaactcatatttgttgtcttaaaatcatcatatgaattacacagaaacatacatttaaaaccatatcttcctctctctgaacactagtccatttctaaggagaggaagaataaccaaaaaaaaagagaggaaaaatggcagtttgcaccgtctacacaactcaactcaacccaacatgctcatcaatctccacaccatcaaaatcccacttgggatttcaccaaagacaagtagtgttctacagcacaggcaagagagccaccaggagaggaggcaattcttcttccattagtaccagctgcagcccctacgtgataacatgctcagctggtgactcacagacagtggtgattggcctggctgctgactccgggtgtggcaagagcactttcatgaggcggttgacaagcgtgttcggcggtgcggcggagccacctaagggagggaatccggactcaaacactctgatcagtgacaccacaactgtgatatgtcttgatgactatcactctttggatagaactggaagaaaagagcagggagtgactgctcttgacccaagagctaacaactttgatctcatgtacgaccaagttaaggctctcaaggatggcatacctgttgaaaagcctatttacaaccatgtttcaggacttcttgacccccctgagctcatccaaccccccaagattcttgtcattgaaggtctccacccaatgtatgattctcgagtgagggacctcctggacttcagcatctacttggacattagcaatgaggttaagtttgcatggaaaattcagagggacatggcagagcgtggccacagtcttgaaagcatcaaagccagtatcgaagcccggaaacccgatttcgatgcctatattgatccacaaaagcaatacgcagatgctgtgattgaagtgttgccaactcaactcattccagatgacaatgaagggaaggtgttgagagttaagttgatcatgaaagaaggggtcaagtatttcagccctgtttacttgttcgatgaaggatccaccatttcatggataccttgtggaagaaagctcacctgttcttaccccggcatcaaattcgcctacggccctgactcctactatggcaacgaggtgtctgttttggagatggatggacaatttgacagattagatgagctgatctatgtggagagccatctgagtaacatctccaccaagttctatggagaagtcactctacaaatgttgaagcattctgatttccctggtagcaacaacggtaccggtctcttccaaaccattgttggattaaagataagagatctatacgagcagatcacttcaagcagggccaaaactccagtacaagcttcaaaagcttgattaaaataatgaatcatgaatggacacgccttgtttgccacggaataaagccaatgagatcagcttagtccagaacaaaatatctccttcttcttctttttttctcttt

SEQ ID NO: 1386 - DNA, 1735 bp, Lippia dulcis
acacagtaagccataaacagtgacacgtcactcttcccctcatcaacacaaaacaactttctatccaacaaaactgccatctgcgatactctcaccatagcctcttctttcattttcatctgcaataaaatcaaattcccatttccatctccatttccattctactaacactacctcctctagagtgcgagagagagaagaggagagagaggagtagaggaagaaaaaatggcagtctgcacgatgtacacagctcaatccctcacctcaatctccaccccaccaaaaacccacttgggattcaaccaaagacaagtggttttctacaccaccgccaagaaaaccacctccgcctccaggagggcggcggtgatctcctgctccggcgaggagaagcccgtggtgatcggtttggctgcagactccggctgcgggaaaagcacattcatgcggcggctgacgagcgtctttggtggcgccgccgagccacccaagggcggcaaccccgactccaacacgctcatcagcgacacgaccaccgtgatttgcctcgacgattaccactcacttgatagaactgggagaaaagagaaaggagtgacagctcttgaccctagagcaaacgattttgatcttatgtatgaacaagttaaggcgattaaagaagggaaagctattgacaaacctatttataatcacgtcactggtttgcttgacccgcctgagctcattaagcctccaaagatctttgtcatcgaaggattacaccctatgtacgatgcacgagttagagagcttctggacttcagtatttacctggacatcagcaacgaagttaaatttgcatggaaaattcagagggacatggctgaaagaggacacagccttgaaagcatcaaagctagtatcgaagcccgaaagcccgatttcgacgcttacattgacccacagaagcaatatgcagatgcagttatcgaagttttgccaactcaactgattcccgacgacaacgaggggaaagtgttgagagtgagattgataatgaaagaaggagtgaagtttttcaatccagtttacctctttgatgaagggtccaccatctcatggataccctgtggaaggaagttgacttgctcttaccctggaatcaagttcacttacggccccgaaacttactatggccatgaggtctcagtactcgagatggatggtcaatttgacaaactagatgagctgatctacgtcgaaagccatttgagcagcatttccactaagttctacggcgaagttactcaacaaatgttgaagcatgcagatttccccggcagcaacaacggaactggtcttttccagaccatcattggcttgaaaatcagagacctctatgagcagattgttgcaagcagaggtgcagctcctttggaagctacaaaggcctaagaaactaaagttcctaagatatattgagattcagtccgtctaaggttgtcctgatttttctcttaccaccagtgttgctgtatctgttgagagtgttggataaaatcctcctgaattgagatcttctccatgatgtacttatttttttaatcagttgtaacatagagaattgcacaagcacatatgaaataaaatacaagaattacgcaatctttatcaaataggagttatagttaattttccttgtggtttttttagtttatcttcatatagaaacacatatccatcttgttgt

SEQ ID NO: 1387 - DNA, 1289 bp, Helianthus annuus
gagaggcggtgagatacgatgcgcaggggacacaatagtaatcgggctagcagcagactcggggtgcgggaagagtacgttcatgaggaggttgactagtgtgtttggaggtgcagcagagccaccaaagggagggaatccagattcaaacacactcataagtgacaccacgacggttatatgtttggatgattaccattcgttggatagaacagggaggaaggtggaaggggtgaccgcgcttgatccgagagcgaataactttgatctcatgtatgaacaggttaaggctttaaaagatgggattgcggtagataagccgatttataaccatgttagtggtcttttggaccctccggagctcatcaagccacctaagatccttgtcattgaaggtttgcacccaatgtatgatgagagagtaagagacctcttggacttcagtatctacttggacatcagcaacgatgttaaattcgcgtggaaaattcagagggacatggcagagagaggacacagccttgaaagtatcaaagctagtattgaagcaagaaagccagattttgatgcttatattgacccacaaaagcaatacgcagatgcggttattgaagtgttgcctacacagctgattccagatgacaatgaggggaaggtgttgagagtgaagctgataatgaaagagggagtgaaatacttcagcccggtttacttgttcgatgaaggctccaccatctcatggattccctgtgggaggaagctcacttgttcttacccgggtatcaagttcgcctatggccccgatacttactacggtcaagaggtgtccgtattggagatggatggtcaattcgacaaactggacgagctcatctatgttgagagccatttgagcaacatctccaccaaattctacggagaaattacccaacaaatgttgaagcatgccgacttcccgggcagcaacaacggaaccggtctcttccaaaccattgtcggtttgaaaatcagagatctctttgaacaaatcacagccagcaaggcctcagctacattggaagctacaaaagcttaaactaaagagaaacaaacttataagttttaagtgtcaggcttttatcacgtgtcttgtgagagttacacacccgtatgtatgtatgtatttagtttcttttgtttcttccatggagatctgttatatagggaatcaaattcttaaatgaaatcttgagaagattaaagaacgcctctgttatcaaaatcactgcaaattccagttttggaatcac

SEQ ID NO: 1388 - DNA, 2519 bp, Panicum virgatum
cggaggaagaatactgacaaaatacagaatgaaagggagaactcattttcagctcagtataagctgcccttgatattatcagaaaaatgaagaaagtgaaaaatagggacgtcacatcacatgatcgccaccctcttttccttcttatgttcttctagctccacatccagcattccattctccctcctctttctcttgaagtcccacccataaggcttggagggaagaagagaaagcttagcccagaacaaaggccggcaagcaaaaatggcgatctgcagcacgcacaccaccacctccctgcactccccatgcacaacagtctcaaacgcaggcttcaggcagaagcaagtcatcttcttcaccagcaacaggagaagcggcagaaggcatggaggggcaagaacctttcaggtttcatgctccgtcgagaagccagtggtgatcggcctggcggcagactcaggatgcgggaagagtaccttcatgcgccgtctcaccagtgtgtttggtggtgctgcagagccacccaagggtggcaacccggactccaacaccctcatcagtgacaccacgacagtgatatgccttgatgactaccactccttggacagaaccgggagaaaggagaagggtgtgaccgccctcgacccaagggccaacaactttgatctcatgtatgagcaggtgaaggcaatcaaagaaggccagacaattgagaagccgatctacaaccatgtcactggcctcctcgacccaccggaggttatcaagcccccaaagatttttgtcattgagggcttgcacccaatgtttgatgagcgtgtgagagacctcctagacttcagtatctacttggacatcagcgatgaggttaagtttgcatggaaaattcagcgggacatggcagagcgcgggcacagccttgaaagcatccaggctagtatcgaagctaggaaaccagattttgatgccttcattgatccgcagaagcaatatgctgatgctgtgattgaagttctgccgacacagttgattcccgatgacaatgaaggaaaggtgctgcgtgttaaattgatcatgaaagaaggcgtgaagcacttcaacccagtttacctcttcgatgagggatcaagtatcagctgggtgccttgcggaagaaagctcacatgctcttaccctggcatcaaatttgcctatggcccagacacttacttcggccacgaggtatcagtgttggagatggatgggcaattcgacagactagatgagctcatatatgtggagagccatctaagcaatctctcaactaaattctatggagaagtgacacagcaaatgctaaagcatgcagatttcccaggaagcaacaacggaacaggtctcttccagaccatcgttggactgaagattagagatctctatgagcagatagttgccgagagggctggtgcaccagctgaaacagcaaaagtttaatgatctgcacattcagatttcctacacctcttcaaactcaatgagaacgagaatcctcgaaattcttgtaattagttcggatacatcacggctagaaggcggtagaaatgtcattgcagtactcaggaaaacatgcgatgaaatttctagaaatacctcgccatgggggtgctcttacatctcttctgcgcatgtttaaatgtatatcttcatccatgcttttatgcggaaagaaatacagctgcctgctactatgaagtgtaggtttttatttcaatgcttctagtgttggttatttatctgaccaggacccagcgttcatgcaagaacagtcaagaaggatcgagatagaacatctattttgatgaattgcaccaataaggagaatggtgttcccaaccatggatcattagtgacaaggatgctacttttgtttcagataaagtataggtgatcttttctcctgaatggaaaaccgtaagagaactttagaacaaactaaacttgaaagaaaaatgttccaaaagaactggagagaaaaatcacatataggcacacaaataaattattagcatgtctcataccgttttagtatttcagtatgttgttataacatagttttgctattgctagtgttttaagtcagcaaatttggatcatagtagcaacaaactgctacatcactcattattgcagtatcacataccatataactaagcaacatcttcagcaatcgaaacagaagctgaacctagacactgttgttcaacattttgatacaagcattgccacacaaatataatcaaaagaagagctgtggataaacccatatgtttgatggccatggctgccgatccgtcatcgctcttccgctaaataggtaattgtcagcaacaccgggagctgcctcccaccctggtggaaatgatctccgggggcacccaggtactcctgctaatggggcggggcttgatgggttttttgggtgggttttaatacgggtactattggatgggtggaaacgggtgacactatgaaat

SEQ ID NO: 1389 - DNA, 1303 bp, Triticum aestivum
tgcaccaccatccaaactctggcttcaggcagaaccaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcacaagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgtgttaaattgatcatgaaagaaggcattaagttcttcaacccggtttacctcttcgatgaaggatcaaccatcaactggatcccttgtggaagaaagcttacatgctcttaccctggcatcaaattttcctatggcccagacacttactttggccaagaggtatcggtgctggagatggacgggcaatttgacagactagatgaactcatctatgttgagagccacctaagcaacctctcaaccaagttctacggggaggtgacacagcaaatgctaaagcatgcagactttccaggcagcaacaatggaacaggtctcttccagaccatcgtaggactgaagattagagatctctatgaacagatcatcgctgagagggccggcgttcctgctgaagcagcaaaagtttgatcagccccaaattcaagttcacaaatcatttcatcaccaactcaatgagaatgagcatcctcccatttcttgtacctagtttgaatatattacagctagaagacggtagaaagttcactgcagaactcatgaaa

SEQ ID NO: 1390 - DNA, 1347 bp, Zingiber officinale
  misc_feature (113)..(113): n is a, c, g, or t
gagggccagctgcacaatccacaccgctccttattcctgctctatatcaaggccagctgctaaggccttcagcttgggcttccaccagaggcatcagcagctcatcttcttcngcagcggaaggaggagtgcagtggtgtgctctgctgagaagacagtggtgatagggctggcagccgactcagggtgtggcaagagcacctttatgaggaggctgacaagtgtgtttgggggagcagcagagccacccaggggagggaatccagactccaataccttgatcagcgacaccaccactgtgatatgccttgacgactaccactccctggacaggacaggaaggaaggagaagggggtgactgcactggacccgagggccaacgacttcgacctcatgtatgagcaggtgaaggcgatcaaggatggagtggccgtggagaagcccatctacaaccatgtcactggtctgctcgacccccctgagctcatcaagccacccaagatcctggtcattgaaggattgcaccctatgtacgactctcgtgtgagagatctcttggacttcagcatctacttggatatcagtaacgaggtcaagtttgcctggaaaattcagagagatatggcggaacggggacacagtcttgaaagcatcaaagctagcattgaagctcgaaaacccgattttgatgcttacattgatccacagaagcaatatgctgatgctgtgattgaagtcctaccgacacagctaatccctgatgacgacgaggggaaggtgctgcgtgtgaggttgatcatgaaggaaggggtgaagcgattcgctcccatctacctcttcgatgaaggctccactatctcatggattccctgcggcaggaaactgacttgctcataccctggcatcaagttcttctatggccctgagacttacttctccaacgaggtttctgttgtggagatggatgggaagtttgacaggttggacgagctgatctatgtggagagccatctcagcaacttatcgaccaagttttatggcgaggtgacacagcagatgttgaagcactcagacttcccgggcagcaacaatggcactggactcttccaaaccattgttggattgaagattagagatttgtatgagcaaattgttgctgagagggcagcagcttctgctgcagcagctaaagtttgagtgggtaatcttgggtcagtgttggagaggatcatttcctgcatggctacttctctttggtttttgttttctgtatacatataaagaaattaaatgttgcagttgttctaaacttaatccgtttatcagatacttgtaaaacaatttgg

SEQ ID NO: 1391 - DNA, 1379 bp, Euphorbia esula
  misc_feature (618)..(618): n is a, c, g, or t
  misc_feature (911)..(913): n is a, c, g, or t
  misc_feature (951)..(952): n is a, c, g, or t
  misc_feature (1017)..(1017): n is a, c, g, or t
  misc_feature (1055)..(1055): n is a, c, g, or t
aaaaatacccaattgagctttctaaaccacaaacatgtctcaatcttttacagcaccagaagaacaataaacacccccaaaaatggaacctcaataacatgtgcagcaaatgaagaacagacaattgtaattggattagcagcagattcagggtgtggaaagagcacatttatgagaagattaacaagtgtttttgggggagcagctgagcctccaaaggggggaaatccagattcaaacacattgattagtgacactacaactgtgatttgtttggatgattatcattctttggatagaactggaaggaaagaaaagggagtcactgcacttgatccaagagctaatgattttgatctcatgtatgaacaagttaaagctattaaggatggtgttgctgttcaaaaacctatttataaccatgttactggactcttagatcctcctgaacttattaagcctcctaagattcttgttattgaaggtcttcatcctatgtatgatgaacgggtgagggatcttttagacttcagcatatatttggacattagcaatgaggttaaatttgcttggaaaattcagagagatatggcagaaagaggacacagtcttgaaagnattaaagccagtattgaagctcgcaagcctgattttgatgcttttattgatccacaaaagcaatatgcagatgcagtgatagaagtgttgccaacacaactgataccagatgacaatgaaggcaaagttttgagagttaaactcataatgaaagaaggtgttaagtacttcagtcctgtttacttgtttgatgaaggttctaccatttcctggattccctgtggccggaaacttacttgctcctaccccggtattaagttcgcctatggccccgacgcctatttcggcaacgnnntgtctgtgcttgaaatggatgggcaatttgacagattnnatgaattaatatatgtggagagccatttaagcaacatatcaacaaagttctatggagaagtgacncaacaaatgttgaaacattctgatttcccaggaagcancaatggaactggtcttttccaaaccattgttggattgaaaatcagagatctttttgagcaaattgttgctagcagatctgctaaaaccccggccaaagccaaggcctagaattcgtcgactttttttctttcaatctttctctgtcctgcctttcaaaactgttattgaataaggcaattctgagttgttaggaaaatggtgatgataattaagaaaatggaggaattgatggttgtgtgatgatgatgatgatgttgtaattgttaattgtgtaatattattacatagagaaatttaaaaagcagtcagttagggctgtttca

SEQ ID NO: 1392 - DNA, 1737 bp, Pinus taeda
gatcagaaaaaagagagagccacattgcaactatgcattgtatttagtaattgcaatattgcttgtgggtgttgaaatcttcaactgggagttgaagagattaagcgaccgggggctacagaatggcctgcccagctccaacagcagcatcaactcctgcaactgtgagatcatggaactcacggttctgttctaattcccctctcgcttcattttctctggccaacacaaccaggagacccaggagagcgctggtcgtatgtactgttgggcccgagaagaccgtggtcataggcctggctgccgactcaggctgtgggaagagtacgttcatgaggcgcctaacaagcgtctttggcggagccgcagagccccctaagggtggaaatcctgactccaatacgcttatcagcgataccaccacggtcatatgcttggacgactaccactccctggacagatatgggaggaaggagaaagctgtgacggctcttgaccccagggctaataactttgatctcatgtatgagcaggtcaaggccatgaaggaggggaaagcagtcatgaagcccatctataaccatgtcactggtcttctagatcctccggagcagatcaagcctcccaagattctcgtcattgaaggccttcatcccatgtttgatgcccgtgtgagagaactactggatttcagtatctatttggacatcagcaacgaggtcaagttcgcttggaaaatccagcgcgatatggccgaacgtgggcacagcctagaaagtatcaaagcaagtatcgaagcccgcaaaccagattttgatgcctatatcgatccacagaaacaatacgccgacgttgtgattcaggttttgcctacagagctgattcccgatgacaacgaagggaaggtactgcgtgttcgcatggtgatgaaagagggggtgaacttcttcaatcccgtatatctgttcgacgagggctccacaatatcatggattccatgtggtagaaagttaacttgttcatatccaggcatcaaattcttctatggccctgacgtttactatgacaacgaggtgtctgtgctggagatggatggacagtttgacagattagaagagttaatctacgtggagagccacttgagtaacatatctaccaagttctatggtgaagtaacacaacagatgctgaagcatgcagattttccagggagcaacaatggcactggtctgttccagaccattgttggacttaaaatcagggatgtttatgagcagatcatcgcaaagagggccggggcttccttggaagcagctaaggcctagaccagagaagatgatgagatattcactaggattatattcggcatgtaacattaaattaattaaacgccataactcttttctctggttgcttctctatatatattatcagtaaatcagtcgattctgttgtaagttactcagtcctcggatgtaatataaatataaaaccatgaaaattattcatctcagagaagttgaatgtttttgagaattcgagaaaagttaaatgtttttgagaaactaaatttggatataccacagtcttcgactttaatttgactcgaagaagggaatttttcaatcccaaattggcaactttttggtggctgatttcatatggggccggactgcctactttattctgttaatcgatatcatatcgtctaaataacaaaaaaaaaaaaaaaggccg

SEQ ID NO: 1393 - DNA, 1183 bp, Zostera marina
gaaaaaataggcagtctgcacagtctactctcctcattctctcaaatccacatgcccaattccaaatacatcaagaatccaattgggttctcatcagaagcaagttattttcttcacaaggagaaaaggcggcaactacagaagcaataagttatccggtaccatcacctgtgaagcaaacacaattgttatcggtcttgcagcagattcaggatgtggaaagagcacattcatgaggagacttactagtgtatttggtggagcagcatcacctcccaagggtgggaatccagactcaaacacgcttatcagtgacacgacaactgtgatatgtcttgatgactaccactctctcgatagatatggaagaaaggagcagggtgttactgcacttgatccaaaagccaacaactttgatctcatgtatgaacaagttaaggcacttaaacaaggtattgctgtggagaaaccaatttataatcatgttactggaattctcgattctcctgagctcattcaacctcccaagatcctggttattgaaggactgcacccaatgtacgattctcgtgtccgtgatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaagggaaggtgttgagagttaagctggtgatgaaggaaggagtgaaatatttcagtccctcgtacctctttgatgaaggatcaaccatcgattggatcccatgtggaagaaattgacttgttcatatccaggaattaagttctcttatggtccagacagttactactcaaacgaggtatctgtgttggagatggatgggcaattcgacaaattagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattg

SEQ ID NO: 1394 - DNA, 1319 bp, Zostera marina
tctgcacagtctactctcctcattctctcaaatccacatgcccaattccaaatacatcaagatccaattgggttctcatcagaagcaagttattttcttcacaaggagaaaaggcggcaactacagaagcaataagttatccggtaccatcacctgtgaagcaaacacaattgttatcggtcttggcagcagattcaggatgtggaaagagcacattcatgaggagacttactagtgtatttggtggagcagcatcactcccaagggtgggaatccagactcaaacacgcttatcagtgacacgacaactgtgatatgtcttgatgactaccactctctcgatagatatggaagaaaggagcagggtgttactgcacttgatccaaaagccaacaactttgatctcatgtatgaacaagttaaggcacttaaacaaggtattgctgtggagaaaccaatttataatcatgttactggaattctcgatcctcctgagctcattcaacctcccaagatcctggttattgaaggactgcacccaatgtacgattctcgtgtccgtgatctgctggacttcagttatttacctagacatcagcaatgaagtgaagtttgcctaggaaaattcagagagatatggcagaaagagggcacagccttgagagcaattaaggctagcattgaatcaagaaagcctgattttgatgcttttatcgatccacaaaaacagtatgcagatgctgtaattgaagttttgccaacacaattgattcctgatgacaatgaagggaaggtgttgagagttaagctggtgatgaaggaaggagtgaaatatttcagtccctcgtacctctttgatgaaggatcaaccatcgattggatcccatgtggaagaaaattgacttgttcatatccaggaattaagttctcttatggtccagacagttactactcaaacgaggtatctgtgttggagatggatgggcaattcgacaaattagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattgcagaaagaaggcagttacaactgacaagcagccaaaatgtagaaatgttctttacaatctaatttttccccctcttcttatttacttatgttgttccaagttaaactacccaaactggtaaaaatgacattaccagtataataaata

SEQ ID NO: 1395 - DNA, 1498 bp, Brachypodium distachyon
ccaaccggagcaaaagttgggcagcaaacatggcaatctgcagcgcacacaccaccacatccctacgctccccatgcaccaccatctcaaacacaggcctcaggcagaaccaagtcatcctcttcacaaccagaagcagcaggaggggtagcacgagacacggagcaaggaccttccaggtttcatgcacagccgagaagccaatcattattggcctggcagcagactcaggatgtgggaagagcaccttcatgcgccggctcaccagtgtgtttggaggcgctgcagagccacccaagggagggaacccagactcaaacacactcatcagcgacacgacaacagtgatttgccttgatgactaccattccttggacagaaccggcaggaaggagaaaggtgtgaccgccctcgatccgaaggcaaacgactttgatctcatgtatgagcaggtgaaggcaatcaaagaaggcaaggccattgagaagccaatctacaaccatgtcaccggcctcctggacccagctgagctcattcagccccccaagattttcgtcattgagggtttgcacccaatgtacgatcaacgcgtgagggacctcctagatttcagcatctacttggatatcagcaatgaggttaagtttgcatggaaaattcagagggacatggctgagcgtgggcacagccttgaaagcatcaaggctagcatcgaagccaggaaaccagatttcgatgcctatattgatccacagaagcaatacgctgatgctgtgattgaagttctcccgacactgctgattcctgatgacaacgaaggaaaggtgctgcgtgttaaattgatcatgaaagaaggcgtgaaatacttcaaccctgtttacctcttcgatgaaggatcaagcatcggttggatcccttgtgggagaaagcttacatgctcttatcctggcatcaaattttcttatggcccagacacttactttggtcaagaggtatcagtgctggagatggacgggcaatttgacagacttgatgaactcatctatgttgagagccacctaagcaacctctccaccaagttctacggagaggttacacagcaaatgctaaagcattcagacttcccaggcagcaacaatggaacaggactcttccaaactattgtaggactgaagattagagatctgtatgaacagatcattgcagagagagccggcgtacctgctgaagcagcaaaagtttgaagaccgcctcccccccccccccaccccacccccaaacacacacacacattgagatttcatgaatcatttcatcaccagctcaatgagaatgagcatccttgcgttcattgtaactagtttggaaatgttacagctagaagacggtagaaagttcattgcagaactcatgtaaacctgcatttgaacttctcgaaaaccctttccacgagggtgctctcacgtctcttcgtaacacatttcaatgtacatcttcc

SEQ ID NO: 1396 - DNA, 1471 bp, Zostera marina
tttcggggtaagggagaagaacacttacttctagttccaaccaacattttctcttcttcctcaaagagctagaaggaagcttggtggccagaagagaaaaaatggcagtctgcacagtctactctcctcattctctcaaatccacatgcccaattccaaatacatcaagaatccaattgggttctcatcagaagcaagttattttcttcacaaggagaaaaggcggcaactacagaagcaataagttatccggtaccatcacctgtgaagcaaacacaattgttatcggtcttgcagcagattcaggatgtggaaagagcacattcatgaggagacttactagtgtatttggtggagcagcatcacctccaagggtggaatccagactcaaacacgcttatcagtgacacgacaactgtgatatgtcttgatgactaccactctctcgatagatatggaagaaaggagcagggtgttactgcacttgatccaaaaagccaacaactttgatctcatgtatgaacaagttaaggcacttaaacaaggtattgctgtggagaaaccaatttataatcatgttactggaattctcgatcctcctgagctcattcaacctcccaagatcctggttattgaaggactgcacccaatgtacgattctcgtgtccgtgatctgctggacttcagtatttacctagacatcagcaatgaagtgaagtttgcctggaaaattcagagagatatggcagaaagagggcacagccttgagagcattaaggctagcattgaatcaagaaagcctgattttgatgcttttatcgatccacaaaaacagtatgcagatgctgtaattgaagttttgccaacacaattgattcctgatgacaatgaagggaaggtgttgagagttaagctggtgatgaaggaaggagtgaaatatttcagtccctcgtacctctttgatgaaggatcaaccatcgattggatcccattgtggaaagaaattgacttgttcatatccaggaatttaagttctacttagtgtccagactagttactactacaacgaggtatctgtgttggagatggatgggcaattcgaaaattagacgaactgatctatgtggagagtcatctgagcaacctctcgacaaagttctacggggaagtgactcaacagatgctgagcctttccaacttccctggaagcacaaatggaactggtctcttccagaccattgttgggatgaagataagagacttatatgaacagataattgcagaaaagaaaaggcagttcactgcaagcagccaaaatgtagaaaatgttcttttaccaatctaatttttccctctcttcttatttacttatgttgttccagtaaatacccaaactggtaaaaatgagattaccagtatataaatatacagacttatgattgtgaattcgaaatcaaatcgtattgtggcc

SEQ ID NO: 1397 - DNA, 2163 bp, Amborella trichopoda
cccaaatcaaataccccttggtatctctctctatttcctccctttctctctctacactgtctttatctctctacactgtctttctctctctacactctctctcacacagccaccccaatttgtctccaataacaatgtaacatttctctctctctctctaaccattccaaacgccagtccaatctctctcctcacccccatgcagttgtagtccaaccccttgggcttttattctccactccaatgttatccttccctatctccccttgagagatcaccaaaaacccaccccaaaatcagctccaaagaaccatggcctcctgcacagtctacaccacccattctctctcctcttcaggcacaatctccaaaaccagcataggatttctccaccaatctccactcagacctgaaaaccaaatcatattctgcaaaagaaccaccaaaagacccaactctctctctacaatcacatgctcagttcctgaatatccaaagactgtagtgattgggttagctgctgattcaggatgtggaaaaagcaccttcatgaggaggctcacaagtgtttttgggggagatgctgcacccccaaagggaggaaacccagattcaaatactttgattagtgatacaacaactgttatttgtttagatgattaccattcattggatagaaatgggaggaaagtgaaaggggtgactgctcttgaccccagagcaaatgattttgatctgatgtacactcaggttaaggctttgaaagaggggaaagcagtggagaagccaatttacaaccatgtgagtgggcttttggatcctcctgagcttattcagcctcctaagatccttgtcattgaaggactccaccccatgtatgatgaacgagtgagggagcttctggatttcagcatctacttggacatcagcaatgaagtgaagtttgcatggaaaattcagagagacatggccgaacgtgggcacagtcttgagagtatcaaagcgagtattgaagcaaggaagccagactttgatgcctacattgatccgcagaagcaatacgcagatgcagtcatcgaagtcctgccgactcagctcattcccgacgataatgaagggaagatattgagagtgaagcttgtgatgaaagaaggggtcaaatacttcagtccggtttacctctttgatgaaggatccaccatttcctggataccatgtggtaggaagctcacctgctcctatccaggcatcaaattcttctatggcccagacgcctacttctccaatgaggtctctattcttgagatggatggacagtttgatagattagatgaactgatatatgtggagagccatttgagcaacctctccacgaaattctatggcgaagtcacacaacaaatgcttaaacacgtagacttcccaggaagtaacaatggcacaggtctcttccaaaccatagttgggttgaaaataagggacctctatgaacaaattgtagctagcagggcaggggctactttggagactgccaaagtttgatcaagacaggattctctccctatgagttctctctcttaagtctgtgcttatcagtcgacttttccattgtcaatatggaattctcagtttaaatgtctaaagatccttagcacaggagatcataatatgtgtagtttatgctgtatgtggagaatgtattgtagaggtgatgcagatccaatgtactcacctaacatttttcagagtgttggggcaatcaaatggctatcttttgtgaatccaatcgggttggcagctgtgtgctcccaccatgatcctctctctttctctctctctctcatgcacacgcgtggacacaggtgcacatgtaacagagattcttattggaatatctcccctctaatgtttcaagtgttaatacatccaagggcttgcactaatacataccgatcttgccttccgagccacttgacggaccatgattatctctctcttcctgaaacaaaccggtttccctatcttctctctcccactctctctctctcaaaacctttacacattttatctgacatatttgttcgaacatttctgatttcatatttcaagtgttagcacatccaaatggcttatgactgggaatacagatctcgctttcaaagt

SEQ ID NO: 1398 - DNA, 1593 bp, Coffea canephora
tatcatttctcaacaaagggtaccaaaccaactaaaaagttcacttcatatacaaccgcataatattaacaccttgctctctcccaaaattctctgagtaaagagagagagagagggggccaagaagaagaaggaaaagaaaaaaaatggctgtttcaacagtccatacaattcaacccctcaactcctcatgctcaatctccacaccaacaaaatcccacttgggatttagccaaaaacagcaagtcttattcttcagcaagagaataaagaccagcagcagcagcagcaggagaagcagcagtgagataacgtgctcagctgagaaaacagttgttataggcttagcagcagactcaggatgtgggaagagtactttcatgagaagattaacaagcgtttttggaggtgcggctgagccaccaaggggcggcaaccctgattccaacacactcatcagtgacacgaccaccgtcatatgcttagatgattaccattctcttgatagaactggaaggaaagaaaagggtgtcactgcacttgaccccagagccaataactttgatcttatgtatgaacaagttaaggccattaaagatggtgttgctgttgataagcctatttataaccatgttactggtcttcttgaccctcctgagctcatcaagcctcccaagatccttgtcattgaaggattacatccaatgtatgatcagcgtgtaagagacatattggatttcagtatctacctggatattagtagcgaggtcaaatttgcatggaaaatccagagggacatggccgagagaggacacagccttgaaagtattaaggccagtattgaagcccggaagccagattttgatgcctacattgacccacagaagcagtatgctgatgttgtcattgaagttttgccaacacaactcattcctgatgataatgaggggaaggttttgagagtaaagttgatacaaaaagaaggggtgaatcatttcagcccagtttacctgttcgatgaaggctctacaatttcttggattccatgtgggaggaagttaacatgttcttaccctggcatcaagtttgcctatggtcctgatacttactttggcaatgaggtttctgtagtggaaatggatggccaatttgacagactggatgagctgatttatgtagaaagccacctgagcaacatctccagcaagttctatggtgaagtcactcagcagatgttgaaacatgccgacttccctggcagcagtaacggaacagggctcttccagaccatagtggggttgaagatcagagatctctacgagcaaattgttgctagcagggctgaagcattgcaaacagcaaaggcctaaaaacttcctagatgcatggaaacccttgttcttcgtaactttttcactaaaattttcccatcagttttcctccgctccatgtatcagtcgacattaaatgataactctccaaacgtgtgtgttcgaagcacaaatctgtgagacttgtaccataaagaaacaaaagaagaaatgaaatggaaaagatataggcaactgcagcctttggcagattgcaattata

SEQ ID NO: 1399 - DNA, 1786 bp, Mimulus guttatus
atttcattaaaaaaaattaatgtcctcaaaacaatttaaaattaaaaaaaaaaatcccaataacatcactcccacaccactccatttctagcttcatctctctaaacacacacttctagagagagaaacaagagagagaaagagagaaacaacaatggcggtctgtactgtgtacacagtccaatccctcaactcaacctactcaatctccaccacaccggcgaagaaaaacaacttgctgggtttcaaccagaagcaggccgtcgttttctacagccggaaaaccaccaccgccaccagaagcggcagacccggcgccgccgtgatatcatgctccgccgcggacaaaacaatcgtgattgggctggcggcggactccggctgcgggaagagcacattcatgcggcggctgacgagcgtattcggcggcgccgccgagccaccgaagggcgggaacccggactcgaacacgctgatcagcgacaccaccaccgtgatttgtctcgacgactaccactcactggacagaaccggacggaaggaaaagggagtaaccgcactggacccgagagccaatgatttcgatctcatgtacgaacaggttaaagcgattaaagacggcgtcgccgtcgacaaaccgatttataaccacgtctccggtctgttggacccgccggagctgattaaaccgcccaagattctcgttattgaaggattacatccaatgtacgattcacgagtaagagatcttttggacttcagtatttacctggacatcagcaatgaagttaaattcgcttggaaaattcagagggacatggctgaaagaggacacagccttgaaagcatcaaagctagtattgaagcccgaaaacccgattttgatgcttacattgatccacagaagcaatacgcagacgcagtgatagaagttttgccaacacagctaattccagatgacaatgaaggcaaagttctaagagtgagattgattatgaaagaaggtattaaatttttcaatcccgtttaccttttcgacgaaggctccactatttcgtgggtcccgtgtggacggaaattgacttgctcttaccccggcatcaaattcacctacggccccgatacttactacggcaacgaggtctcggtattggaaatggacgggcaattcgacagactggacgaactgatttacgtggaaagccacctcagcaacatatccaccaaattctacggtgaaataactcagcaaatgttgaagctttccgatttcccaggcagcaacaacggcaccggtcttttccaaacaatcgtcggcctcaaaatcagagacctttacgagcagatcatcgcaacccgagccgctgctccattggaagctacaaaggcctgaaaaataaaattaataaaaaatcgcacgtaatatcataatatgagacaggctcttcggctgtctaattttttttctctctcctctctctcgtgttgttgttgttgttatcagttgtgtgttatagatgaacattgaacagagaaatttcgacgtttatttgtatttttttacgttcggtcgaacaaaaactttgtggagactttgtaacatagagaaacaagaagcacataaaaaaaaggattatgtaatcgtctttggcaaataccgttccgactctgaacgtgattttaactattttcgagtttgaatttgccagaactcgaaaaatggaatttgtggtagtttgacttaactttctaatccaacttgaaaagaattatagatgaatgaatg

SEQ ID NO: 1400 - DNA, 1562 bp, Pseudotsuga menziesii
caagcggccggggctacagaatggcctgcccagctccaacagcgacatcaaccccttcaattgtgagatcatggaactcacacttctgctctagctccccactcgcttcattctctctggctcactctatcaggagacccaggagaacattgattgtatgctctgctgggcccgagaagaccgtggtcataggcctcgctgccgattcaggctgtgggaagagcacgttcatgaggcgcctaacaagcgtctttggcggagccgcagaaccccccaagggaggaaatcctgactccaatacgctcatcagcgataccaccacggtcatatgcttggacgactaccactccctagatagatatgggaggaaggaccaaggtgtgacggctcttgacccccgcgctaataacttcgatctcatgtatgagcaggtcaaggccttgaaggagggaaaaccagtgatgaaacccatctataaccacgttactggtattcttgatcctgcggagcagatcaatcctcccaagattctcgtcatcgaaggccttcatcccatgtttgatgcccgcgtgagagagctgctggatttcagtatatatttggacatcagcaacgaggtcaagttcgcttggaaaatccagcgtgatatggctgaacgtgggcatagtctagaaagtatcaaagcaagtatagaagcccgcaagccagattttgatgccttcattgatccacagaaacaatacgcagacgttgtgattcaggttttgcctacagagctgattcccgatgacaacgaggggaaggtgctgcgtgttcgcatggtaatgaaagaaggggtgaacttcttcaatcccgtttatctattcgacgagggctccacaatctcctggattccatgtggtagaaagttaacttgttcatatccaggcatcaagttcttctatggccctgacgtttactatgacaacgaggtgtctgtgctagagatggatggacagtttgacagattagaagagctaatctacgtggagagccacctaagtaacatatccaccaagttctatggagaagtaacacaacagatgctcaagcatgcagattttccagggagcaacaatggcactggtctcttccagaccattgttggacttaaaatcagggacgtttatgagcagctcattgcacagatgaccggtgcttccctggaagctgctaaggcctagagtaaagtagagaatatcattaaatattcactaggattatgttcgggatgtaaaatgaaatcaaattcaaagccataactctattctcttgctgcttctctctatatattataattaaatcagccgattctactgtaagtcactgagtcctcggatgtaatataaatataaaaccatgaaaatgcttcacctcggagaagttaaatgcaagatccaggagagtttttcattcccttatttttttgtgatgtcaaattggccatggctgctgatttcatatgggaccggattgcctccattttaaaggtatatcattccgtttgtcaaaatcatatatgg

SEQ ID NO: 1401 - DNA, 1483 bp, Triphysaria pusilla
gtaaattacttacccaaactaataattacaaaaaataaaattaatttaaaagccaaattttcatgaaaatacacactctctaaataacactcacttatctcctagagagtagaagaagaagaaaaaatggcagtttgtacagtctacacagttcaatccctacactcaatctcaacaccaccaaaaacccacttaggattcaaccaaaaacaagtgtatttctacagcaccaccaagaaaccgataaaatccaagtctttttcgactgaaatctcatgctcagccgatgacaagactgtagtaatcggcctggctgcagactctggctgtggaaagagcactttcatgcggcggctcactagcgtgtttggcggtgcggctgagccgccaaagggcggcaacccggactcgaacacgcttataagcgaaatgacgactgtgatttgtttggatgactatcattcattggacagaaccggacgaaaggaaaagggagtcactgcactggatccaagagctaatgactttgatctcatgtatgagcaggttaagtctattaagaatggtgttgctgttgagaagcctatttataaccatgtcactggtttattggacccgccggagctgattaagtctcccaagatttttgtcattgaaggattgcatccattgtacgatgcacgagtgagagatcttctggacttcagtatttacctggacatcagcaatgaagttaaattcgcatggaaaattcagcgtgacatggctgaaagaggacacagcctcgaaagcatcaaagctagcatcgaagcccgaaaaccagatttcgatgctttcattgacccacagaagcaatatgcggatgcagtgatagaagtgttgcctacacaactcatccctgatgacaatgagggcaaatacttgagagttagattgatacaaaaagaagggggttaaattttttcaacccggtttacctctttgatgaaggctcgacaatctcatggataccctgtggtcgcaagctgacgtgctcataccctggcatcaagttcacttacggccccgacacttactatggcaatgaggtctcagtgttggagatggatggacaattcgacagactagacgagctcatctacgtcgaaagccatctgagcaacctttcgtccaaattctatggcgaagtaactcagcaaatgcttaagcacgcagatttcccaggcagcaacaatggcaccggtcttttccagactatcgtcggcttgaagatcagagacctttacgagcagcttaactacaaccaaaacaagcaaaactgcagctccattgaaagctacaaaggcctaaataaatatccgatttttttccctctttgttcaaaacactgtgttgtgtatcagttgagtgttatataaatactcataaaaacaagtaagatttgataatcacttcaaattcaacattctattaaaaaaaaaaa

SEQ ID NO: 1402 - DNA, 1480 bp, Zea mays
agaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttagatttcagtatctacttggacatcagtgatgaagttaagtttgcatggaaaatccagcgggacatggcagagcgtgggcacagccttgaaagcatcaaggccagtatcgaggccaggaaaccagattttgatgcttttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaatttgcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatccctcttgaagagagtgagaactcgatagatcaagaatcaccacacgttgtattaatcgtatggtataatatttatac

SEQ ID NO: 1403 - DNA, 1704 bp, Zea mays
ttttcagctcactacaagctgcccttgatattatcagaagaaaaaaaagaatgtgaaaaatagggacaccacatcattgccatccgcatttcgtcctcatgttcttgttatcttgtagctccacatccaccatcccactctccctattcttcttctcttcaagtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttagatttcagtatctacttggacatcagtgatgaagttaagtttgcatggaaaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatccctcttgaagagagtgagaactcgatagatcaagaatcaccacacgttgtattaatcgtatggtataatatttatacatgtacaggatgagctatgcata

SEQ ID NO: 1404 - DNA, 1782 bp, Pinus pinaster
aacgaaaggaggggagaggagaaggaaggatcaggaaaaaaaaagagagccacattgccactatgcattgtattcagtaattgcaatattgcttgtgggtgttgaaatcttcaactgggagttgaagagattaagcgaccgggggctacagaatggcctgcccagctccaacagcagcatcaactcctgcaactgtgagatcatggaactcacggttctgttctaattcccctctcgcttcattttctctggctcacacaaccaggagacccaggagagcgctggtcgtatgcactgttgggcccgagaagaccgtggtcataggcctggctgccgactcaggctgtgggaagagtacgttcatgaggcgcctaacaagcgtctttggcggagccgcagagccccctaagggtggaaatcctgactccaatacgcttatcagcgataccaccacggtcatatgcttggacgactaccactccctggacagatatggaaggaaggagaaagctgtgacggctcttgaccccagggctaataactttgatctcatgtatgagcaggtcaaggccatgaaggaggggaaagcagtcatgaagcccatctataaccatgtcactggtcttctagatcctccggagcagatcaatcctcccaagattctcgtcatcgaaggccttcatcccatgtatgatgcccgtgtgagagaactactggatttcagtatctatttggacatcagcaacgaggtcaagttcgcttggaaaatccagcgtgatatggccgaacgtgggcacagcctagaaagtatcaaagcaagtatcgaagcccgcaaaccagattttgatgcctatatcgatccacagaaacaatacgcagacgttgtgattcaggttttacctacagagctgattcccgatgataatgaagggaaggtactgcgtgttcgcatggtgatgaaggagggagtgagcttcttcaatcccgtctatctgttcgacgagggctccacaatatcgtggattccatgtggtagaaagttaacttgttcatatccaggcatcaaattcttctatggccctgacgtttactatgacaacgaggtgtctgtgctggagatggatggacagtttgacagattagaagagttaatctacgtggaaagccacttgagtaacatatctaccaagttctatggtgaagtaacacaacagatgctgaagcatgcagattttccagggagcaacaatggcactggtctgttccagaccattgttggacttaaaatcagggatgtttatgagcagatcatcgcaaagagggccggggcttccttggaagcagctaaggcctagaccagagaagatgatgagatattcactagcattatgttcggcatgtaacattaaattaattaaacgccataactcttttctctggttgcttctctatatatattatcagtaaatcagtcgattctgttgtaagtcactcagtcctcggatgtaatataaatataaaaccatgaaaattattcatctcagagaagttaaatgttagctcaaagaagagaatttttcaatcctcttaattggcaaccttttggtggctgatttcatatggggccggactgccaattttcaatcctcttccttgtcaaattggcaaccttttggtggctgatttcatatggggccggactgcctactttattctgttactcgatatcacatctcctaaatatagaaaaatgcctatgccatacactgggtcaattttagc

SEQ ID NO: 1405 - DNA, 1847 bp, Elaeis guineensis
acacgctctcgctcctcccacctcaaaaagctcccatttcgtccagatcattgggaatctccaaacaaaagaagtttacaccagggtagactggcagaggaaaaatctaaagccataaaagcagtttctctagaaaaaaaaataagagagcgaaaaattgaataagaaactgtcagagaaactgagaaggctgaagtcatcaaaaacaaaaagaaggaaagcacaccacaacccccttgctcatcttcaatgtctcctccttccaactagacttcccctccaactcttcttaccttctcttaaaggaaagaagaacaacccacatcagctgccatcccacccttaaaagaagacaataaatagcccattaaggatggcagtttgcacagtctacaccacaccttcccttcactccccttgctctgtctccaacccaacaaagacttcctttggattcaaccaaaggcagcaggtcatcttctacaccagtgggaggggaagcagaaggaggggaggaaagaaaatttcggaggccctctattgctctgctgaggctaagacagtggtgattggtctggcagcagactcggggtgcgggaagagcaccttcatgaggaggctgaccagcgttttcggaggagcagcggagcctcccaagggagggaatccggactccaacactttgatcagtgataccaccactgtgatatgtttggatgactaccactccttggacaggaccgggaggaaggagaagggagtgacagctttggacccgagggccaacaacttcgatctcatgtatgagcaggtgaaggccctcaaggaaggggtggctgtggacaaaacctatttacaaccatgtcactggtctctggaccccccggagctcatccagcctcccaagatcctggtcattgaaggactgcacccaatgtttgatcctcgtgtgagggatctcttggacttcagcatctacttggacatcagtaatgaggttaagtttgcatggaaaattcagagagatatggccgaacgtgggcatagtcttgaaagtattaaagctagcattgaggctcgaaaacccgactttgatgcttacattgatccacagaagcaatatgctgatgctgtgatagaagttttgccaacccaattgattcctgatgataatgaagggaaagtgttgcgggttcgcttgattatgaaagaagggtcgaagtatttcagcccggtttacctctttgatgaaggctccaccatctcttggataccttgtggaaggaaactgacttgttcataccccggaatcaaattcttctatggcccagacacctacttttcccatgaggtttcagttttggagatggatgggcaatttgacagattagatgagctcatatatgtggagagccatctaagcaacatctcaaccaagttctatggggaggtgactcagcagctgttgaagcatgccgacttcccaggcagcaataatgggaccggtctcttccaaactatcgtcggtctgaaaataagagatctatatgaacagatcgttgcgaagaaggcagctgctcctgcagaagcagcaaaagtttaatgttccacactggcatagtcgaattcagattttcttatcatgtttggcctcctaaaatgatagcatcagtatttgtatctcatgtaatctatatagaatctgtaatataggagcaggccaaaagaaatgtggcagattcccctcaggttgcaagcaatggctatgtagatcactgctcctttctttgcagtcacgatttccttggaaatcagatgcctttgttgatagaagaaaaaaaaaaaaa

SEQ ID NO: 1406 - DNA, 1336 bp, Centaurea maculosa
  misc_feature (159)..(159): n is a, c, g, or t
  misc_feature (178)..(178): n is a, c, g, or t
  misc_feature (1261)..(1261): n is a, c, g, or t
ggggacacaatagtaattggactagcagcagactcagggtgtgggaagagtaccttcatgaggaggctgaccagcgtctttggcggtgcagcatcgccaccaaagggcggcaatcccgattcaaacacgctcataagcgacacaacaacggtgatctgnttggatgattaccattcantggatagaacaggaaggaaagtggaaggtgtgacagcacttgatccaagggccaacaattttgatcttatgtatgaacaggttaaggctcttaaggatggtattgctgttgataagcccatctataaccatgttagtggtcttttggaccctccagagctcattaagccccccaagatccttgtcattgaaggtttgcacccaatgtatgatgagagagtaagagacctattggacttcagtatctacttggatatcagcaacgatgttaaatttgcctggaaaattcagagggacatggcagagagaggacacagccttgaaagtatcaaagctagtattgaggcccgaaagccagattttgatgcttatattgacccacaaaagcagtatgcagatgcagttatagaagtgctacctacgcagctgattccaggcgacaatgaagggaaggtcttaagagttaagctgataatgaaagagggagtgaaatacttcagtcctgtttacttgtttgatgaaggctccaccatctcatggatcccatgtgggaggaagctcacctgttcttaccctggtatcaaattcaattatggccccgattcttactttggccaagaggtgtctgtgttggagatggacgggcaattcgacagactggatgagctcatctatgtcgagagccatttgagcaacatctccaccaaattttatggagaaattacacagcaaatgttgaagcatgccgacttccctggtagcaacaatggcaccggtctcttccaaaccattgttgggttgaaaatccgagacctctttgaacaaatcacggcaagcagggcttcagctccattggaagctacaaaagcttaaagtaaagaaagaaacgaaaaagtggtttaacatggaaacaaaaaagtcccttgatttttctttccttctacaacctcctttgtcatgtaaaatttccgagtgtttaggcttttatcgcgagtttcatgagagttgcactcccatatgtatttagttccatttgtctattccatggagatatgtaaaatagagaatcaaaatcttgactganatcttgagaagatcaaagaacttattattaagattacctgcgcataccagaagtataagtgcaggtagcaatctt

SEQ ID NO: 1407 - DNA, 1344 bp, Flaveria ramosissima
gtacacagcccaatctctcaactcaacatgttcaatctcaacacccacaaaaacccatttgggaattcagcaaagacaagtgttgttctatactaaaaagaccaataggggcagggtgaggggtggtgagataagatgctcaggggacacaatagtaattggactagcagcagactcagggtgtggaaagagtaccttcatgaggaggttgactagtgtgtttggaggtgcagcagaaccaccaaagggaggcaatccagattcaaacacactcataagtgacaccacgacagtcatatgtttggatgattaccattcattggatagaacagggaggaaggtggaaggggtgacagcacttgatccaagagccaataactttgatcttatgtatgagcaagttaaggctttgaaagatggtattgctgttgaaaagcccatttataaccatgttagtggtcttttggaccctcctgagaccatcaagccacctaagatccttgtcattgaaggtttgcacccaatgtatgatcagagagtaagagacctcttggatttcagtatctacttggacatcagcaatgatgttaaatttgcctggaaaattcagagggacatggcagaaagaggacacagccttgaaagtatcaaagctagtattgaggccagaaagccagattttgatgcttatatcgacccgcaaaagcaatatgcagatgctgttatagaagtgttgcctacacagctcattccaggtgacaatgaggggaaggtgttgagagtcaagctgataatgaaagagggagtgaaatacttcagccctgtttacttgtttgatgaaggctccaccatctcatgggttccatgtgggaggaaactcacctgttcttaccctggtatcaaatttgcctatggccctgatacttactacggtcatgaggtctctgtgttggagatggacgggcaatttgacaaactggatgagcttgtctatgttgagaaccatttgagcaacatttccaccaaattctatggagaaatcacccagcaaatgttgaagcattcagatttccctggtagcaacaatggcactggtctcttccaaaccattgttggtttgaaaatcagagatctctttgaacaaatcacagccagcaaggcctcggctacattggaagctacaaaagcttaaactaaagaaacataaagaagccctttgaatcttctttcctccacaacccttttttcatgtaaaattctgagtgttaggcttttatcacgagtctctcccatatgtattacagggttgtaaaattcggacagggcactgaaatcaatacaata

SEQ ID NO: 1408 - DNA, 1189 bp, Olea europaea
tgtaataacatgctccgccgggaacacagtggtgattggcttagctgcagactctggctgtggaaaagcaccttcatgcggcggttgacgagtgtcttcggcggagcggcagagccaccgagggcggcaaccctgactctaacacactgattagtgacaccactactgtgatttgtttggatgattatcattcactagatagaactgggagaaaagagaagggagttaccgcacttgatccaagagcaaataattttgatcttatgtatgaacaggttaaggcgattaaaaatggtgttgctgtggagaaacctatctataatcatgtcaccggtttaattgaccctcctgaattgatcaagcctcccaaaatttttgttattgaaggattgcacccaatgtacgatgcccgggtgagagaactcttggacttcagtatctatttggacattagcaacgaggttaaatttgcatggaaaattcagagggacatggctgagagaggacacagtcttgaaagcattaaagctagtattgaagcaaggaagcctgattttgatgcttacattgatccacagaagcaatatgcagatgcagttattgaagtgttgccaacacaactcattcctgatgacaatgaagggaaggtcttaagagtaagattgataatgaaagaaggggtgaaatatttcaaccctgtttacctctttgatgaaggttccaccatttcatggatcccttgtggaaggaagttgacatgttcttatcctggcatcaaattctcttacggccccgaaacctactttgggcacgaggtgtcggtgttggagatggatgggcagtttgacaggctagatgaactgatctatgtagaaagccatcttagcaacatttcgaccaagttctatggagaagtcacacaacaaatgttgaagcatgcggatttccctggcagcaacaatggcaccggacttttccaaacaatagttggcttgaaaatcagagacctctatgagcagatcgttgctagcaaaactggagctccattggaagctacaaaggcataagagatgcgtatggcgcatgtttggtaaggtgcaattggacactgtgatgaatgagattttaaatcatctttcttctttaatattgtccaatattatttaatctgccgaccaaacgtgccaaa

SEQ ID NO: 1409 - DNA, 1979 bp, Panicum virgatum
cggaggaagaatactgacaaaatacactggttaagactgaaagggagaactcattttcagctcagtataagctgcccttgatattatataaaaaaaaaagagtgaaaaatagggacatcacatcacatgatcgccaccctcttttccttcttatgttcttctagctccacatccagcatcccattttccctcttctcttcaagtcccacccataaggcttggagggaagaagagagagcttagcagcccagaaccaaagccggcaagcaaaatggcgatctgcagcacgcacaccaccacctccctgcactccccatgcacagtctcaaacacaggcttcaggcagaagcaagtcatcttcttcaccagcaacaggagaagtggcagaaggcatggaggggcaagaacctttcaggtttcatgctccgtggagaagccagtggtgattggcctggcggcagactcaggatgcgggaagagtaccttcatgcgccgtctcaccagtgtgtttggtggtgctgcagagccacccaagggtggtaacccggactccaacaccctcatcagtgacaccacgacggtgatatgccttgatgactaccattccttggacagaaccgggagaaaggagaagggtgttaccgccctcgacccaagggcgaacaactttgatctcatgtatgagcaggtgaaggcgatgaaagaaggccagacaattgagaagccgatctacaaccatgtcactggcctcctcgacccaccggaggttatcacacccccaaagatttttgtcattgagggcttgcacccaatgtttgatgagcgtgtgagagacctcctagatttcagtatctacttggacatcagtgatgaggttaagtttgcatggaaaattcagcgggacatggcagagcgcgggcacagccttgaaagcatccaggctagtatcgaagctaggaaaccagattttgatgccttcattgatccgcagaagcaatatgctgatgctgtgattgaagttctgccgacacagttgattcccgatgacaatgaaggaaaggtgctacgtgttaaattgatcatgaaagaaggcgtgaagcacttcaacccagtttacctcttcgatgaaggatcaagtatcaactgggtgccttgcggaagaaagctcacatgctcttaccctggcatcaaatttgcctatggcccagacagttacttcggccacgaggtatcagtgttggagatggatgggcaattcgacagactagatgagctcatctatgtggagagccatctaagcaacctctcaactaaattctacggagaagtgacacagcaaatgctaaagcatgcagatttcccaggaagcaacaacggaacaggtctcttccagaccattgttggactgaagattagagatctctatgagcagatagttgctgagagggctggtgtaccagctgaagcagcgaaagtttaatgatctacacattcagatttcctacacctcttcaaactcaatgagaatgagaatcctcgaaattcttgtaattagttcggatatatcacgactaggaggtagaaatgtcattgcagtactcaggaaaacatgcaatggaatttctagaaatacctcgccatgggggtgctcttacatctcttcttcacatgttcaaatgtatatcttcttccatgcttttatgcagaaagaaatacagctgcctgctactatcaagtgtaggtgtgcttctagtgtcggttatttatctgaccaggacccaatgttcatgcaagaacagtcaagagggatcgagatagaacatctattttgatgaattacatagagtaaatttataagtggcccaataaggagcatggtgttctggccaacacatcctatttgtaaatcagcataacgatggataccaaccatggatcattagtgacaaaaggcttaaaacttatggagttaccctcca

SEQ ID NO: 1410 - DNA, 1348 bp, Tripterygium wilfordii
caacccaactctctcaactcaacatgctcaatctccacaccaacaaaaccaacttagggtttctaccaaaacaggttgtgttctatagtacttctggtaagagaagcagcaagagaggtggtagtaccactactgtgataacctgctcagcaggtgactcacagacagttgtgattggtctggcagcagactctggatgtgggaagagtactttcatgaggaggctaacaagtgtttttggaggagcagcagagccgcccagaggaggaaatccagactcaaacacactgataagtgacacaacaactgtgatttgcttggatgattatcattctcttgatagaacgggaaggaaggagaagggagtcactgctcttgacccaagagccaataactttgatctcatgtatgagcaggttaaggcaatcaaggatggaattgctattcagaaaccaatctacaatcatgtatctggtcttattgaccctcctgagctcatcaagcctcccaagatctttgtcattgaaggacttcacccaatgtatgatgagagagtaagggacctgttggacttcagcatctacttggacatcagtaatgaagttaagtttgcatggaaaattcagagggacatggccgagcgagggcacagccttgaaagcattaaagctagtattgaagcgagaaagccggactttgatgcttacattgatccacagaagcaatacgcggatgctgtgattgaagtacttccaaccgaactcatcccggacgacaacgaggggaaggtcttgagagttaggttgataatgaaggaaggtgtgaagttcttcaaccctgtttacttgtttgatgaaggctccactatttcatggataccctgtggaaggaaactcacctgctcttatcctggcatcaagttctcctatggccccgactcttacttcggccacgaggtgtctgtactggagatggatgggcaatttgacagattagatgagctaatctatgtagagagccatttgagcaacatttccaccaagttctatggtgaggtcacccaacagatgttgaagcattctgatttccctggcagtaacaatggaaccggtctcttccaaactataattggattgaaaataagagatctgttcgaacagcttgtcgcgagcagggctggagcccctgtagaagcaaaggcctaagcacaaatgcacttcactcgtctttttttttgtttccactggctgttactggttaaaatgagaatcactctatgtacctatttcaatttgtaattgtattgggagtttgtaaaatagataagaaataacagagatgaaattca

SEQ ID NO: 1411 - DNA, 1414 bp, Triticum aestivum
accaagtcatcctcttcacgaccagaagcagcaggaggagtaacacgaggcatggggcaaggaccttccaggtctcatgcgcagttgagcagccaatagtgattggcctggcagcagactcgggatgtgggaaatccaccttcatgcgccggctcacaagcgtgtttggaggtgctgcagagccacccaagggcggcaacccagactccaacacgctcatcagcgacacgacgacggtcatatgccttgatgactaccattccttggacagaaccgggaggaaggagaaaggtgtgaccgccctggaccccaaggcaaacgactttgatctcatgtatgagcaggtgaaggcaatcaaggaaggcaaggctattgagaagccaatctacaaccacgtcactggcctcctcgacccggcggagctcatccagccccccaagatcttcgtcatcgagggtttgcacccaatgtacgatgaacgtgtgagagagctccttgatttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattgaagttctgccaacccagctgattcctgatgacaacgaaggaaaggtgctgcgagttaaattgatcatgaaagaaggcattaagttcttcaacccggtttacctcttcgatgaaggatcaaccatcaactggatcccttgtggaagaaagcttacatgctcttatcctggcatcaaattttcctatggcccagacacttactttggccaagaggtatcggtgctggagatggatgggcaatttgacagactagatgaactcatctatgttgagagccacctaagcaacctctcaaccaagttctacggggaggtgacacagcaaatgctaaagcatgcagacttcccaggcagcaacaatggaacaggtctcttccagaccattgtaggactgaagattagagatctctatgaacagatcatcgctgagagggccggcgttcctgctgaagcagcaaaagtttgatgagacccaaattcaagttcacgaatcatttcatcaccaactcaatgagaatgagcatcctcgcatttcttgtacctagtttgaatatattacagctagaagacggtagaaagttcactgcagaactcatgaaaacctgcattttgaacttctcgaaaatcctctccatgatgagggtctcttatgtctcttcttaacaaatttcgatgtacatcttctcccatgtttcaatgcagaaaatacatgtgcttgctagaatcaaaagcggctgcttttat

SEQ ID NO: 1412 - DNA, 1472 bp, Pennisetum glaucum
attctcactctcttcttctcttcaagttccagtcacaaggcttggagggaagaaggaaagcttagcccagaacaaaagcccgcaagcagaaaatggcgatcagcagcgcgcacaccaccacctctctgcactccccatgcacaactgtctcgaacgcaggcttcaggcagcagcaagtcatcttcttcaccagcaaccggggaagcggcagaaggcacggaggggcaagaacctgcttccaggtttcatgctccgtccagaagccagtggtgattggcctggcagcagattcgggatgcgggaagagtaccttcatgcgccggctcaccagtgtgtttggtggtgctgcggagccacccaagggcgggaacccagactccaacacgctcatcagtgataccacgaccgtgatatgccttgatgactaccattccttggacagaaacgggaggaaggagaacggtgtgacagccctcgacccaagggcgaacaactttgatctcatgtatgagcaggtgaaggcaatcaaagaaggccagacaatcgagaagccaatctacaaccatgtcactggcctcctcgacccaccagaggttatcacgcccccaaagattttcgtcattgagggcttgcacccaatgttcgatgagcgtgtgagggacctcctagatttcagtatttacttagacatcagtgatgatgttaagtttgcatggaaaattcagcgggacatggcagagcgtgggcacagccttgaaagcatcaaggctagcattgaagccaggaaaccagattttgatgcctttatcgatccgcagaagcaatatgctgatgctgtgattgaagttctgccaacccagttgattcctgatgacaatgaaggaaaggtgctgcgtgttaaattaatcatgaaagaaggcgtgaagcacttcaacccagtttatctcttcgatgaaggatcaagcatcagctgggtaccttgtggaagaaagctcacatgctcttaccctggcatcaaattcgcatatggcccagacacttactttggccatgaggtatcagttctggagatggatggacaatttgacagactagatgagctcatctacgtggagagccatctaagcaacctctcaactaaattctacggagaggtgacacagcaaatgctaaagcatgctgacttcccaggaagcaacaatggaacgggtctcttccagaccatcattggactgaagattagagacctctatgaacagatagttgctgagagggccggtgtaccagcggaagcagcgaaagtgtaatgatctccagattcagattacctcttcaaactcaatgagaatgagaatcctcgaatttcctgtaattagttcggatatatcacagctagaaggaggtagagatgtcattgcggtactcaggaaaacatgcaatggaatttctacaaatccctcgccatgggggtg

SEQ ID NO: 1413 - DNA, 1713 bp, Sciadopitys verticillata
aaaacctgtgaacaaatgggcgataattcgttagcgaaaactaacaaaaaggctcttgatttctcccactgaaacaattgctgtgtatgcagtcgtagttgcaggggcgaggtcgcacgttcgaatccgttggaagaaagagtgaataaaaaatggcttgcccagctcctacaataaccacacccgcacacagatattcttctgtgtctttggccccctctaccaagtttctcccgggagtctcttccttgaggagcaggggcaggagagccggggccctggtcatatgctccgcggcgcccgataagaccgtggttataggcctcgcggcggattcgggatgcgggaaaagtacgttcatgaggcgcttaacgagcgtgtttggcggagcggcggagcccccccagggtggcaatcctgattctaatacgcttatcagcgataccaccacggtcatatgcctcgacgactaccattccttggatagatatggcaggaaagagaaaggcgtgacggcgctagaccccaaggctaataacttcgatcttatgtatgagcaggtgaaggctctcaaggagggtaagtctattatgaagcccatatataaccacgtctctggtttgctagatcccccggaggagattcctcctcctaagattctcgtcatcgaaggccttcatcccatgttcgattctcgcgtgagagagctgctggatttcagcatatatctggacattagcaatgaggtcaagtttgcctggaaaattcagcgtgacatggcagaacgtgggcacagtctagaaagtatcaaagcaagtattgaagcccgcaagccagactttgatgcttttattgatccacagaagcaatatgcagatgttgtgattcaggttttgcctacacagctgattcctgatgacaatgagggcaagatcttgagagttaggatgataatgaaagaaggtgtcgaagacttcagcccagtctatctatttgatgagggctccacgatctcttggattccatgtggtagaaagttaacatgttcatatcctggcatcaagttcttctatggccctgacgtttactatgaccaagaggtgtctatgttggagatggatggtcagtttgacagactagatgaactgatatatgtggagagtcacttgagtaacatatccaccaagttctatggagaaattacccagcagatgttgaaacatgctgattttccaggaagcaacaatggcactggtcttttccaaaccatagttggactaaaaatcagggatctctacgaacagatcatttcagagaagaaaagaacaacttttgcagcagctaaggcctagaatggaagaagttacagtgtaaaataaaatctgacgacatcctgcacttgttggtaaattatgaggcattgaatcatcggatgtattataaaaaaacagtccaacgtttaaagaaatgctattgaagtttttttgtttgattcttcactgtgatatgacgtttgggcacctgttttttttgtgggacggttttaatttcatgacatcgtagtgtcttaaaatagcaatgggcacaccatacggcgttagcttttctttgtggatggcattgatgatgctggtgaatattcagtcgtggaatctattacgttactatgcaaggataactcttcctaataattttggggaatttggagggaca

SEQ ID NO: 1414 - DNA, 2364 bp, Arabidopsis lyrata
gctttcttcagtctctctctccaatggcgttcacttttctctctcctaacccagtctttctctctctaactggaaccacctcttcgttctcctacaaacctgttctcttaccattctctcgaaattcccgtaatctcacggttgcggcgggacctgctcgccggaattcgtacccgaaccctgcagatgacgatccacctgaagcaccggaggattcaatgcacggagtatcgaagtttcagcagatacagcgtcaagctgctcgtgcacggaaactagaggaagaagatttcgagaagaatcggaacacttatctctccgctatcgccgatgtggaagacgcggcagagacgggacgagatgatgaagaatctggtggcgatttgttttcagatatcgatagagcaatctccatgaaacgtagtgagttcgtgaagcaaggattgctcaaacctaatcctccgaaaacggcgtcgcttaagaagattggggaggagggagatgaggaagaaggtgatgttactgacgttgttgatgagcttgatgaagaagaagttgttgatttggatgaaattgataaattaactggattaaccgagatttctgatgaagaagattgggttgatgaggaaggtaacaccaggatcaacaagaagaaggagattgggtctgatcatcaatttgaattcgatttggatgattttggtgaatctaaagtgagaattgtggaacctaaattcaaaatgagcttagctgagcttttagatgagagtaaagtggtaccaatctcagtttacggggatttagatgtcgagatcaccgggattcagcacgattcacgaggtgtgagtgccggagatctcttcgtgtgttgtgtaggaagtgaaagtttcttgagtgaagcagataagagaggagcagtggcggttgtagctagcaaagagattgatattgaagatactttaggttgcaaagcacttgtcattgttgaagacactaatgcggttttagcagctttagcctcttcgttttataggcatccgtcgaagaacatgtcggtgatcggagttactggtacagatgggaaaacgactactacgtatttgattaagagcctctacgaagcgatgggcgtgcgaacaggaatgtttagcacagtttcttgttatattcatggcgataacaaattggatacgcctaatgctacaacgaatcctgatgctgttttggttcagagtttgatggctaagatgttgcataatggaactgaagctttggttatggaagcttctcctcaagaacttgctttagggaaatgtgatgaagtggatttcgacattgcagttttcacaaatttgactagagaaaatacagattttcgtggtaccgatgaagagtatagagatgctgaagccaagttgtttgcaagaatggttgatccgggaaggcataggaaagtggttaacatagatgatccaaacgcaacattcttcgtccagcaagggaatcctaatgttcctgttgtgacatttgccatggaaaacaccaaagccgatgttcacccattaatgtttgagctttccttgtttgagacacaggttttggttaatacccctcaaggtatattggagatctcttcaggtttgttaggaaggcataacatttataatattcttgctgctgtggctgttgggattgcggttggagctcctcttgaggatattgttagaggtgttgaggaagtcgatgcagtcccgggaaggtgtgagttgattgatgaggaacaagcttttggtgttattgtggatcatgcaaacacacctgatggcttgtcaaggctgctagattcaattcgagagcttaaaccgagaagaatcattaccgttattggttgtgagggtgagaatgaaagagggaaaagaccgcttatgacaaaaattgctactgaaaagagcgatgtgacaatgttgacatctgataatccgaggaatgaagatccattggacatcttggatgacatgttggctgggattggatggacgatgcaagagtatttgaaacatggcgaacacgattactatccgcctttggcaaatggtcatagactctttcttcatgatattagacgtgtagctgtgcgttgtgctgttgctatgggtgaagaaggtgatatggttgttgtagctggaaaaggccatgaagcgtatcagcttgaaggtgaaaagaaagagttctatgatgacagagaggaatgccgggaagcattacaatacgttgatgagcttcaccaagctggaatagacacaagcgagttcccatggcgattaccagagagtcattaatatctccgtggtgaagtcatta

SEQ ID NO: 1415 - DNA, 2647 bp, Arabidopsis lyrata
tgcttgctttcttcagtctctctctccaatggcgttcacttttctctctcctaacccagtctttctctctctaactggaaccacctcttcgttctcctacaaacctgttctcttaccattctctcgaaattcccgtaatctcacggttgcggcgggacctgctcgccggaattcgtacccgaaccctgcagatgacgatccacctgaagcaccggaggattcaatgcacggagtatcgaagtttcagcagatacagcgtcaagctgctcgtgcacggaaactagaggaagaagatttcgagaagaatcggaacacttatctctccgctatcgccgatgtggaagacgcggcagagacgggacgagatgatgaagaatctggtggcgatttgttttcagatatcgatagagcaatctccatgaaacgtagtgagttcgtgaagcaaggattgctcaaacctaatcctccgaaaacggcgtcgcttaagaagattggggaggagggagatgaggaagaaggtgatgttactgacgttgttgatgagcttgatgaagaagaagttgttgatttggatgaaattgataaattaactggattaaccgagatttctgatgaagaagattgggttgatgaggaaggtaacaccaggatcaacaagaagaaggagattgggtctgatcatcaatttgaattcgatttggatgattttggtgaatctaaagtgagaattgtggaacctaaattcaaaatgagcttagctgagcttttagatgagagtaaagtggtaccaatctcagtttacggggatttagatgtcgagatcaccgggattcagcacgattcacgaggtgtgagtgccggagatctcttcgtgtgttgtgtaggaagtgaaagtttcttgagtgaagcagataagagaggagcagtggcggttgtagctagcaaagagattgatattgaagatactttaggttgcaaagcacttgtcattgttgaagacactaatgcggttttagcagctttagcctcttcgttttataggcatccgtcgaagaacatgtcggtgatcggagttactggtacagatgggaaaacgactactacgtatttgattaagagcctctacgaagcgatgggcgtgcgaacaggaatgtttagcacagtttcttgttatattcatggcgataacaaattggatacgcctaatgctacaacgaatcctgatgctgttttggttcagagtttgatggctaagatgttgcataatggaactgaagctttggttatggaagcttctcctcaagaacttgctttagggaaatgtgatgaagtggatttcgacattgcagttttcacaaatttgactagagaaaatacagattttcgtggtaccgatgaagagtatagagatgctgaagccaagttgtttgcaagaatggttgatccgggaaggcataggaaagtggttaacatagatgatccaaacgcaacattcttcgtccagcaagggaatcctaatgttcctgttgtgacatttgccatggaaaacaccaaagccgatgttcacccattaatgtttgagctttccttgtttgagacacaggttttggttaatacccctcaaggtatattggagatctcttcaggtttgttaggaaggcataacatttataatattcttgctgctgtggctgttgggattgcggttggagctcctcttgaggatattgttagaggtgttgaggaagtcgatgcagtcccgggaaggtgtgagttgattgatgaggaacaagcttttggtgttattgtggatcatgcaaacacacctgatggcttgtcaaggctgctagattcaattcgagagcttaaaccgagaagaatcattaccgttattggttgtgagggtgagaatgaaagagggaaaagaccgcttatgacaaaaattgctactgaaaagagcgatgtgacaatgttgacatctgataatccgaggaatgaagatccattggacatcttggatgacatgttggctgggattggatggacgatgcaagagtatttgaaacatggcgaacacgattactatccgcctttggcaaatggtcatagactctttcttcatgatattagacgtgtagctgtgcgttgtgctgttgctatgggtgaagaaggtgatatggttgttgtagctggaaaaggccatgaagcgtatcagcttgaaggtgaaaagaaagagttctatgatgacagagaggaatgccgggaagcattacaatacgttgatgagcttcaccaagctggaatagacacaagcgagttcccatggcgattaccagagagtcattaatatctccgtggtgaagtcattagaagagaagttagcttagtccatgaaaccagattttcttccaccatggtccaatgctcttgcgaagatcgatttgcacagaggtaatgaattctacacaagtgacataaaaacatgctcaaggaaaagagattacaccacttggaggagaaagattctaaaggtggaagaagatgcttacaaattttgtaagcgttaaaacccaaaaatgtaagtgattgtgtttgtgtatcagtgtatgactgtatgttttgatttagcgatagcaggtgtttaatt

SEQ ID NO: 1416 - DNA, 2495 bp, Eutrema parvulum
cctcgaaaaacctttcatcactctctctcagtctctccaatggcgttcacttttctctctcctcacccggtctttctctctctagctggaaccacctcttccttctcctacaaaccggttttgttaccgttctctcgaaattctcgtagtctccacttagcggcgggacctgctcgtcggaattcttacccgaacccagcagatgacgatccgcctgaagcgccggaggattcaatgcacggagtttcgaagtttcagcagatacagcgtcaagctgctcgtgcacggaagctagaggaagaagacttcgagaagaatcgaaacacgtatctctcagccattgccgatgtagaagacgcgccggaaacgggacgagatgacgtggaatctggaggcgatctgttctcagatatcgatagagctatatccatgaaacgtagtgagtttgtgaagaaaggattgctccaacctaatcctcccaaaacagcgtcgtctaagaagattgaggaggaagatggagaagatggtgatgttaccgacgctggtgatgagcttgacgaagaagaagttgtagatttggacgaaatcgataaactaactggattaaccgaagtctctgacgaagaagattgggtggatgaggaaggaaaccctaagatcagcaagaagaaggaaatgagttccgatcatcaattcgagttcgatttggatgatttcggtggatctaaagtgagaattgtggaacctaaattcaaattgagcttagctgagcttttagacgagagcaaagtggtaccgatatcagtttacggcgacttagacgtcgaaatcaccggaattcagcacgactcgcgtggtgtaagcgccggtgatctcttcgtgtgctgtatagggagtgaaaacgatggagattcggtcttaagcgaagctgacaagagaggagcagtggctgttgtagctagcaaagagatcgacattgaagacaccttaggttgtaaagcacttgtcatcgttgaagacacggacgcggttttagcagctttagcttcttccttttataggcatccgtcgaagaacatggcggtgatcggagtcaccggcacaaacgggaaaacgaccaccacgtatttgattaaaagcctctatgaagcgatgggtgtgcgaacaggaatgtttagcacagtttcctgttatatccatggagataacaaattggattcgcctaatacgactacgaatcctgatgcggttttggttcagagcttgatggctaagatgttgcataatggaactgaatctctggttatggaagcttctcctcaagaacttgctttagggaaatgtgatgaagtggatttcgacattgcggttttcacaaatttgactagagaggatagtgattttcgtggtactgacgaagagtatagagatgcggaagccaagttgtttgcaagaatggttgacccggaaagacacaggaaagttgttaacatagacgatccaaacgcagcatttttcgtccagcaagggaatcctaatgttccggttgtgacatttgccatggagaacacaaaagccgatgttcacccgttaaagtttgagctttccttgtttgagacacaggttttggttaatacccctcaaggtatactggagatctcttcgggtttgttaggacggcataacatttataatattcttgctgctgttgctgtcgggattgctgtgggagctcctcttgaggatatagttagaggtattgaggaagtcgatgcagtccccggaaggtgtgagttgattgatgaggagcaagcttatggtgtaattgtggatcatgctaacacacctgatggtttgtcaaggctgttagattctattcgagagcttaagccaagaagaatcattactgttattggttgcgcgggtgagactgagagagggaagagaccagttatgacaaaaatcgctacggaaaagagcgatgtgacgatgttgacatctgataatccagggaatgaagatccattggacatcttagatgacatgttggctgggattgggtggacgatgcaagaatatttgaaacacggcgaacatgattactatcctcctttggcaaatggtcatagactcttccttcacgatattagacgtgtagctgtgcgttgtgctgttgctatgggtgaagaaggtgacatggttgttgtagcagggaaaggccatgaagcgtatcagcttgaaggtgataagaaagagttctatgatgatcgagaggaatgccgggaagcattacaatatgttgatgagcttcaccaagctggaatagacacaagcgagttcccatggcggttaccagagagtcactaatgtctctacggtgatatcattagaacagaagtttggttattagcgaaaccatgaaatcagatttacttccacctcggctcttgcgaaatcgatttgctgagagctcatgaattctacacaagagactt

SEQ ID NO: 1417 - DNA, 2438 bp, Eutrema halophilum
cctcgaaaaacctttcatcactctctcagtctccaatggcgttcactttcctctctcctcacccagtatttctctctctaggaggaaccacctcttccttttcatacaaaccgattatcttaccattctctcgaaattcccgtaatcttccgttagcagctggacctgctcgtcggaattcgtacccgaacccagcagatgacgacccgcctgaggctccggaggattcaatgcacggagtgtcaaagtttcagcagatacagcgtcaagctgctcgtgcccggaagctagaggaagaagatttcgagaagaatcggaacacgtatctctccgccatcgctgatgtggaggacgcggcggagacgggacaagatgacgtagaatctggaggagatctgttctcagatatcgacagagctatttccatgaaacgcagtgagtttgtcaagaaaggttttctccagcccaatcctcccaaaacggcgtcgtctaagaagattgaacaggaagatggggaagaaggtgatgtcaccgacgtcggtgatgagcttggagaagaagaggttgaagatttggatgaaattgataaactaactggattaaccgaagtctccgacgaagaagactgggtggatgaggaaggaaacccaaggatcaacaagaagaagaatattggatccgatcatcaattcgagttcgatttagatgatttcggtggatccaaagtgagaattgtggaacctaaattcaaattgagcttagctgagcttttagacgagagcaaagtggtaccgatctcagtttacggcgacttagacgttgagatcaccggaattcagcaggattcgcgaggtgtaagtgccggagatctcttcgtttgctgtgttgcaagtgaaaacgatggagattccttcttgagcgaagctgacaagagaggagcagtggctgttgtagctagcaaagagatcgacattgaagatacattaggttgcaaagcactcgtcatcgttgaagacactaacgcagttttagcagcgttagcttcttccttttataggcatccgtcgaagaacatggcggtgatcggagtcaccggcacgaacgggaaaacgaccaccacgtatttgatcaaaagcctctacgaagcgatgggtgtgcgaacaggaatattcagcacagtttcttgttatatccatggcgataccaaattagatacgcctaatgccacaatgaaccctgatgcggttttggttcagagtttgatggcgaagatgttgcataacggaactgaagctctggtcatggaagcttctcctcaagagcttgctttagggaaatgtgatgaagtggatttcgacattgcggttttcacaaatttgacaagagaggatactgattttcttggtactgacgaagagtatagagatgctgaagccaagttgtttgcaagaatggttgacccggaaaggcacaggaaagtggttaacatagacgatccaaacgcagcgtttttcgtccgacaagggaatcctaatgttcctgttgtgacatttgccatggagaacaccaaagccgatgtttaccctttgaagtttgagctttccttgtttgagacacaggttttggttaatacccctcaaggtatactagagatctcttcaggtttgttaggacggcataacatttataacattcttgctgctgttgctgtcgggattgctgttggagctcctcttgaggatattgttagaggtgttgaggaagtcgatgcagtcccggggaggtgtgagttgatcgatgaggaacaagcttttggtgttattgtggatcatgctaacacacctgctggtttgtcaaggctgctagattcagttcgagagcttaaaccgagaagaatcattacggttattggttgcgagggtgagaatgagagagggaaaagaccgcttatgacgaaaatcgctactgaaaagagtgatgtgacgatgttgacatctgataatccaaggaacgaagatccattggacatattggatgatatgttagctgggattgggtggacgatgcaagagtatttgaaacacggcgaacacgattactatccgcctctagcaaatggtcatagactcttccttcacgatattagacgtgtagctgtgaggtgtgctgttgctatgggtgaagaaggggacatggttgtcgtagcagggaaaggccatgaagcgtatcagcttgaaggtgataagaaagagttctatgatgaccgagaggaatgtcgagaagcattacagtacgttgatgagcttcaccaagcaggaatagacacaagcgagttcccatggcggttaccagagagtcattaatgtctgagacattggtgagatcattagaatagaagttagctaatagctaagacatgaaattggttttacttccac

SEQ ID NO: 1418 - DNA, 2345 bp, Eutrema halophilum
cctcgaaaaacctttcatcactctctcagtctccaatggcgttcactttcctctctcctcacccagtatttctctctctaggaggaaccacctcttccttttcatacaaaccgattatcttaccattctctcgaaattcccgtaatcttccgttagcagctggacctgctcgtcggaattcgtacccgaacccagcagatgacgacccgcctgaggctccggaggattcaatgcacggagtgtcaaagtttcagcagatacagcgtcaagctgctcgtgcccggaagctagaggaagaagatttcgagaagaatcggaacacgtatctctccgccatcgctgatgtggaggacgcggcggagacgggacaagatgacgtagaatctggaggagatctgttctcagatatcgacagagctatttccatgaaacgcagtgagtttgtcaagaaaggttttctccagcccaatcctcccaaaacggcgtcgtctaagaagattgaacaggaagatggggaagaaggtgatgtcaccgacgtcggtgatgagcttggagaagaagaggttgaagatttggatgaaattgataaactaactggattaaccgaagtctccgacgaagaagactgggtggatgaggaaggaaacccaaggatcaacaagaagaagaatattggatccgatcatcaattcgagttcgatttagatgatttcggtggatccaaagtgagaattgtggaacctaaattcaaattgagcttagctgagcttttagacgagagcaaagtggtaccgatctcagtttacggcgacttagacgttgagatcaccggaattcagcaggattcgcgaggtgtaagtgccggagatctcttcgtttgctgtgttgcaagtgaaaacgatggagattccttcttgagcgaagctgacaagagaggagcagtggctgttgtagctagcaaagagatcgacattgaagatacattaggttgcaaagcactcgtcatcgttgaagacactaacgcagttttagcagcgttagcttcttccttttataggcatccgtcgaagaacatggcggtgatcggagtcaccggcacgaacgggaaaacgaccaccacgtatttgatcaaaagcctctacgaagcgatgggtgtgcgaacaggaatattcagcacagtttcttgttatatccatggcgataccaaattagatacgcctaatgccacaatgaaccctgatgcggttttggttcagagtttgatggcgaagatgttgcataacggaactgaagctctggtcatggaagcttctcctcaagagcttgctttagggaaatgtgatgaagtggatttcgacattgcggttttcacaaatttgacaagagaggatactgattttcttggtactgacgaagagtatagagatgctgaagccaagttgtttgcaagaatggttgacccggaaaggcacaggaaagtggttaacatagacgatccaaacgcagcgtttttcgtccgacaagggaatcctaatgttcctgttgtgacatttgccatggagaacaccaaagccgatgtttaccctttgaagtttgagctttccttgtttgagacacaggttttggttaatacccctcaaggtatactagagatctcttcaggtttgttaggacggcataacatttataacattcttgctgctgttgctgtcgggattgctgttggagctcctcttgaggatattgttagaggtgttgaggaagtcgatgcagtcccggggaggtgtgagttgatcgatgaggaacaagcttttggtgttattgtggatcatgctaacacacctgctggtttgtcaaggctgctagattcagttcgagagcttaaaccgagaagaatcattacggttattggttgcgagggtgagaatgagagagggaaaagaccgcttatgacgaaaatcgctactgaaaagagtgatgtgacgatgttgacatctgataatccaaggaacgaagatccattggacatattggatgatatgttagctgggattgggtggacgatgcaagagtatttgaaacacggcgaacacgattactatccgcctctagcaaatggtcatagactcttccttcacgatattagacgtgtagctgtgaggtgtgctgttgctatgggtgaagaaggggacatggttgtcgtagcagggaaaggccatgaagcgtatcagcttgaaggtgataagaaagagttctatgatgaccgagaggaatgtcgagaagcattacagtacgttgatgagcttcaccaagcaggaatagacacaagcgagttcccatggcgg

SEQ ID NO: 1419 - DNA, 5738 bp, Brassica rapa
cctcgaaaaaccttttcatcactctccctcagttctctccaatggcgttcactttcctctctcctcacccactcttcctctctctagccggaaccacttcttccttctcctacaaaccggtttacttaccatcctcccgaaattcccgcaaccttcagctatcggcggcacctgctcgtcgtaactcgtacccgaacccagcagacgacgacccgcccgaagccccggaggattcaatgcacggagtctcgaagtttcagcagattcagcgccaagccgcccgcgcaaggaagctagaggaagaagacttcgagaagaatcgaaacacgtacctctcagccatcgctgacgtggaggacgcgcccgagacgggacgtgatgacgtggaatcaggaggcgatctgttctcggatatcgatagagctatctccatgaaacgaagcgagttcgttaaaaaaggattgctccaacctaatcctcccaaaacggcgtcggataagaagatcgacgaggaggaagatgatgacgtcaccgacgttgttgatgagctcgacgaagaagaggttgtagatttagacgagatcgataaactaacgggattaacggaagtctccgacgaagatgactgggtcgacgaggaagggaaccctagaatcaacaagactagatccgatcatcaattcgagttcgatttggatgacttcggtggatctaaggccagaatcgtggaacctaagttcagattgagcttagctgagctcttagacgagagcaaagtggtgccgatctcagtttacggcgacttagacgtcgagatcaccggaatccagcacgattcgcgaggcgtaagcgccggagatctcttcgtgtgttgcgagaacgatggagactccgtcttgagcgaagctgataagagaggagcagtggcggttgtagctagcaaggagattgacattgaagatacgttaggctgtagagcacttgtcatcgttgaagatactgaagcggtcttagcagctttagcttcttccttttataggcatccgtctaagaacatggcggtgattggagtcacgggcactaacgggaagacgaccaccacgtatttgatcaaaagcctctatgaagctatgggtgtgagaacaggaatgttcagcactgtttcttgttatgtccatggggataacaagttggattctccagcgactacgacgagtcctgatgctgttttggttcagagtatgatggctaagatgttgcataatggaactgaagctctggttatggaagcttctcctcaggagcttgcttcagggaaatgtgatgaagtggatttcgacattgcggttttcacaaacttggctagagaggagagtggttttcgcggtactgatgaagagtatagagatgctgaagccaagttgtttgcaagaatggttgacccggaaaggcacaggaaagtggttaacattgacgatccaaacgcagcgtttttcgtccagcaagggaacgctgatgttccggttgtgacatttgcaatggagaacaccaaagctgatgttcacccgttgaagtttgagctgtctttgtttgagacacaggttttggttaatacccctcaagggattttggagatttcgtctggtttgttaggacggcataacatttataacattcttgctgctgttgctgtcgggattgctgttggagctcctcttgaggatattgttagaggtgttgaggaagtcgatgcagtccctgggaggtgtgagctgattgatgaggaacaagcttttggtgttattgtggatcatgctaacacacctgatggcttgtcaaggctgcttgattcggttcgagagcttaaaccaagaagaatcattactgttattggttgcgcgggtgagactgagagagggaaaagaccggttatgacgaaaattgctactgaaaagagtgatgtgacaatgttgacatctgataatccagggaatgaagatccattggacatattggatgacatgttggctgggattggatggacgatgcaagagtatttgaaacacggtgaacatgattattatcctcctttggcaaatggtcatagactcttccttcacgatgttagacgtgtagctgtgcgttgtgctgttgctatgggtgaagaaggtgacatggttgtggtagcagggaaaggccatgaagcgtatcagctagaaggtgataagaaagagttctatgatgatcgagaggaatgtcgggaagcattacaatacgttgatgagcttcatcaagctggaatagacacaagcgagttcccatggaggttaccagagagtcattaatatctctatggtgagatcattaaaccatgaatcagatttacttccaccgccaagatagatttgcagagacctcatgatttctatacgagagacttggaggtgtctaacaacccttgtgagtcatcagataagtgcaggggagagaagagatttaaaggtggaagaagatgtgtacaaatttttgttagtggttgttgcgtttgtctatgtgttgatggtttaagagatagcaggtgtttttttataataaacctttattggctcgaaattaaattggatgagaacataaaacaaaatccatacaaatgagttggacattacaacactgcaatgagaaggaattaagcgaccccatactaattagcaagacctaaccataagacaaccctatttcctaaagggttcataagccttcttaatcacattttagaaagtcacagtttggctaacggctctacactcgataaacatatcaaaaatacacaaccatatggtccataatccatatcagtatcaatttggttacaattcaatctgcagaccaaaaaagatatacaagaaataatccctaagatcctgaacataattaccaaaaagaatttatataaaaacatcatacttgtgttcaaaagggtaataaaatctctatctgacttttcattcttcaatcttgaacaagatctttgtggggtggattgtgtccaaattgagttctaaactcaaattctatatcaggtgtggtgagctataagggtaccggattgcatcacaaggaaggaccaatcgttgatgttcttggtaagctctatgttcatcatcaactgtcaaatgtttctcatccgtgccaaaatcgaattctttataggacccgagagaggactgttgagctgcttcttggttagacgatgtagatgcctcagggaacgttttccttagcttctgatcaacgcatctaatgacatgatcggcatcaagatcagatgaaaccgcaatcttctgctccttgggagttgtatcagtcttggagcaacgcagtctatcacggctcaatagctttggtggatcagagacttcaaagtaagtggctccgtcagtaaaaggagaagttggaccagaaccggacataaccgactaaccgagcttaggtccaatggttaaatcggaggcgaaaccaattgagattcatgaaaaatgtctttcattcatcctccaactgatatcctgcaaaacaaacacaccaaagcatttaagcaagcttccctgatactacagcataagctgcagctcttctccaaaaacctaaaggtaaggaaagaaatttgaaaacaaaatgtgttgaattgacatacccacactcatctgcagatcctcaagcattgccactgccctttctagttcctctttactacataaaccagtcagcatattacgaatagtaatggtatcaggatacacaccacttgaaatcatctcctggaaaatgtctagagctccattaatattacccacttgacaaaacccatgaatcaaggttctgtaagtaattgcattagcaactattcctcttcgacccatctcggagaaaacctccagcccatcatcaacccttcctaccttacaatagccattaatgagggtagtaaaggtcactacgtcgggagagaagcctttactacccattgaatcaaacatttgtgtagcctcatctaggcggctctgcttgcataatccatcgatcactgagttataggtgatagtatttgggactaaacctctgtggggcatctcctcgtacaattcctcggcctctgaaaacttcccttcattgatcaagccgcagatcaatatattgtaagtttgaacatcaggttccacatcattgaaggggtgactagcatcaagatccatcttactcttctgcatagctttaaacatttccaatgcatcttttagtttcccattattgcagagaccgtccagcaaagtgttacaagtaacgacattagggcacacaccactagaaatcatctcctgtaaaaggtctagagcagtattaagattgcccacctgacagaacccgtgaataagagtggtgtaagtaattgtgttagcaactaatcctcttctagacatctcatggagaatttccattccatcatctaccctcttagcccgacaatatccgtctatgaggatactgaaagtgattacgtccggagagcagcccttggtagccatcaaataaaacatgtgttccgcagcatcaagacgattctgtttggaaaagccatcgatcattgaattatatgtgattgtattagggattatacccctttgaagcatctcatagtataattcttcagcctcaaagaacttgccctccttgaccaatgcattgatcaatccactaaaagttacaacatcagggttgatcttcctttcaaacatttcttgcaacaaccgctgggcttcactccatctaccagagctacagaaaccaactatcatacagttgtaggtaaataaattaggaaagactcctttctcttgcatttcactgaaaacattttgagcatcgctacgacgtccgtctttccaaagaccatcaatgacggcactatagattacaacattgggtttgatgtggctcacctcctccatcttcctcagcagattcaacgcagacacagtgtctcccatcttacacattccatcaacaattgttccgtacgtaatctggttaggctggagaccatcttccaccatccgatcaagaagagctacagcttcaacaactctaccctcgcggcaaagaccgttcatcagcgtggtgaacgttaccacatttggtttacaaattcgatgaaaaaaacgcaaggcttcagaaaccctctcttccacacataaaccatggagcagggtggtgaaggtaacgagagtgggatgaaacccaagcttggtgagcttaccaaacgtagacagagcaaagggcagcttagagcagctgcagaaacactttatcagaatggtgaagctgtaaatattacacggaatccgccgcatttccatcttcctatggagagaaatcacaacatcgggcctttccatcctcaccacaactcccagcaatttacagaaatcaaccacacaagggaggggacgagatcgtaccatgtaactgaacaaatcaatcgcatcatctaagcctttgatttcatgaattccactttgcagcttcaacgtctctcctccaaaacctcctgctttgccgctccttttcttggcaagagtatgaagaatcgatctcgtacagaataatctagccgcaggcacagaagacgaagactcgaatctaaaaaccctagccaacatttcgttcttcgtcgatctctg

SEQ ID NO: 1420 - DNA, 2535 bp, Brassica napus
ctctctagctggaaccacctcttccttctcctacaaaccggtttacttaccatcctcccgaaattcccgcaaccttcagctttcggcgggacctgctcgtcgtaactcttcttacccgaacccagcagatgacgacccgcccgaagccccggaggactcaatgcacggagtctcgaagtttcagcagatacagcgccaagctgctcgcgcgcggaagctagaggaagaagacttcgagaagaatcgaaacacgtacctctcagccatcgctgacgtggaagacgcgccagagacgggaagtgatgacgtggaatcaggaggcgatctgttctcggatatcgatagagctatctccatgaaacgaagcgagttcgtcaagaaaggattgctccaacctaatccccccaaaacggcgtcggataagaagatcaacgaggaggaagaagatgacgtcaccgacgttgttgatgagctcgacgaagaagaggttgtagatttagacgagatcgataaactaacgggattaaccgaagtctccgacgaagatgattgggtcgacgaggaaggaaaccctaggatcaacaagactagatccgatcaccaattcgagttcgatttggatgatttcggtggatctaaggccagaatcgtggaacctaagttcagatttagcttagctgagctcttagacgagagcaaagtggtgccgatctcagtttacggcgacttagacgtcgagatcaccggaatccagcacgattctcgaggcgtaagcgccggagatctcttcgtgtgctgcgagaatgatggagactccgtcttgagcgaagctgacaagagaggagcagtggcggttgtagctagcaaggagatcgatattgaagatacgttaggttgtagagcacttgtcatcgttgaagatactgaagcagtcttagcagctttagcttcttccttttatagacatccgtccaagaacatggcggtgattggagtcacgggcacaaacgggaagacgaccaccacgtatttgatcaaaagcctctatgaagctatgggtgtgcgaacaggaatgttcagcactgtttcttgttatgtccatggagataacaagttggattcgccgactacgactagtcctgatgctgttttggttcagagtatgatggcgaagatgttgcataatggaaccgaagctcttgttatggaagcttctcctcaggagcttgcttctgggaaatgtgatgaagtggatttcgacattgcggttttcacaaacttggctagagaggagagcggttttcgcggtactgatgaagagtatagagacgctgaagccaagttgtttgcaagaatggttgacccggaaaggcacaggaaagtggttaacattgacgatccaaacgcagcgtttttcgtccagcaagggaaccctgaagttccggttgtgacatttgcaatggagaacaccaaagctgatgttcacccgttgaagtttgagctctctttgtttgagacacaggttttggttaatacccctcaagggattttggagatttcgtctggtttgttaggacggcataacatttataacattcttgctgctgttgctgttgggattgctgttggagctcctcttgaggatattgttagaggtgttgaggaagttgatgcagtcccggggaggtgtgagttgattgatgaggaacaagcttttggtgttattgtggatcatgctaacacacctgatggcttgtcaaggctgcttgattcagttcgagagcttaaaccaagaagaatcattactgttattggttgcgcgggtgagactgagagagggaaaagaccggttatgacgaaaattgctactgaaaagagtgatgtgacaatgttgacatctgataatccagggaatgaagatccattggacatattggatgacatgttggctgggattggatggacgatgcaagagtatttgaaacacggtgaacatgattattatcctcctttggcaaatgggcatagactctttcttcacgatgttagacgtgtagctgtgcgttgtgctgttgcaatgggtgaagaaggtgacatggttgtggtagcagggaaaggccatgaagcgtatcagctagaaggcgataagaaagagttctatgatgatcgagaggaatgtcgggaagcattacaatacgttgatgagctacatcaagctggaatagacacaagcgagttcccatggaggttaccagagagtcattaatatctctgtggtgagatcattaaaccatgaatcagatttacttccaccgccaagatagatttgcagagacctcatgatttctatacgagagacttggaggtgtctaacaacccttgtgagtcatcagataagtgcaggggagatgagagattttaaaggtggaagaagatgtgtacaaatttttgttagtggttgttgcgtttgtctatgcgttgatggtttaagagagggcaggtgtttttttataataaaccttcattggctcgaaa

SEQ ID NO: 1421 - DNA, 824 bp, Arabidopsis lyrata
aacataaactcgtctccggtaaccaaaatggtttccatgactacttcttcttcttcatacgcaccattctctacagtcttcaacagttccagacctaattcatctgcaacctttctcgtcccttccttcaaattctccaccggaatatcgaatttcgcgaatctgagtaatgggttttctctaaaatctccaattaatcctgggtttctcttcaagtcccgtcctttcactgttcaagctagagctgctgcagaaaagaccgttcacgacttcaccgttaaggacattgatgggaaagatgttgctttgaacaaattcaaggggaaagttatgttgattgtcaatgttgcttcaagatgtggtttgacatcatcaaattactcagagctttcacatctgtacgagaaatacaaaagccaaggatttgagattctagcttttccctgcaatcagtttggtttccaagagcccgggtcaaactcggagatcaaacaattcgcttgcactcggtttaaagcagagttccctatatttgataaggttgacgtaaatggaccaagcacagcgcccatctacgaattcttgaaatcaaacgcaggaggattcttgggtggtctcattaaatggaactttgagaagtttttgattgataaaaagggaaaggtcgttgagaggtaccctcccaccacatcccctttccaaatcgagaaagacatccagaagttgcttgccgcttaaaaacttttgctcatgagagcatatagagactgatggtaaaaataaccggaaattgtgacatatagtttccggtgattgcttgtata

SEQ ID NO: 1422 - DNA, 862 bp, Arabidopsis lyrata
tctctccggtctcactattgaaccgaacgctggtcgaaaacataaactcgtctccggtaaccaaaatggtttccatgactacttcttcttcttcatacgcaccattctctacagtcttcaacagttccagacctaattcatctgcaacctttctcgtcccttccttcaaattctccaccggaatatcgaatttcgcgaatctgagtaatgggttttctctaaaatctccaattaatcctgggtttctcttcaagtcccgtcctttcactgttcaagctagagctgctgcagaaaagaccgttcacgacttcaccgttaaggacattgatgggaaagatgttgctttgaacaaattcaaggggaaagttatgttgattgtcaatgttgcttcaagatgtggtttgacatcatcaaattactcagagctttcacatctgtacgagaaatacaaaagccaaggatttgagattctagcttttccctgcaatcagtttggtttccaagagcccgggtcaaactcggagatcaaacaattcgcttgcactcggtttaaagcagagttccctatatttgataaggttgacgtaaatggaccaagcacagcgcccatctacgaattcttgaaatcaaacgcaggaggattcttgggtggtctcattaaatggaactttgagaagtttttgattgataaaaagggaaaggtcgttgagaggtaccctcccaccacatcccctttccaaatcgagaaagacatccagaagttgcttgccgcttaaaaacttttgctcatgagagcatatagagactgatggtaaaaataaccggaaattgtgacatatagtttccggtgattgcttgtata

SEQ ID NO: 1423 - DNA, 842 bp, Eutrema parvulum
cttgtctaaagcagaagaagataaactcgtctcttgtaaccaaaaatggcttctacttcttcttacgcaccattctctgctatcttcaacggttccagacctaacccatctgtaaaacccgcggctttcctcgcctcttccttgaaattctccaccgtcatatcgaatttcgcaaatctgagtaatgggttctctctgaaatctccgattaatcctgggtatctcttcaagtcgcggtatttcaatgtccaagctagagctgctgcagagaagaccgttcacgatttcactgtaaaggacattgatgggaatgatgtttctttgaacaagtttaaggggaaagttatgttgatcgtcaatgtcgcttcaagatgtggcttgacatcatcaaattactcagagctctcacatctgtacgagaaatacaagagccaaggatttgagattctagcttttccctgcaatcaatttggtggccaagagcccggttctaaccctgagatcaaacaattcgcttgcacccggtttaaagcagagttccctatatttgataaggtcgatgtgaatggaccgagtacagctccgatctacgagttcttgaaatcaaacgcaggaggattcttgggtggactcatcaaatggaactttgagaagttcttgattgataaaaagggaaaagtcgttgagaggtaccctcccaccacttcccctttccaaatcgagaaagacatcaagaagttgcttgctgcttagtaactttcgttcatgagagagcacacagagactgagtgtgaaataaccggtaaatgaaactcaattttgctggttatggtttgtctaca

SEQ ID NO: 1424 - DNA, 966 bp, Eutrema halophilum
tataaaatgctctcgacctttagcactcaaagtttaacttgcgttgacactagtgtctagtcgaaagtacaagaagataaactcgtctcagtttcactaggaaccaaaaatggcttcttcttcttcttacgcaccattctctgctatcttcaacggttccagacctaacccatctgtaaaacccgcggctttcctcgcgtcttccttgaaattctccaccgtcatatcgaatttcgcaaatctgagtaatgggttctctctgaaatctccgattaatcttgggtatctcttcaagtcgcggtatttcaatgtccaagctagagctgctgcagagaagaccgttcacgatttcactgtaaaggacattgatgggaatgatgtttctttgaacaagtttaaggggaaagttatgttgatcgtcaatgtcgcttcaagatgtggcttgacatcatcaaattactcagagctctcacatctgtacgagaaatacaagagccaaggatttgagattctagcttttccctgcaatcaatttggtggccaagagcccggttctaaccctgagatcaaacaattcgcttgcacccggtttaaagcagagttccctatatttgataaggtcgatgtgaatggaccgagtacagctccgatctacgagttcttgaaatcaaacgcaggaggattcttgggtggactcatcaaatggaactttgagaagttcttgattgataaaaagggaaaagtcgttgagaggtaccctcccaccacttcccctttccaaatcgagaaagacatcaagaagttgcttgctgcttaataacttttgcttcatgagagtacacagaaactaaccggtatttgaatcttaatgttaccggtcatggtttgtatacattgtaccgataatggttatgttatatattttttcataatgtaaattattatatatattatcacaatagacaa

SEQ ID NO: 1425 - DNA, 935 bp, Eutrema halophilum
gtttaacttgcgttgacactagtgtctagtcgaaagtacaagaagataaactcgtctcagtttcactaggaaccaaaaatggcttcttcttcttcttacgcaccattctctgctatcttcaacggttccagacctaacccatctgtaaaacccgcggctttcctcgcgtcttccttgaaattctccaccgtcatatcgaatttcgcaaatctgagtaatgggttctctctgaaatctccgattaatcttgggtatctcttcaagtcgcggtatttcaatgtccaagctagagctgctgcagagaagaccgttcacgatttcactgtaaaggacattgatgggaatgatgtttctttgaacaagtttaaggggaaagttatgttgatcgtcaatgtcgcttcaagatgtggcttgacatcatcaaattactcagagctctcacatctgtacgagaaatacaagagccaaggatttgagattctagcttttccctgcaatcaatttggtggccaagagcccggttctaaccctgagatcaaacaattcgcttgcacccggtttaaagcagagttccctatatttgataaggtcgatgtgaatggaccgagtacagctccgatctacgagttcttgaaatcaaacgcaggaggattcttgggtggactcatcaaatggaactttgagaagttcttgattgataaaaagggaaaagtcgttgagaggtaccctcccaccacttcccctttccaaatcgagaaagacatcaagaagttgcttgctgcttaataacttttgcttcatgagagtacacagaaactaaccggtatttgaatcttaatgttaccggtcatggtttgtatacattgtaccgataatggttatgttatatattttttcataatgtaaattattatatatattatcacaatagacaa

SEQ ID NO: 1426 - DNA, 901 bp, Eutrema parvulum
taaattgctctccactatcatcatcacctctctcagtttcactaagaacgtttaacgcttgtctaaagcagaagaagataaactcgtctcttgtaaccaaaaatggcttctacttcttcctacgcaccattctctgcagtcttcaacggttcaaaacctaatccatctcttaatcctgcggcttttctcgtcccttccttgaaattctccaccgtcatatcgaattttgcaaatctgagtaatgggttttcccttaaatctccgattaatcctgggtttctcttcaagtcccgaaatttcaatgttcaagctagagctgctgcagagaagaccgttcacgatttcactgtaaaggacattgatgggaatgatgtttctttgaacaaatttaaggggaaagttatgttgatcgtcaatgtcgcttcaagatgtggtttgacatcatcaaattactcagagctttcacatttgtacgagaaatacaagagccaaggatttgagattctagcttttccgtgcaaccagtttggtggccaagagcccggttcaaaccccgagatcaaacagtttgcttgcacccgatttaaagcagagttccctatatttgataaggtcgatgtgaatggaccaagcacagcaccgatctaccaattcttgaaatcaaacgcaggaggattcttgggtgatctcgttaaatggaactttgagaagttcttgattgataaaaaaggaaaggtcgttgagaggtaccctcccaccacatcccctttccaaatcgagaaagacatcaagaagttgcttgctgcttagtaactttcgttcatgagagagcacacagagactgagtgtgaaataaccggtaaatgaaactcaattttgctggttatggtttgtctacatt

SEQ ID NO: 1427 - DNA, 936 bp, Brassica juncea
ctatcatcaaatcagccctcagtttcaccaacgctagacgaaagcagaagaggataaactcttctcctgtaaccaaaaaatggctttttcgtcttcttattactcaccattctctgcactcttcgacgtttccaaacccaatccatctctaaaccccgcggcttttctcgtcccttccttgaaattctccaccgccatatcgaatttcgcgaatctgagtaatgggttctctctaaaatctccgattaatcctgggtttctcttcaagtcccgagctttcaatgttcaagctcgagctgctgctgagaagaccgttcacgatttcaccgtaaaggacattgatgggaatgatgtttctttgaacaagtataaggggaaagttatgttgatcgtcaatgtcgcttcaagatgtggtttgacatcatcaaattactcagagctttcacatctgtatgagaaatacaagagccaaggatttgagattctagctttcccttgtaatcagtttggtggccaagagcccggttcaaaccctgagatcaaacagtttgcttgcacccggtttaaagcagagttccctatatttgataaggtcgatgtgaatggaccgagcacagcaccaatctatcagttcttgaaatcaaacgcaggaggattcttgggtgatctcattaaatggaactttgagaagttcttgattgataaaaagggaaaggtcgttgagaggtaccctcccaccacatcccctttccaaatcgagaaggacatcaagaagttgcttgctgcttaataacctctgcgatgagagaccacacagactgattgtaaaatattcagtacttgaaactcggttttgctggttatggtttgtatacattgtaacgatatatattttattacaatgctaagtatgaccagcaaaaccgagtttcaagt

SEQ ID NO: 1428 - DNA, 1073 bp, Brassica rapa
ggggttagtataaactcttgactatcatcagccctcagtttcaccaacgctagacgaaagcagaagaggataaactcttctcctgtaaccaaaaaatggcttcttcgtcttcttattactctccattctctgcactcttcgacgtttccaaacccaatccatctctaaaccccgcggctttcctcgtcccttccttgaaattctccaccgccatctcgaatttcgcgaatgggttttcgctaaagtctccgattaatcctgggtttctcttcaagtcccgaactttcaatgttcaagctcgagctgctgctgagaagaccgttcacgatttcaccgtaaaggacattgatgggaatgatgtttctttgaacaagtataaggggaaagttatgctgatcgtcaatgtcgcttcaagatgtggtttgacatcatcaaattactctgagctttcacatctgtatgagaaatacaagagccaaggatttgagattctagctttcccttgtaatcagttcggtggccaagagcccggttcaaaccctgagatcaaacagtttgcttgcacccggtttaaagcagagttccctatatttgataaggtcgatgtgaatggaccgagcacagcaccaatctatcagttcttgaaatcaaacgcaggaggattcttgggtgatctcattaaatggaactttgagaagttcttgattgataaaaagggaaaggtcgttgagaggtaccctcccaccacatcccctttccaaatcgagaaggacatcaagaagttgcttgctgcttaataacctctgcgatgagagaccacacagactgattgtaaattattcagtacttgaaactcggttttgctggttatggtttgtatacattgtaacgatatatattttattacaatgctaagtatgattataagttttcaaagttgatatatttataggacagtgagcataatacacataacaaaaactgtagtaagataactacatattatgtgactaaatgatgaattattttttatatactaattgagaaatattacaacttttaaatgatcctct

SEQ ID NO: 1429 - DNA, 877 bp, Brassica napus
gaacgctagacgaaagcagaagaggataaactcttctcctgtaaccaaaaaatggctttttcgtcttcttattactcaccattctctgcactcttcgacgtttccaaacccaatccatctctaaaccccgcggcttttctcgtcccttccttgaaattctccaccgccatatcgaatttcgcgaatgggttttcgctaaagtctccgattaatcctgggtttctcttcaagtcccgaactttcaatgttcaagctcgagctgctgctgagaagaccgttcacgatttcaccgtaaaggacattgatgggaatgatgtttctttgaacaagtataaggggaaagttatgctgatcgtcaatgtcgcttcaagatgtggtttgacatcatcaaattactcagagctttcacatctgtatgagaaatacaagagccaaggatttgagattctagctttcccttgtaatcagtttggtggccaagagcccggttcaaaccctgagatcaaacagtttgcttgcacccggtttaaagcagagttccctatatttgataaggtcgatgtgaatggaccgagcacagcaccaatctatcagttcttgaaatcaaacgcaggaggattcttgggtgatctcattaaatggaactttgagaagttcttgattgataaaaagggaaaggtcgttgagaggtaccctcccaccacatcccctttccaaatcgagaaggacatcaagaagttgcttgctgcttaataacctctgcgatgagagaccacacagactgattgtaaaatattcagtacttgaaactcggttttgctggttatggtttgtatacattgtaacgatatatattttattacaatgctaagtatga

SEQ ID NO: 1430 - DNA, 914 bp, Brassica oleracea
gagtttcgccacactaacgctggtcgaaagcggaagaggataaactcttctcctgtaaccaaaaaaatggcttcttcgtcttcttattacacaccattctctgcactcttcgccgtttccaaacccaatccatctctaaaccccgcggctttcctcgtcccttccttgaaattctccaccgccatatcgaatttcgcgaatctgagtaatgggttctctctaaaatctccggttaatcatgggtttctcttcaagtcccgaactttcaatgttcaagctcgagctgctgctgagaagaccgttcacgaattcaccgtaaaggacattgatggtaatgatgtttctttgaacaagtataaggggaaagttatgttgatcgtcaatgtcgcttcaagatgtggtttgacatcatcaaattactcagagctttcacatctgtatgagaaatacaagagccaaggatttgagattctagctttcccctgcaatcagttcggtggccaagagcccggttcaaaccctgagatcaaacagtttgcttgcacccggtttaaagcagagttccctatatttgataaggtcgatgtgaatggaccgagcacagcaccaatctaccagttcttgaaatcaaacgcaggaggattcttgggtgatctcattaaatggaactttgagaagttcttgattgataaaaagggaaaggtcgttgaaaggtaccctcccaccacatcccctttccaaatcgagaaggacatcaagaagttgcttgctgcttaataacctctgctcatgagagaccacacagactgattgtaaaatattcagtacttgaaactcggttttgctggttatggtttgtatacattgtaacgagatatattttattacaatactaagtatgacaataagttttc

SEQ ID NO: 1431 - DNA, 922 bp, Raphanus sativus
gggagtttcaccacacttaacgctagtccaaatcagaagaggataaactcttctcctgtaaccaaaaaaatggctacttcgtcttctcactcaccattctctgcaatcttcaacgtctccaaacccaatccatctgtaaaccctgcggcttttctcgtcccttccttgaaattctccaccgccatatcgaatttcgcgaatctgagcaatgggttttctctaaaatctccgattaatcctgggtttctcttcaagtcccgaactttcaacgttcaagccagagctgctgctgagaagaccgttcacgatttcactgtaaaggacattgatgggagtgatgtttctttgaacaagtataaggggaaagttatgttgatcgtcaatgtcgcttcaagatgtggtttgacatcatcaaattactccgagctttcacatctgtacgagaaatacaagagccaaggacttgagattttagctttcccttgcaatcagtttggtggccaagagcccggttcaaacactgagatcaaacagtttgcttgcacccggtttaaagcagagttccctatatttgataaggtcgatgtgaatggaccgagcacagcaccaatctaccagttcttgaaatcaaacgcaggaggattcttgggtgatctcattaaatggaactttgagaagttcttgattgataaaaagggaaaggttgttgagaggtaccctcccaccacatcccctttccaaatcgagaaggacatcaagaagttgcttgctgattagtaacctctgctcatgagagaccacacagactggttgtaaaatattcagtacttgaaagttgaaactcggttttgccagttatggtttgtatacaatgtaatgatatatattttattataatactaagtacgataataagtttcga

SEQ ID NO: 1432 - DNA, 1162 bp, Brassica napus
atactataaactgctctcgacaatcaccagctctcagtttcgccacactaacgctggtcgaaagcggaagaggataaactcttctcctgtaaccaaaaaaatggcttcttcgtcttcttattacacaccattatctgcactcttcgacgtttccaaacccaatccatctctaaaccccgcggctttcctcgtcccttccttgaaattctccaccgccatatcgaatttcgcgaatctgagtaatgggttctctctaaaatctccggttaatcatgggtttctcttcaagtcccgaactttcaatgttcaagctcgagctgctgctgagaagaccgttcacgaattcaccgtaaaggacattgatggtaatgatgtttctttgaacaagtataaggggaaagttatgttgatcgtcaatgtcgcttcaagatgtggtttgacatcatcaaattactcagagctttcacatctgtatgagaaatacaagagccaaggatttgagattctagctttcccctgcaatcagttcggtggccaagagcccggttcaaaccctgagatcaaacagtttgcttgcacccggtttaaagcagagttccctatatttgataaggtcgatgtgaatggaccgagcacagcaccaatctaccagttcttgaaatcaaacgcaggaggattcttgggtgatctcattaaatggaactttgagaagttcttgattgataaaaagggaaaggtcgttgaaaggtaccctcccaccacatcccctttccaaatcgagaaggacatcaagaagttgcttgctgcttaataacctctgctcatgagagaccacacagactgattgtaaaatattcagtacttgaaactcggttttgctggttatggtttgtatacattgtaacgatatatattttattacaatgctaagtatgataataagttttcaaaattgatatatttataggacagtaagcataatacacataacaaaaactgtagtaagataactacatatgatgtgactaaatgctgaattattcttatatactattgtgaaacgttacaatttttaaatgatactatgtggcattatcaaaatgattcgtaaatgatgtgtccatctaaatgtttactatatttttcataaacttatcacaaa

SEQ ID NO: 1433 - DNA, 855 bp, Arabidopsis lyrata
cataattcatatatacataacaaacagtcttttcattattttcatttatttctctgttcaatctcacaggcgctacaccataacgcgatattactaatgacgaactacggtgcgattccgacgtcgtctcatgcatctccggtggtggatcttgagtctctctcacgcgccaagcaccgtatcaaagccggactagccacgcgccgtccttggagagtgatgttcgattttcactccatgggactacctcacagcgtctccgatgctttcacaagaatcaagaccaatcttgcttacttccgtatgaactacgcaatcgttgtcttgatcgttatcttcttcagcttgatctggcatccgacatcgctcatcgttttcaccgtcttggtcgctgtttggatctttctttattttctccgtgatgagcctatcaagctgttccgatatcagatcgatgatcggacggtcttaattgttttatcggtgttaaccgtcgttctacttttgttgaccaacgcgacgtttaatattgttggagcgcttgtgaccggagctgtgttggttttgatccatgcggtggttaggaagacagaggatcttttcttggatgaagaagcggcgacgactgagacttctgggctgacgtcatacccgtcgacttaaatggattgatctcgaactttgttttttttttttttttttgtatattatctttgttttttttaataatcatttttatgtgtaatcaatttttattggtgtgagtttggtttgagactcattctctcttttgtttttgagctttgagttactgtctgaagtttgaacaattctaaattgttacaatttttatta

SEQ ID NO: 1434 - DNA, 1060 bp, Arabidopsis lyrata
aaaacacgatctaattaaattttgttttatttcataaacatagattagtttagaaaacgccatatgaaaatgtgtatcacctaattctctggacctttcataattcatatatacataacaaacagtcttttcattattttcatttatttctctgttcaatctcacaggcgctacaccataacgcgatattactaatgacgaactacggtgcgattccgacgtcgtctcatgcatctccggtggtggatcttgagtctctctcacgcgccaagcaccgtatcaaagccggactagccacgcgccgtccttggagagtgatgttcgattttcactccatgggactacctcacagcgtctccgatgctttcacaagaatcaagaccaatcttgcttacttccgtatgaactacgcaatcgttgtcttgatcgttatcttcttcagcttgatctggcatccgacatcgctcatcgttttcaccgtcttggtcgctgtttggatctttctttattttctccgtgatgagcctatcaagctgttccgatatcagatcgatgatcggacggtcttaattgttttatcggtgttaaccgtcgttctacttttgttgaccaacgcgacgtttaatattgttggagcgcttgtgaccggagctgtgttggttttgatccatgcggtggttaggaagacagaggatcttttcttggatgaagaagcggcgacgactgagacttctgggctgacgtcatacccgtcgacttaaatggattgatctcgaactttgttttttttttttttttttgtatattatctttgttttttttaataatcatttttatgtgtaatcaatttttattggtgtgagtttggtttgagactcattctctcttttgtttttgagctttgagttactgtctgaagtttgaacaattctaaattgttacaatttttattactccctctgtccataaaagataaattttttaggaaaaatatttgtcttacaaagatagaaattttatatttgcaatgcaaattttaaaattgttttcccgttttacc

SEQ ID NO: 1435 - DNA, 2131 bp, Arabidopsis lyrata
tcagacattgaccaaactgatacaatttctaacgctacaatatttttttataacatcaccctacattattgtaatagtatcacaaattttctacatcatccaatttattttgttttattccatatgcaaatgtgtatcacagccaaaactataaatcaggacagttttacattatttctatctagtcctctgactaaataatgacgaacaacaacgcgattccgacgtcgtcatctccggcagtgaatcacgagtctatctcacgcgccaagcaacatatcaaagacggactagccacgcgccgcccctggagggtgatattcgatgtccactccatgggactacctcacaacgtctccgatgctttcacaagaaccaagacgaatcttgcttacttccggagtaattacgcaatcgtagtcttgaacgtcatcttcttcagcttgatttggcatccgacatcgctcatcgtcttcgcaggcttggttttcctatggatcttcctttacttcctccgtgacgagcctctcaaagtgttccgatttcagatcgacgatcgtgcggtcctgattggtttatcggttataaccatcgttcttctcctgttgaccaacgcgacgtttaatattgttgcggcgttggtggccggagctgtgttggttctgatccatgcggtggttaggaagacggaggatcttttcttggatgaagaggcagcgacgactgaaacgtcaggactgacgtcacacccttcgtcttaaaacaatcgatctcgaattttatgtatattatattgtttttgataatcttgtgtaataatttatagtgtaagtttggttctttttgagttttgaagtttgaacaagcttaataatgaatgttaaagtcttcgccttttttttggcgggctgcttacttttataactttttgtcgacttattgggccattcattaaggcccaataaactcagcccataaaattcgaaaaggaaagtgtttaaacagtgcgtcacactaccatttacacgtcagctctcttcgccggcgtctattgcaaccgtcaacctcgccgccggccagagaaaaaaatggcgtatcaccaaccgtacgatcctttctacgtctatcaacctcattatcatccacatcatcttccgccgcagctgccacagttcgccgacgaacctggggcgataaacactctctttgtctctggtttgcctaacgatgttaaagctcgtgagatccacaatctcttccgtcgccgttatggattcgaatcttgtcagctcaagtacactggacgcggcgaccaggttgtggcatttgcaacattcacgagtcatagattcgctatggctgcaatgaatgagctaaatggtgtgaaatttgatcctcagacaggatcaactctacatatagaactagctagatcaaactctagaagaaaagaaaggccaggaagtgggccttatgttgtgattgataacagaaacaaagaactgtctaagtctcaggatgaccagagtgatgaaggggatagcgatccggatgaggtgcaggaacctcgaaatagcgagtctccaaaggaaaatgataatgccaaaagcgaagcggattctgagccagatagtaaagcaccatctgctaatgggcacttagagaaagcatatgaaggaggttctggtgctcgagcttgttcgaccttgtttatagctaatctagggcctaattgtacagaagatgaacttagacaactcctatctagatattctggtttcaacatcttaaaaatccgagctagaggcggaatgccggttgcatttgctgattttgaggaaatcgagcaagctactgatgccatgaatgaacttcaagggaacctcttatcctcttcagaccgaggcggcatgcatatagaatatgcaagatcaaagatgaggaaacagtaaggattaatgtaccacatgccaatggtattctcttctgaaaacgaaatatatagagatcataagcaaatgaaagctgtatttctttattttaaatctccacttactatttgttgtcatgaagatggatcttctatgctgacactgacttaagaaatacgtgttaatatttttattcaaga

SEQ ID NO: 1436 - DNA, 2193 bp, Arabidopsis lyrata
tcgatttgatcagacattgaccaaactgatacaatttctaacgctacaatatttttttataacatcaccctacattattgtaatagtatcacaaattttctacatcatccaatttattttgttttattccatatgcaaatgtgtatcacctaaaaattcaagagaccttcatttactctatatacagagccaaaactataaatcaggacagttttacattatttctatctagtcctctgactaaataatgacgaacaacaacgcgattccgacgtcgtcatctccggcagtgaatcacgagtctatctcacgcgccaagcaacatatcaaagacggactagccacgcgccgcccctggagggtgatattcgatgtccactccatgggactacctcacaacgtctccgatgctttcacaagaaccaagacgaatcttgcttacttccggagtaattacgcaatcgtagtcttgaacgtcatcttcttcagcttgatttggcatccgacatcgctcatcgtcttcgcaggcttggttttcctatggatcttcctttacttcctccgtgacgagcctctcaaagtgttccgatttcagatcgacgatcgtgcggtcctgattggtttatcggttataaccatcgttcttctcctgttgaccaacgcgacgtttaatattgttgcggcgttggtggccggagctgtgttggttctgatccatgcggtggttaggaagacggaggatcttttcttggatgaagaggcagcgacgactgaaacgtcaggactgacgtcacacccttcgtcttaaaacaatcgatctcgaattttatgtatattatattgtttttgataatcttgtgtaataatttatagtgtaagtttggttttgatcaattgatccctttttgagttttgaagtttgaacaagcttaataatgaatgttaaagtcttcgccttttttttggcgggctgcttacttttataactttttgtcgacttattgggccattcattaaggcccaataaactcagcccataaaattcgaaaaggaaagtgtttaaacagtgcgtcacactaccatttacacgtcagctctcttcgccggcgtctattgcaaccgtcaacctcgccgccggccagagaaaaaaatggcgtatcaccaaccgtacgatcctttctacgtctatcaacctcattatcatccacatcatcttccgccgcagctgccacagttcgccgacgaacctggggcgataaacactctctttgtctctggtttgcctaacgatgttaaagctcgtgagatccacaatctcttccgtcgccgttatggattcgaatcttgtcagctcaagtacactggacgcggcgaccaggttgtggcatttgcaacattcacgagtcatagattcgctatggctgcaatgaatgagctaaatggtgtgaaatttgatcctcagacaggatcaactctacatatagaactagctagatcaaactctagaagaaaagaaaggccaggaagtgggccttatgttgtgattgataacagaaacaaagaactgtctaagtctcaggatgaccagagtgatgaaggggatagcgatccggatgaggtgcaggaacctcgaaatagcgagtctccaaaggaaaatgataatgccaaaagcgaagcggattctgagccagatagtaaagcaccatctgctaatgggcacttagagaaagcatatgaaggaggttctggtgctcgagcttgttcgaccttgtttatagctaatctagggcctaattgtacagaagatgaacttagacaactcctatctagatattctggtttcaacatcttaaaaatccgagctagaggcggaatgccggttgcatttgctgattttgaggaaatcgagcaagctactgatgccatgaatgaacttcaagggaacctcttatcctcttcagaccgaggcggcatgcatatagaatatgcaagatcaaagatgaggaaacagtaaggattaatgtaccacatgccaatggtattctcttctgaaaacgaaatatatagagatcataagcaaatgaaagctgtatttctttattttaaatctccacttactatttgttgtcatgaagatggatcttctatgctgacactgacttaagaaatacgtgttaatatttttattcaaga

SEQ ID NO: 1437 - DNA, 928 bp, Eutrema parvulum
aaaggacctccatataacagtagtgcccagttttataaagtctttcattattttccattttagtcctctattcaaatctcacaccgagacaataacaacaataagagtaaataataaataatgacgaactacggcgcgattccgacgtcgtctcacgcttctccggtggtggatctcgagtccatctcacgcgccaagcaacgtatcaaagccggactctccacgcgccgcgcatggagagtgatgttcgattttcactccatggggctccctcgcggcgtctccgacgctttctcaacgatcaagaagaacctcggctatttccagacgaactacgcgatcgtcgtcttgatcgtgatcttcttaagtcttatcaagcatccgacgtcgctcatcgtcttgaccgtacttgttttcgtctggatcttcctctacttcctccgcgacgagcccatcaaggtgtttcgttaccagatcgacgatcagacggtcttgatttgtttatcggtgatatccatcgttctgctgttcttgaccaacgcgacactcaacatcgccggggcgttgttggtcggagctgtgctggtgttgatccatgcggtggttaggaagacggaggatctcttcttggatgaagaggcggcaacgactgagactcttgtgggatgacgtcatcataaccgtcgtcttgaatcgattgattgatctcgaacttttatgtatattgtatttttttaaaaatcattttatgtgtaataatttaaagttgtgatggtgtgagtttggtttgagactctctccctcttttgtgttttgagttttgtttcgggtgacgcacgttacgagtttgaagtttgaaccattcaaaattgttacaaactttttttgttagtataatccaaggttcaggaattgtttcgtgtgatta

SEQ ID NO: 1438 - DNA, 2294 bp, Arabidopsis thaliana
aactcgatcgactttcagacattgaccaaattgaatcagatcataacgctacatccttttatatatatataacatcacgctacattattgtaataatatcacaaaatttctacggaaaaaaactcggtctaatgttttaacacaccatctaatttatttggttttattccatatgcaaattcaagagaccttcttcatatattatacacagagagataaaacaataaatcagaacagttttacattatttcaatcaagtcatcttattcactaatggcgaacaacgacgagattaccacgtcgtctcatgcatctccggcagtgaatcacgagtctatctcacgcgctaagcaacgtatcaaagacggactagccacgcgccgctcctggagggtgatgttcgatttacactccacgggactacctcacggcgtctccgatgttttctcaagaatcaagacaaatcttgcttacttccgtagtaattacgcaatcgtaatcttgaacgtcatattcttcagcttgatttggcatccgacctcgctcatcgtctttaccggtttggttttcctatggatcttcctttattttctccgtgatgtgcctctcaaggtgttcaggtttcaaatcgacgatcgtgcggtcttgattggtctatcggtgattaccatcgttctacttctattgaccaacgcgacgtttaatattgttgcggcgttgatggccggagctgtgttggttctgatccatgcggtgattaggaagacggatgatctttttttggatgaagaagcggcgacgactgagacttcaggactgacgtcacacccttcgtcttaaaacgattgatctccatttttatgtatattctattgtttttgatcatcttatgtgtaattatagtttatggtgtaaccgtgtaagtttggtttgattctctctctgtttttaagttttgaagtatgaacaaacttaataatgtcaaagtcttcgcttcttgtttttggcgggctgcttacttttatcactttttggcgccttattgggccattcattaaggcccaatagtatcagcccataaaattcaaaaaggaacatatttttacatttaaacagtgtgtctcacacttccatttacacgtcagctctcttcgccggcgcttaatacaaccgtcaacctcgccgccggctagaggaaaatggcgtatcaccaaccgtacgatcctttctacgtctatcaacttcattctcatcctcatcatcttccgccgcagctgccactgctcgccgacgaacctggggcgattaacactctctttgtctctggcttgcctaatgacgttaaggctcgtgagatccacaatctcttccgtcgtcgtcatggattcgaatcttgtcagctcaagtacactggacgcggtgaccaggttgtggcatttgcaacattcacgagtcatagattcgccttggctgcaatgaatgagctaaatggtgtgaaatttgatcctcaaacaggatcaaatctacatatagaactagctagatcaaactctagaagaaaagaaaggccaggaagtggaccttatgttgtgattgataacagaaacaaggaaatttctaagtctcaggatgaccagagtgatgaaggggatagcgatccagatgaggtgcaggaacctggaaatagcgattctccaaaggaaaacgatactaccaaaagcgaagcggattctgagccagatagtaaagcaccatctgctaatgggcacttagagaaagcatctgaaggaggttctggtgctcgagcttgttcgaccttgtttatagctaatctagggcctaattgtacagaagatgaactcaaacaactcctatctagatatcctggtttccacattttaaaaatccgagctagaggcggaatgccggttgcatttgctgattttgaggaaatcgagcaagctactgatgccatgaatcatcttcaagggaacctcttatcctcttcagaccgaggcggcatgcatatagaatatgcaagatcaaagatgaggaaacagtaaaagattatcataaccacaaagcctcacttctcaaatgaagaatgtggtggataatgtaccatatgccaatggtagtctcttatgaaaacaagatatatagagatcataagcaaatgaaagctgtatttcttattttaaatcttcacttactatttgttgtcatgaagatgaatccttctatgctgacactgacttaagagatacatatgaatatatttattcaagatttac

SEQ ID NO: 1439 - DNA, 1010 bp, Arabidopsis thaliana
aactcgatcgactttcagacattgaccaaattgaatcagatcataacgctacatccttttatatatatataacatcacgctacattattgtaataatatcacaaaatttctacggaaaaaaactcggtctaatgttttaacacaccatctaatttatttggttttattccatatgcaaattcaagagaccttcttcatatattatacacagagagataaaacaataaatcagaacagttttacattatttcaatcaagtcatcttattcactaatggcgaacaacgacgagattaccacgtcgtctcatgcatctccggcagtgaatcacgagtctatctcacgcgctaagcaacgtatcaaagacggactagccacgcgccgctcctggagggtgatgttcgatttacactccacgggactacctcacggcgtctccgatgttttctcaagaatcaagacaaatcttgcttacttccgtagtaattacgcaatcgtaatcttgaacgtcatattcttcagcttgatttggcatccgacctcgctcatcgtctttaccggtttggttttcctatggatcttcctttattttctccgtgatgtgcctctcaaggtgttcaggtttcaaatcgacgatcgtgcggtcttgattggtctatcggtgattaccatcgttctacttctattgaccaacgcgacgtttaatattgttgcggcgttgatggccggagctgtgttggttctgatccatgcggtgattaggaagacggatgatctttttttggatgaagaagcggcgacgactgagacttcaggactgacgtcacacccttcgtcttaaaacgattgatctccatttttatgtatattctattgtttttgatcatcttatgtgtaattatagtttatggtgtaaccgtgtaagtttggtttgattctctctctgtttttaagttttgaagtatgaacaaacttaataatgtcaaagtcttcgcttcttgtttttggcgg

SEQ ID NO: 1440 - DNA, 1699 bp, Arabidopsis lyrata
tctctatcttctttaagttgtttactttgttcttcgatttgatcaccaactctcacatatttcgaaatcccaacactttgttgcgtgttatcttctccctctctctctcttataatccttgagtttcacgtctcaaccagattgatctctgtaatcatggcttccatgagtttcgccttgaatcgcttctctggactctcatctaaaaccaccttatcagctgacttcgatccatcaactcgccgaagttttctaccgccgactagagttggacttaagatttcttccgccaccgaatcggagcctgatctcagcgtcactgtaaatggcctgaaaatgcccaatcctttcgtgatcgggtcgggtccaccgggtaccaactacaccgtcatgaagagagcttttgacgaaggttggggagccgtcatcgccaaaaccgtatcattagatgcagccaaagttatcaacgtgacacctcgatatgctcggctacgaactggttccaatggctcagccaaaacagatgtaattgggtggcagaacatagaactcatcagtgaccgacctcttgaaaccatgctcaaagagtttgagcgattgaaaaaagagtatcctgatcggattctgattgcttccatcatggaggaatataacaaaactgcttgggaagagcttattgaccgtgttgagcaaactggggttgatgctttagaaatcaacttctcgtgtcctcatggtatgccagagcgcagaatgggtgccgctgttggacaagattgtgtgcttctcgacgaggtttgcggatggattaatgctaaagctacagttcctgtgtgggctaagatgactcctaatatcactgacataacagagcctgctagggtatctctaaaatcaggatgtgaaggaatttcagctatcaatacaatcatgagtgtaatgggagttgatatgaagacgctgcgtcctgagccatgcgttgaaggttattcaactccaggaggctactcttataaggccgttcgcccaattgcgcttgcaaaagttatgaacattgccaaaatgatgaaatctgagttcagtgaaaatcactcgctttcgggtatcggaggtgttgaaactggctatgatgccgctgagttcattctccttggatcaaatactgtacaggtatgcaccggtgtgatgatgcacgggtatggtcatgtgaaaaccctttgcgccgagcttcaagatttcatgaaacaacacaacttctcgacgatagaagagttcagagggcattcgctgcagtactttacaacacacacagatttagttaagagacagaaagaagcagttgagcagagaaaagctgagaagagaggcttgaaatctgataaagattggaccggagatgggttcgtgaaggagactgagagtatggtttctaactaagttagttgcctgatgaagtagtgatgaccacccaaatatttaataaaggttctgcagcttcattcacaatcaaatcactaaggctctttctttcaaatgtttaaaatcgacttcgttaatctcacttgaaaagaaataactaaatttgtgtatcttaattttcatctccttgtgtactattcatcttgtatccatccatagcaaccatttctttgttccttcaagttggcttaatttttggccaataataatatcatagacc

SEQ ID NO: 1441 - DNA, 1720 bp, Arabidopsis lyrata
tctctatcttctttaagttgtttactttgttcttcgatttgatcaccaactctcacatatttcgaaatcccaacactttgttgcgtgttatcttctccctctctctctcttataatccttgagtttcacgtctcaagtttgataacttctgcaattcccagattgatctctgtaatcatggcttccatgagtttcgccttgaatcgcttctctggactctcatctaaaaccaccttatcagctgacttcgatccatcaactcgccgaagttttctaccgccgactagagttggacttaagatttcttccgccaccgaatcggagcctgatctcagcgtcactgtaaatggcctgaaaatgcccaatcctttcgtgatcgggtcgggtccaccgggtaccaactacaccgtcatgaagagagcttttgacgaaggttggggagccgtcatcgccaaaaccgtatcattagatgcagccaaagttatcaacgtgacacctcgatatgctcggctacgaactggttccaatggctcagccaaaacagatgtaattgggtggcagaacatagaactcatcagtgaccgacctcttgaaaccatgctcaaagagtttgagcgattgaaaaaagagtatcctgatcggattctgattgcttccatcatggaggaatataacaaaactgcttgggaagagcttattgaccgtgttgagcaaactggggttgatgctttagaaatcaacttctcgtgtcctcatggtatgccagagcgcagaatgggtgccgctgttggacaagattgtgtgcttctcgacgaggtttgcggatggattaatgctaaagctacagttcctgtgtgggctaagatgactcctaatatcactgacataacagagcctgctagggtatctctaaaatcaggatgtgaaggaatttcagctatcaatacaatcatgagtgtaatgggagttgatatgaagacgctgcgtcctgagccatgcgttgaaggttattcaactccaggaggctactcttataaggccgttcgcccaattgcgcttgcaaaagttatgaacattgccaaaatgatgaaatctgagttcagtgaaaatcactcgctttcgggtatcggaggtgttgaaactggctatgatgccgctgagttcattctccttggatcaaatactgtacaggtatgcaccggtgtgatgatgcacgggtatggtcatgtgaaaaccctttgcgccgagcttcaagatttcatgaaacaacacaacttctcgacgatagaagagttcagagggcattcgctgcagtactttacaacacacacagatttagttaagagacagaaagaagcagttgagcagagaaaagctgagaagagaggcttgaaatctgataaagattggaccggagatgggttcgtgaaggagactgagagtatggtttctaactaagttagttgcctgatgaagtagtgatgaccacccaaatatttaataaaggttctgcagcttcattcacaatcaaatcactaaggctctttctttcaaatgtttaaaatcgacttcgttaatctcacttgaaaagaaataactaaatttgtgtatcttaattttcatctccttgtgtactattcatcttgtatccatccatagcaaccatttctttgttccttcaagttggcttaatttttggccaataataatatcatagacc

SEQ ID NO: 1442 - DNA, 1783 bp, Eutrema parvulum
ttctccaacttctcttgttaaggtatttcttaccacctttgttcgatttgatcaatacacacaatttcgaattcctctactttgtcgcgtgttatcttctctctctctctattaagtccgtcattctcgtggtgtttcacgtctctcatctacttcatccttgcaggagataaaatttctgcaatttccagattgatctgtaatcatggcatccatgagtttcgccttgacgcgcttctctggactcgctgctaaaaccagcttatctgccgacttcgatcactcctctcgccggaattttctgccgccgactagagttggtcttaagatctcttcttcttccgccgaatcggagcctgatctcagtgtcaccgtaaatgggctgaaaatgccgaatcctttcgtgatcgggtcgggtccacctggtaccaactacaccgtcatgaagagagccttcgacgaaggctggggaggcgttatcgctaaaaccgtttcactagatgcatccaaagttatcaacgtaacacctcgatatgcccggctacgaaacggatccaatggctcagccaaaacagatgtaattgggtggcagaacatagaactcatcagtgaccggcctctcgaaaccatgctcaaagagtttaagcgattgaaacaagagtaccctgatcggatcctcatcgcttccatcatggaggaatacaacaaaaccgcttgggaagagctcatcgaccgcgttgagcaaactggtgttgatgctttagagatcaacttctcgtgtcctcatggaatgccagagcgcagaatgggagctgcggttggacaagattgtgcgctactggacgaggtttgcgggtggattaatgctaaagctacagttcctgtatgggctaaaatgactcctaatattactgacatagcagagccggccagggtatctctaaaatcaggctgtgaaggaatttcagccatcaacacaattatgagtgtaatgggaattgatctgaagacgttgcatcctgagccatgcgttgaaggttactcaactccaggaggctactcgtataaggctgttcgcccaattgcgcttgcgaaagttatgaacatcgccaagatgataaaatctgagttcagtgagaaagattgctcgctgtcaggtattggaggtgttgaaactggctatgatgcagctgaattcattctcctcggatcaaatactgtacaggtatgcaccggtgtcatggtgcatggctatggtcatgtgaaaaccttatgcgctgagcttcaagatttcatgaaacagcacaacttctcgacaattgaagacttcagagggcattcgcttcagtactttacaacacacacagatttagtcaggagacagaaagaagctattgagcagagaaaagccgagaggagaggcttgaaatctgataaagattggactggagatggattcgttaaggagactgagagtatggtttctaactaagttcagtagcctgatgaagtgatggacccaaatttttaataaagtttgcaacttcattcacaaccaatcgcaaaggctcttcctttctttcgttctacatggacttctctcacttggaaagaaaaaaacactaaagtttattgtatcttattttcttctcgttgtgtataatttgtataatgtatcaattgccaccatttctttgttctatcaagttggcttaatctttagccgataataatgggattatataaaaaaatgaacctggttggcaacatagttagacgagtt

SEQ ID NO: 1443 - DNA, 1708 bp, Eutrema parvulum
ctttgttcgatttgatcaatacacacaatttcgaattcctctactttgtcgcgtgttatcttctctctctctctattaagtccgtcattctcgtggtgtttcacgtctctcatctacttcatccttgcaggagataaaatttctgcaatttccagattgatctgtaatcatggcatccatgagtttcgccttgacgcgcttctctggactcgctgctaaaaccagcttatctgccgacttcgatcactcctctcgccggaattttctgccgccgactagagttggtcttaagatctcttcttcttccgccgaatcggagcctgatctcagtgtcaccgtaaatgggctgaaaatgccgaatcctttcgtgatcgggtcgggtccacctggtaccaactacaccgtcatgaagagagccttcgacgaaggctggggaggcgttatcgctaaaaccgtttcactagatgcatccaaagttatcaacgtaacacctcgatatgcccggctacgaaacggatccaatggctcagccaaaacagatgtaattgggtggcagaacatagaactcatcagtgaccggcctctcgaaaccatgctcaaagagtttaagcgattgaaacaagagtaccctgatcggatcctcatcgcttccatcatggaggaatacaacaaaaccgcttgggaagagctcatcgaccgcgttgagcaaactggtgttgatgctttagagatcaacttctcgtgtcctcatggaatgccagagcgcagaatgggagctgcggttggacaagattgtgcgctactggacgaggtttgcgggtggattaatgctaaagctacagttcctgtatgggctaaaatgactcctaatattactgacatagcagagccggccagggtatctctaaaatcaggctgtgaaggaatttcagccatcaacacaattatgagtgtaatgggaattgatctgaagacgttgcatcctgagccatgcgttgaaggttactcaactccaggaggctactcgtataaggctgttcgcccaattgcgcttgcgaaagttatgaacatcgccaagatgataaaatctgagttcagtgagaaagattgctcgctgtcaggtattggaggtgttgaaactggctatgatgcagctgaattcattctcctcggatcaaatactgtacaggtatgcaccggtgtcatggtgcatggctatggtcatgtgaaaaccttatgcgctgagcttcaagatttcatgaaacagcacaacttctcgacaattgaagacttcagagggcattcgcttcagtactttacaacacacacagatttagtcaggagacagaaagaagctattgagcagagaaaagccgagaggagaggcttgaaatctgataaagattggactggagatggattcgttaaggagactgagagtatggtttctaactaagttcagtagcctgatgaagtgatggacccaaatttttaataaagtttgcaacttcattcacaaccaatcgcaaaggctcttcctttctttcgttctacatggacttctctcacttggaaagaaaaaaacactaaagtttattgtatcttattttcttctcgttgtgtataatttgtataatgtatcaattgccaccatttctttgttctatcaagttggcttaatctttagccgataataatgggattatat

SEQ ID NO: 1444 - DNA, 1679 bp, Eutrema halophilum
ttctttcttatttgatcaacaacacaacacaatttcgaaattttacacttcctcgcgtgttatcttctttctctctctctattgaattcgccattttcccttgagtttcacgtctctcttcgcaggaactttgcgatctccagattgaatctgtaaccatggcttccatgagcttcgccttgactcgcttctctggactcactgctaaaaccagcttatcagctgactttgatccctcctctcgccggaattttctaccgccgactagagttggtctcaagatctcttcttcttcggatacctctgccgagtcggaccctgatctgagtgttaccgtaaatggcctgaaaatgccgaatcctttcgtgatcgggtcgggtcctccgggtacaaactacaccgtcatgaagagagccttcgatgaaggctggggaggagtcatcgccaaaaccgtgtcactagatgcatccaaagttatcaacgtcacacctcgatacgcgcggctacgaaccggatccaatggctcagccaaaacagatgtatttgggtggcagaacatagaactcatcagtgaccgacctcttgaaaccatgctcaaagagtttaagcagttgaaacaagagtaccctgaccggatccttatcgcatccatcatggaggaatataacaaaactgcttgggaagagctcattgaccgtgttgagcaaactggtgttgatgctttagagatcaacttctcgtgtcctcacggaatgcctgagcgcagaatgggagcagctgttggacaagattgtgcgcttctggacgaggtttgcgggtggattaacgctaaagctacagttccagtgtgggctaagatgactcctaatattactgacataacagagccggccagggtatctctgaaatcaggatgtgaaggaatttcagccatcaatacaatcatgagtgtaatgggaattgacctgaagacactgcatcctgagccatgcgttgaaggttactcaactccaggaggctactcttataaggccgttcgcccaattgctctcgccaaagtaatgaacattgcccaaatgatgaaatctgagttcagtgagaaagattgctcgctttcaggtattggaggtgttgaaactggctatgacgcagctgaattcattctcctcggatcaaatactgtacaggtatgcaccggtgtgatggtgcacggctatggtcatgtgaaaactctatgcgccgagcttcaagatttcatgaaacagcacaacttctcgacaatagaagacttcagagggcattcgcttcagtactttacaacacacacagatttagtcaggagacagaaagaagcgattgagcagagaaaagccgagaggagaggcttgaaatctgataaagattggaccggagatgggttcgtgaaggagactgagagtatggtttctaactaagttcagtagcgtgtgatgaagtggtaaaaagtttgcaacttcattcacgaccaaatcgcaaaggctcttactttctatcgtttcacatcgacttcttaagttctcacttacaaaagaaatgtaataagtgtatgtatcttatttccttctcgttgtgtatcaatatgtatcatatataatgtatccgttgccaccatttctttcaagttgtcttcatttgttacc

SEQ ID NO: 1445 - DNA, 1750 bp, Eutrema halophilum
ttagttctttcttatttgatcaacaacacaacacaatttcgaaattttacacttcctcgcgtgttatcttctttctctctctctattgaattcgccattttcccttgagtttcacgtctctcttcgcaggaactttgcgatctccagattgaatctgtaaccatggcttccatgagcttcgccttgactcgcttctctggactcactgctaaaaccagcttatcagctgactttgatccctcctctcgccggaattttctaccgccgactagagttggtctcaagatctcttcttcttcggatacctctgccgagtcggaccctgatctgagtgttaccgtaaatggcctgaaaatgccgaatcctttcgtgatcgggtcgggtcctccgggtacaaactacaccgtcatgaagagagccttcgatgaaggctggggaggagtcatcgccaaaaccgtgtcactagatgcatccaaagttatcaacgtcacacctcgatacgcgcggctacgaaccggatccaatggctcagccaaaacagatgtatttgggtggcagaacatagaactcatcagtgaccgacctcttgaaaccatgctcaaagagtttaagcagttgaaacaagagtaccctgaccggatccttatcgcatccatcatggaggaatataacaaaactgcttgggaagagctcattgaccgtgttgagcaaactggtgttgatgctttagagatcaacttctcgtgtcctcacggaatgcctgagcgcagaatgggagcagctgttggacaagattgtgcgcttctggacgaggtttgcgggtggattaacgctaaagctacagttccagtgtgggctaagatgactcctaatattactgacataacagagccggccagggtatctctgaaatcaggatgtgaaggaatttcagccatcaatacaatcatgagtgtaatgggaattgacctgaagacactgcatcctgagccatgcgttgaaggttactcaactccaggaggctactcttataaggccgttcgcccaattgctctcgccaaagtaatgaacattgcccaaatgatgaaatctgagttcagtgagaaagattgctcgctttcaggtattggaggtgttgaaactggctatgacgcagctgaattcattctcctcggatcaaatactgtacaggtatgcaccggtgtgatggtgcacggctatggtcatgtgaaaactctatgcgccgagcttcaagatttcatgaaacagcacaacttctcgacaatagaagacttcagagggcattcgcttcagtactttacaacacacacagatttagtcaggagacagaaagaagcgattgagcagagaaaagccgagaggagaggcttgaaatctgataaagattggaccggagatgggttcgtgaaggagactgagagtatggtttctaactaagttcagtagcgtgtgatgaagtggtaaaaagtttgcaacttcattcacgaccaaatcgcaaaggctcttactttctatcgtttcacatcgacttcttaagttctcacttacaaaagaaatgtaataagtgtatgtatcttatttccttctcgttgtgtatcaatatgtatcatatataatgtatccgttgccaccatttctttcaagttgtcttcatttgttaccgatggtaatgactaatgggcatgataataataataataaacaaaaagaaggtctgattggcaaggta

SEQ ID NO: 1446 - DNA, 1556 bp, Brassica napus
ggatttgatctccactttggtcgcttgttatcttcttatacctctctcgaattcgtttctatcgtctgtcagaactcagaactcatcgatggcatccatgagttccgccttgactcgcttctccggactctcttctaaaaccaccttatcaccggacttcgatcactcctctcgccggacttttctacctccgaacagagtcggtctcaagatctcctcttcttcatccgccgcagcagactccgagcctgatctgagtgtcaccgtaaacggcctgaaaatgccgaatccgttcgtgatcgggtcgggtccacccggtaccaactacaccgtcatgaagagagccttcgatgaaggctggggagccgtcatcgccaaaaccgtgtcactagatgcatccaaagtcatcaacgtaacacctcgatacgcaaggctaaagaccggatccaacggctcagccaaaacagatgtgatcgggtggcagaacatagaactcatcagtgaccgacctctcgaaaccatgctcaaagagtttaagcagctgaaacaagagtaccctgaccggatcctcatcgcttccatcatggaggaatacagcaaaaccggctgggaagagctcattgaccgtgttgagcaaaccggtgttgatgctttagagatcaacttctcgtgtcctcatggtatgccagagcgtagaatgggagcagctgtgggacaagactgtgcacttctggaggaggtttgcggttggattaatgctaaagctactgttcctgtttgggctaagatgactcctaatatcactgacattactgagccggctagggtatctctaaaatcaggatgtgaagggattgcagccatcaatacaatcatgagtgtgatgggaattgatctgaagacactgcatcctgaaccatgtgtggaaggttactcaactccaggaggctactcttataaggctgttcgcccaatcgcgcttgcgaaagttatgaacattgctcaaatgatgaagtctgagtttggtgagaaagattactcgctttccggtattggaggtgttgaaactggatatgacgcagctgagttcattctgctcggatcaaatactgttcaggtatgtaccggtgtgatggtgcatggctatggtcatgtgaaaaccctatgcgctgagcttcaagatttcatgaaacaacacaacttctcgacgatagaagacttcagagggcattctcttcagtactttacaacacacacagatttagtcaggagacagaaagaagctattgagcagcgaaaagccgagaggaaaggcttgaaatctgataaagattggaccggtgatgggttcgtgaaggagactgaaagtatggtttctaactaatagcctgatgaagttattgacccaaatgttttataaagtttgaaactttactatcattttacatcatttctcaactctcacttaggaaaaaaaaaaaagacactaaggtgtactgtatcttattttcttctcgttgtgtatcacttgtataatgtatccattatcaccactt

SEQ ID NO: 1447 - DNA, 1536 bp, Brassica napus
cttgtcttcttaacttgtctcttacctttgatcaatttcgaaatcctacgctttctcaaacttcgacctctatcaaacactctcctttgatcaatctttgcagtttccagattgaatctatcaatcaatggcatccatgagcttcgccttgactcgcttctctggactctcttctaaaaccaccttatcacccgacttcgatcactcctctcgccggaactttctacccccaaacagagtttctctcaagatctcttcctccacggactcggagcctgatctcagcgtcaccgtgaatggcctcaaaatgccgaatcctttcgtgatcgggtcgggtccacccggtaccaactacaccgtcatgaagagagcgttcgacgaaggctggggtggcgtcatcgctaaaaccgtttcactagacgcatccaaagtcatcaacgtgacgcctaggtacgccaggctacgaaccgggtcagccaaaacagatgtaatcgggtggcagaacatagaactcatcagcgaccgacctctcgaaaccatgctcaaagagttcaagcagctgaaacaagagtaccctgaccggatcctcatcgcttccatcatggaggaatacagcaaaaccggctgggaagagctcatcgaccgcgtcgagcaaaccggtgttgatgctttagagatcaacttctcgtgtcctcatggtatgccagagcgtagaatgggagctgctgttggacaagactgcgcccttcttgaagaggtttgcggatggattaacgctaaagctacagttcctgtgtgggccaaaatgactcctaatattactgacataacagagccggccagggtatctctaaaatcaggatgtgaagggatctcagccatcaacacaatcatgagtgtaatgggaattgatctgaagactttgcatcctgagccttgcgttgaaggttactcaactccaggaggctactcttataaggctgttcgtcctattgcgcttgcgaaagttatgaacattgcccaaatgatgaagtctgagttcggtgagaaagattgttcgctttctggtattggaggtgttgaaactggctatgacgcagctgagttcattctcctcggatctaatactgtacaggtgtgcacaggtgtgatggttcatggctatggtcatgtgaaaactctatgcgccgagcttcaagatttcatgaggcagcacaacttctcgactatagaagacttcagagggcattcgcttcagtactttacaacacacacagacttagtaaggagacagaaagaagctattgagcagagaaaagctgagaggagaggcttgaaatctgataaagattggactggagatggattcgttaaggagactgagagtatggtttctaactaagttcagtagcttgatgaagtgatggactcaaatattcaataaaagtttgcaacttcattcacaacttcttaaacacttgcaaagaaaaaaaattgtatcttattgtctcaacattgtgtatcatttgtataatg

SEQ ID NO: 1448 - DNA, 1680 bp, Brassica napus
cccacgcgtccggttctagatcgcgagcggccgctcgcgatttctcttcttactttttgttcgatttgatctccactttggtcgcttgttatcttcttatacctctctcgaattcgtttctatcgtctgtcagaactcatcaatggcatccatgagtttcgccttgactcgcttctctggactctcttctaaatcaaccttatcaccggacttcgatcactcctctcgccggacttttctacctccgaacagagtcggtctcaagatctcctcctcttcttccgccgcagcagactccgagcctgatctcagtgtcaccgtaaacggcctgaaaatgccgaatccgttcgtgatcgggtcgggtccaccaggtaccaactacaccgtcatgaagagagccttcgatgaaggctggggaggcgtcatcgccaaaaccgtgtcactagatgcatccaaagtcatcaacgtaacgcctcgatacgctcggctaaaaaccggatccaacggctcagccaaaacagatgtgatcgggtggcagaacatagaactcatcagtgaccgacctctcgaaaccatgctcaaagagttcaagcagctgaaacaagagtaccctgatcggatcctcatcgcttccatcatggaggaatacagcaaaaccggctgggaagagcttatcgaccgcgttgagcaaaccggtgttgatgcattagagatcaacttctcgtgccctcatggtatgccagagcgcagaatgggagctgctgttggacaagactgtgcgcttctggaggaggtttgcggttggattaatgctaaagctactgttcctgtttgggctaagatgactcctaatatcactgacattactgagccggctagggtatctctaaaatcagggtgtgagggcatttcagcgatcaatacaatcatgagtgtgatgggaattgatctgaagacactgcatcctgagccatgcgttgaaggttactcaactccaggaggctactcttataaggctgttcgcccaatcgcgcttgcgaaagttatgaacattgcccaaatgatgaagtctgagtttggtgagaaagattactccctttccggtattggaggtgttgaaactggctatgacgcagctgagttcattctactaggatcaaatactgttcaggtatgcaccggtgtgatggtgcatggctatggtcatgtgaaaacgctatgcgcagagcttcaagatttcatgagacaacacaacttctcgacaatagaagacttcagagggcattctcttcagtactttacaacacacacagacttagtcaggagacagaaagaagccattgagcagagaaaagccgagaggaaaggcttgaaatctgataaagattggacgggagatgggttcgtgaaggagactgaaagtatggtttctaactaatagcctgaagaagttattaacccaaatgttttataaagtttgaaacttcatcatttcttaagtctcacttggaaataaaaaagaaaactaagttgtactgtatcttattttcttctcgttgtgtatcacttgtacaatgtatccattgtcaccacttctttttctttcaagctggcttaatttctagccggtaacaatgagattgttaaattggtctgttggcaaaatatctaatgcgagtt

SEQ ID NO: 1449 - DNA, 1848 bp, Brassica rapa
gggaataatatacagaaatgaatcgtttattacgttaattgcgaacaattaaactagattaatacgcctttctatatcttacggaacatgggattactacattatttgtctcaattaattaattaattaacttcaattatttccacatggggaaagagaagttggaaccgaccaattattattagaacacacttctcttcccacctttgttcgatttgatctccactttggtcgcttgttatcttcttatacctctctcgaattcgtttctatcgtctgtcagaactcatcgatggcatccatgagttccgccttgactcgcttctctggactctcttctaaaaccaccttatcaccggacttcgatcactcctctcgccggacttttctacctccgaacagagtcggtctcaagatctcctcttcttcttcttccgccgccccagactccgagcctgatctcagcgtcaccgtaaacggcctgaaaatgccgaacccgttcgtgatcgggtcgggtccacccggtaccaactacaccgtcatgaagagagccttcgatgaaggctggggtggcgtcatcgccaaaaccgtgtcactagatgcatccaaagtcatcaacgtgactcctcgatacgcaaggctaaagaccggatccaacggctcagccaaaacagatgtgatcgggtggcagaacatagaactcatcagtgaccgacctctcgaaaccatgctcaaagagtttaagcagctgaaacaagagtaccctgatcggatcctcatcgcttccatcatggaggaatacagcaaaaccggctgggaagagctcattgatcgcgttgagcaaaccggtgttgatgctttagagatcaacttctcgtgtcctcatggtatgccagagcgtagaatgggagcagctgtgggacaagactgtgcacttctggaggaggtttgcggttggattaatgctaaagctactgttcctgtttgggctaagatgactcctaatatcactgacattactgagccggctagggtatctctaaaatcaggatgtgaagggattgcagccatcaatacaatcatgagtgtgatgggaatcgatctgaagacactgcatcctgagccatgcgttgaaggttactcaactccaggaggttactcttataaggctgttcgcccaatcgcgcttgcgaaagttatgaacattgctcaaatgatgaagtctgagtttggtgggaaagattactcgctttccggtattggaggtgttgaaactggctatgacgcagctgagttcattctcctcggatcaaatactgttcaggtatgcactggtgtgatggtgcatggctatggtcatgtgaaaaccctatgcgctgagcttcaagatttcatgaaacaacacaacttctcgacaatagaagacttcagagggcattctcttcagtactttacaacacacacagatttagtcaggagacagaaagaagctattgagcagcgaaaagccgagaggaaaggcttgaaatctgataaagattggaccggtgatgggttcgtgaaggagactgaaagtatggtttctaactaatagcctgaagaagttattgtcccaaatgttttataaagtttgaaactttactatcgttttacatcatttcttaagtctcacttggaaataaaaaaagaaaactaaggtgtactgtatcttattttcttttcgttgtgtatcacttgtacaatgtatccattgtcaccacttctttttttctttctagctggtaacagtgagattgttaaattggtctgttggcaaaatatctatacgagtttacgcctttaattatc

SEQ ID NO: 1450 - DNA, 1736 bp, Brassica rapa
taattaattacttaactaggaactctctggttgtaaaattcaattatttctccacatggcaacgagagaagttggaaaccgaccaattattacaacacactcttctctaacttgtcttcttacctttgatcaatttcgaaatcctacgctttctcaaacgtgttatcttctacctctctgtccctctgttaaatctctgtagttatccagattaaatctaccaatcaatcaatggcatccatgagcttcgccgtgactcgcttctctggactctcttctaaaaccaccttatcacccgacttcgatcactcccctcgccggacttctctacctccgaacagagttgctctcaagatctcttcctccacggactcggagcctgatctcagcgtcaccgtgaatggcctcaaaatgccgaatcctttcgtgatcgggtcgggtccacccgctaccaactacaccgtcatgaagagagccttcgacgaaggctggggtggcgtcatcgctaaaaccgtttcactagacgcatccaaagtcataaacgtgacgcctcgatacgccaggctacgaaccggatcagccaaaacagatgtaatcgggtggcagaacatagaactcatcagcgaccgacctctcgaaaccatgctcaaagagttcaagcagctgaaacaagagtaccctgaccggatcctcatcgcttccatcatggaggaatacagcaaaaccggctgggaagagctcatcgaccgcgttgagcaaaccggtgttgatgctttagagatcaacttctcgtgtcctcatggtatgccagagcgtagaatgggagctgctgttggacaagactgcgcgcttcttgaagaggtttgcggatggattaatgcgaaagccacagttcctgtgtgggctaagatgactcctaatattactgacataacagagccggccagggtatctctaaaatcaggatgtgaagggatctcagccatcaacactatcatgagtgtgatgggaattgatctgaagacgttgcatcctgagccttgcgttgaaggttactcaactccaggaggctactcttataaggctgttcgtcctattgcgcttgcgaaagttatgaacattgcccaaatgatgaagtctgagttcggtgagaaagattgttcgctttctggtattggaggtgttgaaactggctatgacgcagctgagttcattctccttggatctaataccgtacaggtatgcacaggtgtgatggtgcatggctatggtcatgtgaaaactctatgcgccgaccttcaagatttcatgaggcagcacaacttctcgacgatagaagacttcagagggcattcgcttcagtactttacaacgcacacagacttagtaaggagacagaaagaagctattgagcagagaaaagccgagaggagaggtttgaaatctgataaagattggactggagatggattcgttaaggagactgagagtatggtttctaactaagttcagtagcttgatgaagtgatcggactcaaatattcaataaaagtttgcaacttcattcacaacttcttaaacacttgcaaagaaaaaaaaaattgtattttattttctcaacattgtgtatcatttgtataatgtatccactgccgcatttctttgttcttacatgagcttaaatttaaaccaataataacggaatcgtttgaaaaagtggacttggttggtaacat

SEQ ID NO: 1451 - DNA, 1577 bp, Brassica napus
ttctacctctataaacactctcatttgagcaatctctgcagtttccagattgaatctatcaatcaatggcatccatgagcttcgccgtgactcgcttctctggactctcttctaaaaccaccttatcacccgacttcgatcactcccctcgccggacttctctacctccgaacagagttgctctcaagatctcttcctccacggactcggagcctgatctcagcgtcaccgtgaatggcctcaaaatgccgaatcctttcgtgatcgggtcgggtccacccgctaccaactacaccgtcatgaagagagccttcgacgaaggctggggtggcgtcatcgctaaaaccgtttcactagacgcatccaaagtcataaacgtgacgcctcgatacgccaggctacgaaccggatcagccaaaacagatgtaatcgggtggcagaacatagaactcatcagcgaccgacctctcgaaaccatgctcaaagagttcaagcagctgaaacaagagtaccctgaccggatcctcatcgcttccatcatggaggaatacagcaaaaccggctgggaagagctcatcgaccgcgttgagcaaaccggtgttgatgctttagagatcaacttctcgtgtcctcatggtatgccagagcgtagaatgggagctgctgttggacaagactgcgcgcttcttgaagaggtttgcggatggattaatgcgaaagccacagttcctgtgtgggctaagatgactcctaatattactgacataacagagccggccagggtatctctaaaatcaggatgtgaagggatctcagccatcaacactatcatgagtgtgatgggaattgatctgaagacgttgcatcctgagccttgcgttgaaggttactcaactccaggaggctactcttataaggctgttcgtcctattgcgcttgcgaaagttatgaacattgcccaaatgatgaagtctgagttcggtgagaaagattgttcgctttctggtattggaggtgttgaaactggctatgacgcagctgagttcattctccttggatctaataccgtacaggtatgcacaggtgtgatggtgcatggctatggtcatgtgaaaactctatgcgccgaccttcaagatttcatgaggcagcacaacttctcgacgatagaagacttcagagggcattcgcttcagtactttacaacgcacacagacttagtaaggagacagaaagaagctattgagcagagaaaagccgagaggagaggtttgaaatctgataaagattggactggagatggattcgttaaggagactgagagtatggtttctaactaagttcagtagcttgatgaagtgatcggactcaaatattcaataaaagtttgcaacttcattcacaacttcttaaacacttgcaaagaaaaaaaaattgtattttattttctcaacattgtgtatcatttgtataatgtatccactgccgcatttctttgttcttacatgagcttaaatttaaaccaataataacggaatcgtttgaaaaagtggacctggtggtaacaatacgtacaa

SEQ ID NO: 1452 - DNA, 1772 bp, Cucumis sativus
tcttagttattttttattccctaagttaatgaaaaggtgtcaaggaataatgaataattaatctgatcatcttcttctccatcatcatcatcatcgtccatgaatattaaattgattacttatgtaaatccaaacggaagtcgacgaggaggattcttcataccccacttttccagctcttgattcaacattacacctcagattcacatacccttttcttcttccttcttcttctgttccactccagaaattctagttacacagagctccagtttcttgatccatggcgtccttcaaccttacccaattcagaactaaaagcccaattaccaacctcgctctgaatccgtcccggacgggtttgactcgaccaactagacttgggtttagagtggttgcctccggtggggctcaggcggagcccgatctcagtgtgacagtcaatgggttgaacatgcccaacccgtttgtaattgggtcgggtccgcctggaactaactatacggttatgaagagggcatttgatgaaggttggggagctgtgattgccaaaactgtgtcactagatgcagcaaaagttataaatgtaactcctagatatgcccggctacgagcagattcgaatggctctgcaaaggggcagattattgggtgggagaacattgaattgataagcgataggcctcttgaaattatgttgaaagagttcaagcagttaaaagaggagtatcccgataggattctcattgcttcaataatggaggagtataataaagctgcttgggaagaacttatcgatcgagttgaacaaactggagttgatgcgtttgaaatcaatttctcatgccctcatggcatgcccgaacggagaatgggtgctgcagttgggcaagattgtgcacttctggaagaagtttgtggatggattaatgcaaaagctacaatacctgtttgggcaaaaatgacccccaatatcactgacatttcacagcctgcaagggtggctctgaaatcaggatgtgagggaatagcagccatcaacacgatcatgagtgtaatgggaatcgatctcaaaaccttacgtcccgagccttgtgttgaggggtattcaactccaggaggctattcttccaaggcagttcatcctattgctcttggtaaagtgttgagcattgcaaaaatgatgaaggcagaatttaacgatggagactactctctttctggcattgggggtgtcgaaactggtggagatgccgccgagtttattctacttggagcaaacactgttcaggtatgtacaggagtgatgatgcatgggtatggcgttgtaaagaaactatgtgctgagcttcaggacttcatgaaacttcacaacttctcatccattgaagacttcagaggagcttctcttccatatttcacgacccacacggatttggttcggaggcagcgggaagcaatcgagcagagaaaagctgtgaagaagggtctgcaatctgataaagactggacaggcgatggctttgttaaggaaactgagagtatggtttcaaactgaagtacagatcaatcaaaccttagcttcgctctttggcattggaaataacaaaaaatggtgtcttcgtatcagagcaaagtttcttttctctttccctcttaaagggtgaataagtgtattattacagaacagtttgatttttcgtatgataaacttttgtagatttggatacgtgaaggaataatagcaatttgttatagacagaaatcattct

SEQ ID NO: 1453 - DNA, 1529 bp, Cucurbita pepo
ccccatcttcttaatcgaatattacacctcagattcactcacccgtcttcttcttcttcttcttctgaatcacttctggatttcttcatccatggcgtcgttgaatttcacccaaatcagaaacaaaaacccaatttccgacctcactctgactcggtctcagacgggtttggctcgtcggactcgagttgggttcaaagtggttgccgccagtgagtctccggtggagcccgatctcagtgtgacggtcaatgggttgcacatgcccaacccgttcgtaatcggttccggtcctccgggaacaaactacacggttatgaagagggcattcgatgaagggggggggctgtgatcgccaaaactgtatcattagatgcagctaaagttataaacgttactccacgatatgctcggcttcgagcggattcgaatggttctgcaaaagggcagattatagggtgggagaacattgaattgataagtgatagacctcttgaaactatgttgaaagagtttaagcagttgaaggaggagtatcctgataggattcttattgcttcgatcatggaggagtataataaagctgcttgggaagaacttattgatcgagtcgaacaaaccggagttgatgcatttgaaatcaatttctcgtgccctcatggcatgcccgaacggagaatgggcgctgcggtcgggcaggattgcgcgcttttggaagaggtttgtggatggataaatgctaaagctacaatccctgtgtgggctaaaatgactcccaatatcactgacattgcacagcctgcaagggtggctctgaaatcaggatgcgagggaatagcggccatcaacacgatcatgagtgtaatgggaatcgatctaaagaccttacgtcccgagccttgtgtcgaggggtactcaactcctggaggctactcttccaaggcagttcatcctattgctcttggtaaagtgttgagcattgcaaaaatgatgaaggcagagcttaatgatgcagactactctctttctggcattgggggtgttgaaaccggtggagacgctgccgagtttattctactcggagctaactctgttcaggtgtgtaccggagtgatgatgcatgggtatggccttgtaaagaagctttgtgcagagctgaaggacttcatgaaacttcacaacttctcatccatagaagatttcagaggggcttctcttccgtatttcacgacccacacggatttggttcggaggcagcgggaagcaatcgagcagagaaaagctgtgaagaaagggctgcaatctgataaagattggactggcgatggctttgttaaagagacagagagtatggtttccaactgagcattgccattacaagtggtgtctttatcccttcctttctcttaaagggcgacgaataagtgtattactacagaacaatttagcaagtatggtaaacctttgtagattcataaatgaaggaataatgaccatttataattcttcctcataacgctgaatatgat

SEQ ID NO: 1454 - DNA, 1759 bp, Citrullus lanatus
tcttaattactatgattattgttacattgtcaagaaagacttgctagtgtataaagaattattgttattgatcggatcattatccatcaatattaaattgattaattttgtaaatccaaaaggaagtcgacgaggatgattcttcataccccaccttccaatcgctcttgatcgaatattacacctcagattcagtcacccttcttctcctttccttctttcttcttcttcttcttctgttgcagagaactcgagtttcttgatccatggcgtccttcaatcttacccaattcagaactaaaaacccaattcccaacctcgctctgaatcggtcccggacggatttgactcgtcgaactagacttgggttcagagtggttgccgccggcgaggctcaggcggagccggatctcagtgtgacggtcaatgggttgcacatgcccaacccgtttgtgatcgggtcgggtccgccaggaactaactatacggttatgaagagggcatttgatgaaggttggggggctgtgattgccaaaactgtgtcactagatgcagcaaaagttattaatgtaactcctagatatgcccggcttcgagcggattcaaatggctctgcaaaggggcagatcattgggtgggagaacattgaattgataagtgataggccccttgaaactatgttgaaagagtttaagcagttaaaagaggagtatcctgataggattctcattgcttcaataatggaggagtataataaagctgcttgggaagaacttatcgatcgggttgaacaaactggagttgatgcatttgaaatcaatttctcatgccctcacggcatgcccgaacggagaatgggtgctgcagttgggcaagattgtgcacttctggaagaggtttgtggatggattaatgcaaaagctacaatccctgtttgggcaaaaatgacccccaatatcactgacatttcacagcctgcaagggtggctctgaaatcagggtgtgagggaatagcggccatcaacacgatcatgagtgtaatgggaatcgatctcaagaccttacgtcctgagccttgtgttgaggggtactcaactccaggaggctattcttccaaggcagttcatcctattgctcttggtaaagtgttgagcattgcaaaaatgatgaaggcagaatttaacgatggagactactctctttctggcattgggggtgtcgaaactgggggagatgctgccgagtttattctactcggagcaaacactgttcaggtgtgtacgggagtgatgatgcatgggtatggccttgtaaagaaactttgtgctgagcttaaggacttcatgaaacttcacaatttctcatccattgaagatttcagaggggcatctcttccgtatttcacgacccacacggatttggttcgtaggcagcgggaagcaatcgagcaaagaaaagctgttaagaagggtctgcaatctgataaagattggacaggcgatggctttgttaaggaaactgagagtatggtttcaaactgaaagtctaaacacagatcaatcaagcgtttactttgtgttggcatttgaaataacaaaagatggtctttgtgtccgagtaaagtttctttctttcttcctccttaaagagtgacgaataaatatatcattacagaacagttcaatttcgtatgataaacttatgtagattggatacgtgaagggataatagcaatttattttagtaaaaattcattctg

SEQ ID NO: 1455 - DNA, 1732 bp, Cucumis melo
aaatcttaattatttttcttccttaagtgttttgaaaagttgtcagggaataatgaataattaatctcatcattatcgtcatcatcatccatgaatattaaattgattactttgtgtaaatccaaaaggaagttgacgaggaggattcttcataccccacttttccattgctcttgattcaacattacacctcagattcacttacccttttcttcttccttcttcctctgttccactccagaatttctagttacaacagagctccagtttgttgatccatggcgtccttcaaccttacccaattcagaactaaaaacccaattcccaacctcgctctgaatccgtcccggacgggtttgactcgaccaactagacttgggtttagagtggttgcctccggcaagcctcaggcggagcccgatctcagtgtgacggtcaatgggttgaacatgcccaacccgtttgtaattgggtcgggtccgccaggaactaactatacggttatgaagagagcatttgatgaaggttggggggctgtgattgccaaaactgtgtcactagatgcagcaaaagttataaatgtaactcctagatatgcccggctacgagcggattcgaatggctctgcaaaggggcagattattgggtgggagaacattgaattgataagtgataggcctcttgaaactatgttgaaagagttcaagcagttaaaagaggagtatcccgataggattcttattgcttcaataatggaggagtataataaagctgcttgggaagaacttatcgatcgagtcgaacaaactggagttgatgcgtttgaaatcaatttctcatgccctcatggcatgcccgaacggagaatgggtgctgcagttggacaagattgtgcacttctggaagaagtttgtggatggattaatgcaaaagctacaatacctgtttgggcaaaaatgacccccaatatcactgacatttcacagcctgcaagggtggctctgaaatcaggatgtgagggaatagcagccatcaacacgatcatgagtgtaatgggaattgatctcaaaaccttacgtcccgagccttgtgttgaggggtattcaactccaggaggctattcttccaaggcagttcatcctattgctcttgggaaagtgttgagcattgcaaaaatgatgaaggcagaatttaacgatggagactactctctttctggcattgggggtgtcgaagctggtggagatgctgccgagtttattctactcggagcaaacactgtccaggtatgtacaggagtgatgatgcatgggtatggccttgtaaagaaactatgtgctgagcttcaggacttcatgaaacttcacaacttctcatccattgaagacttcagaggggcttctcttccatatttcacgacccacatggatttggttcggaggcagcgggaagcaatcgagcagagaaaagctgtgaagaagggtctgcaatctgataaagattggacgggcgatggctttgttaaggaaactgagagtatggtttcaaactgaagtacagatcaatcaaacctttgcttcgctttgtcattggaaataacaaaaaaatggtgtctttgtatcagagtaaagtttcttttctctttccctcttaaagggtgacgaataaatgtattattacagtaacagtttgatttttcgtatgataaacttttgtagattggatacgtgaa

SEQ ID NO: 1456 - DNA, 1636 bp, Euonymus alatus
ccggggattcaataataatgttcttatcacgagcataaagacgcaacgttcctttgaatccgggtttttgatatcatacgattactcaatcagattaaaaaatctcattttttattcattctgattgatttccacttcgtgaactctgaactttcaattcttgatccacatggcgtcgctgagtttgacccagttcagaggcaggaactcggtggctgattctgttcggattcgaccttctccgtctgtgaatcggcatggtcgagttgggtttttgagggtggttgcgtcggacactcaggcagagcctgatttgagtgtgactgttaatggtttacacatgcccaatccatttgtgatcgggtcgggtcctcccggaacaaactacacggtcatgaagcgcgcctttgatgaaggctggggtgctgttattgcaaaaacggtatcactagatgcagcgaaagttataaatgtaactcctcgatatgccagactacgagctggtgcaaatggttcagccaaagggcagattattgggtgggagaatatagaactaattagtgacaggccttttgagactatgttgaaagaattcacgcaattgaaaaaagaatatcctgatcggattctcattgcttctattatggaggaatacaacaaagctgcgtgggaggaacttatttatcgtgtcgagcaaactgggattgatgccattgaaataaatttctcgtgccctcatggcatgcctgagcgcaaaatgggtgctgcagtaggtcaagattgtgccttgttggaagaggtttgtggatggataaatgcaaaagctaccgttcctgtgtgggcaaagatgactcctaacatcacagatattacacagccggctagggtgtctctaaagtcgggatgtgagggaatagcagccattaacacaatcatgagtgtgatgggcatcaaccttaataccctacgtccggagccctgtgtggaaggatactcaactcctggtggttattcttccaaggcagtccatcctattgcccttggaaaagtgatgagtattgcaaaaatgatgaaggcagaattcaacgataaggattattcactttctggtattggaggtgtcgagacaggcggtgatgctgctgaatttattcttcttggagcaaacacggtccaggtttgcactggtgttatgatgcacggctatggcctcgttaagaaactttgtgccgagctgaaggatttcatgaaaatgcacaacttcacatccgtggaagatttcagaggggcgtcactcgagtattttactactcatatggatttggtgcaaagacagcaagaagcgattcaacaaaggaaagctatcaaaaaaggtctgaagtctgataaagattggacaggagatggttttgtgaaggagtctgagagtatggtttctaattgacatgtaaaaactcgagctatccctctcacgtatgactaaaaataaatggttttacttgtgtgtttcttctgatttgaatgaactgaacaaaatgtttctagggtttcttgatagcattttcttcaagttactatatatgacaacattgtggcgattgaacgtcttctaaaattgctctctgttttaatgagt

SEQ ID NO: 1457 - DNA, 1559 bp, Cucurbita pepo
gccccacctttccatctttcttgatcgaatattacatctcagattgagttacccatcttcttcttctccttctgttccattacaggattttctgttgcagagagcttgaatttcttgatccatggcgtcgttggattttacccagatcagaactagaaacccaatgtccgagctcgcgctgaatcggtctcggatgcgtttgcctcgtcgaaatagagttgggttcagagtggtggccgccggtgaaggtcaggcggagcctgatctcagtgtgacggttaatggattgcacatgcctaacccgttcgtaattgggtcgggtccgccgggaactaactatacggttatgaagagggcatttgatgaaggttggggcgctgtgattgccaaaactgtgtcactagatgcagccaaagtaataaatgtaacgcctagatatgcccggcttcgagcagattcaaatggctctgcaaaagggcagatcattgggtgggagaacattgaattgataagcgacagaccccttgaaactatgttgaaagagtttaagcaattgaaggaggagtatcctgataggattctcattgcttcaataatggaggagtataacaaagctgcttgggaagaacttatcgatcgagtcgaacaaaccggagttgatgcatttgaaatcaacttctcgtgccctcacggcatgcccgaacggagaatgggcgctgcagtcgggcaagattgtgcgcttttggaagaggtttgtggatggattaatgctaaagctacaatccctgtctgggctaaaatgactcccaatatcactgacatttcacagcctgctagggtggctctgaatcgggttgcgagggatagcggctatcaacacgatcatgagtgtaatgggaatcgatctcaagacgttacgccccgagccttgtgttgaggggtactcaactccaggaggctactcttccaaggcagttcatcctattgctcttggtaaagtgttgaacatcgcaaaatgatgaaggcggaatttaatgatgcagactactctctttctggcattggaggtgtcgaaaccggtggagatgctgccgagtttattctactcggagcaaacactgttcaggtgtgcacgggagtgatgatgcatggttatggcctcgttaagaaactctgtgctgagctgaaggacttcatgaaacttcacaacttctcatccattgaagatttcagaggggcttcccttccatacttcacgacgcacacggatttggttcggaggcagcgggaagcaattgagcagagaaaagctgtgaagaaaggcctgcaatctgataaagattggactggcgatggctttgtcaaggaaactgagagtatggtttcaaactgaagggcttaatacagtacacggatcaagcctttgctttggcttggcagtagaaataactcagaatgttgtctttgttgcatccgagttcagtttcttttgttctttctttctccttccctcgaataagtgtatcattacagaacagtttcaatttcgtatgattgtg

SEQ ID NO: 1458 - DNA, 2218 bp, Cannabis sativa
tataaaattttgagtagcccataagaaattcctatatataataatattgatgtgtagtggataagcctactcactagaccaccaacaaatatcttaataataccaaataaattaacatatagttgtgttcaagtgaaagagtttgagcttttgttttgcatgaaaaagagttaaactttgattgatcatactaacacacataaaaatgtatatgtaattttgttaaaaaaaaatgtttatgtgatttaatttaccaaagtcaaaactttgagttttcataacaagaagtagaagatgacgatgaatattatgtttgtgaaataaaaactcttgaaagtttctttttttgatgaacaaaacaaaactcttcaaagttgacatttttatatttcgtggggtagtgtcaaatgtaacatggaatcacttcaaaaattattaaaataattcatccatttccagctgcccaaatcaatccaaatacaaacgattcctctgaatccacgttctcttccgatcccttttaatacttttaacgtaagattcaattattgtttccttcttcttcttttaataacgtcagatttatttgcggaggactcaaaattttcaacactgtatgatccatggcgtctctaagcttcactcatgtcaaattcaaaaacccagttgctgatttcgccagaactcgtccaaaaactggtttggcctgctcaaatagagttgggtttagagtttttgcttctgagacccagaaagagcctgatcttagtgtgactgtaaatgggttgcatatgcctaatccgtttgttatcgggtcgggtccacccgggactaactacaccgtcatgaagagggcctttgatgaaggatggggtgcagtgattgctaagactgtctcactagatgcagcaaaagttataaatgtcactcctcgctatgctcgattacgagctggtgcaaatggctctaccaagggacaaattattggatggcagaacatcgaattgattagtgatcggcccttggaaacaatgttaaaggaattcaagcagctaaaggaggaatatccagatagaattcttattgcttcaattatggaggaatataataaagctgcgtgggaggaacttattgatcgagtggagcaaactggagttgatgcctttgaaatcaacttttcgtgccctcatggtatgcccgagcgcaaaatgggggctgcagtcggtcaagattgtgcgctattggaagaggtttgtggttggattaacgcaaaagctacaattcctgtttgggcaaagatgactcctaacatcacagatattacagagccggcgagaatttctctgcgctctggatgtgaaggcgtagcagcaatcaacacaatcatgagtgtaatgggaatcaatcttgatagcttacgtcccgaaccatgtgttgaggggtactcaactcccgggggatattcttccaaagcagtacaccctattgcgcttgcaaaagtgatgaacattgcaaagatgatgaaggcagaattcggtgacaaagattactctctttccggtattggtggtgttgagaccggtggtgatgctgctgaatttattcttcttggagcaaattctgttcaggtctgtaccggggttatgatgcatggatatggccttgtgaagaaactttgtgacgagctgaaagacttcatgagaaagcacaatttctcatcgatcgaagattttagaggggcttcacttccatactttactactcacaccgatttggtaaagaggcagcaagaggcgatcaagcagagaaaggccattaagaaagggctgcagtctgataaggattggactggagatggctttgtgaaagagactgagagcatggtctctaactgaataacaaaaccattggaaaccttctttgaacttgctttcaaaatttattttcaagtttgacaaaggaactccattatgtggatattcagctaataatgcttctttcttacatttcataatctttttgtacaagtcaagcaaactagtgccaatgccaatcttttagaaatacaaaatgttccaatgaaatattatatgtggaaaaatgaatgaggatagcaatctgtgtgaaatattattgatattatattctctttaccaattatacaacaaaataaattattaatgtattttgggataacataatctaaatctaagacatg

SEQ ID NO: 1459 - DNA, 1499 bp, Vitis vinifera
tcaacccgtttttttttttttctatggcttctctcagtttctctcccatcagagccaaaccctctggcggggacttccggccgtttcgcaggcagagtttggctcggcccagcagagttgcgtttagggtctttgcttctgagggtcaggctgagcctgatctgagtgtcactgtcaatggattgcatatgccgaatccttttgttatcgggtccggtccgcccgggaccaattataccgtcatgaagagggcttttgatgaaggttggggtgctgtgatcgccaaaacggtgtctctggatgctgccaaagttataaatgtaactcctcggtatgcccggctacgagtaggagcaaatggctcagccaaaggacaaattattgggtgggaaaatattgaactcataagcgatcggcctcttgaaacaatgttgaaagagttcaagcaattaaaagaagagtatcctgatagaatacttattgcttcaatcatggaggaatatgataaagcagcctgggaagaacttatcgaccgagttgagcaaactggaattgatgcccttgagatcaatttttcatgtcctcatggtatgccagagagaaaaatgggtgctgcagttgggcaagattgtgcacttttggaggaggtttgtggatggataaatgcaaaagccactgttccggtgtgggcaaaaatgactcctaacatcactgacattacacagccagctagggtggctctgagttcaggatgtgagggggtgtctgctattaacacgatcatgagtgtgatggggatcaatctcaacaccttacgtcctgagccttgtgttgagggatactcaactcctgggggctattcttgcaaggcagtccatcccatagcactgggaaaagtgatgagcattgcaaaaatgatgaaggctgaatttggtgaggactactcgctctctggtattggaggtgttgagacaggtggtgatgctgccgaatttattcttcttggagcaaacactgttcaggtatgcactggtgttatgatgcacggttatggccttgtgaagaaactttgctctgagctaaaagatttcatgaaaatgcacaatttctcatccatagaagatttcagaggggcttctcttgaatactttacaacgcacacagatttggtacaaaggcagcaagaagcaattcggcagaggaaagccataaggcaagggttacagtctgacaaagactggacaggagatggctttgtgaaagaaagtgagagcatggtttctaactgaagtcttctactttgttggaattgccctgatctttgatggatcaaaagcaaacaaataggaaggtgaacttgatgtatgctgttgattatacctttgttcacatggaaaacactgattagtgaaagaagctcccgaagaacaaatacacttctaattgcatgatcatcctatttagatgctttgtaactgtgtcgtgctatctaatgatac

SEQ ID NO: 1460 - DNA, 1571 bp, Fagus grandifolia
ctggaccttggctgtcactcagttatacacattcagattccaccgtccatactcaccacacttcctcctttcttcgtttgtcttttttatttcctgtcattattaactgattctgaatctctctgataatcagcctcagccaaagccaaacccaattatttccctgaattaactctgaaaaattttgaagtttgatccatggcgtcactgaatttgactcaggtcaggggcaagaactttgtaccggctgagttcgccaggactcgtcctagctggaatcgacccagtagagttgggttcaagctgtttgcgtcggagagtcaggcggagcctgatcttagcgtgactgtaaatgggttgcacatgccaaacccattcgttattgggtcaggtccgcctgggactaactacaccgtcatgaagagagcctttgatgagggatggggtgctgtgattgccaaaactgtgtcactggatgctgctaaagttataaacgtgacacctcggtatgcacgtctaagagcagagccaaatgggtcagggaaagccaaaggacaaataattgggtgggagaacatagaattgataagcgatcggcctcttgaaactatgttgaaagaattcaagcaattgaaggaagagtatccagataggattctcattgcttcaattatggaggaatataacaaagctgcttgggaggaacttattgacagagttgagcaaactggaattgatgccatagaagtcaatttctcatgtccccatggtatgccagagcgcaaaatgggtgctgcagttggccaagattgtgcccttttagaagaggtttgtggatgggtaaatgccaaagctacagttcctgtttgggccaagatgactcctaacatcactgatatagcactgccagcaagggtggctctaagatcaggatgcgaggggatagctgctattaacacaataatgagtgtaatgggaataaatctcgacaccttacgtccagagccttgtgttgagggatactcaactcctgggggctactcttccaaggccgttcatcctattgcccttgcaaaagtgatgagtattgcaaagatgatgaagtcagagtttggtgacaaggaccactcgctgtctggtattggaggtgttgagacaggtggtgatgctgcagaatttattcttcttggagcaaattctgttcaggtctgtactggggttatgatgcacgggtatggcgttgtgaagaaactatgttctgagctgaaggattttatgaaagcacacaatttctcatcgatagaagatttcaggggggtttctcttcaatattttactactcacacggatttagtacgaaggcaaaaagaagcaattgaacagaggaaagctgtacggaaaggtttacagtccgacaaagattggactggagatgggtttgtgaaagagactgagagcatggtttctaattgaattgtggtaccattgaaaaatttgatgatgaacaaactaggctttcttcgataatgacagtcaaacttgattcttgtgggctttggagcaatgatgtt

SEQ ID NO: 1461 - DNA, 1577 bp, Fagus grandifolia
attatctcttcctttcacctctttctcttctccaaatggcaaagctttccgattaccatcagttgagctccatttgttcaaagtccatacggcgtatcccaaagcatattacaactcatgtacagtcagccaaagccaaagccaaacccaattatttccctgaattaactctagaaaaattttgaagtttgatccatggcgtcactgaatttgactcaggtcaggggcaagaactttgtaccggctgagttcgccaggactcgtcctagctggaatcgacccagtagagttgggttcaaggtgtttgcgtcggagagtcaggcggagcctgatcttagcgtgactgtaaatgggttgcacatgccaaacccattcgttattgggtcaggtccgcctgggactaactacaccgtcatgaagagagcctttgatgagggatggggtgctgtgattgccaaaactgtgtcactggatgctgctaaagttataaacgtgacacctcggtatgcacgtctaagagcagagccaaatgggtcagggaaagccagaggacaaataattgggtgggagaacatagaattgataagcgatcggcctcttgaaactatgttgaaagaattcaagcaattgaaggaagagtatccagataggattctcattgcttcaattatggaggaatataacaaagctgcttgggaggaacttattgacagagttgagcaaactggaattgatgccatagaagtcaatttctcatgtccccatggtatgccagagcgcaaaatgggtgctgcagttggccaagattgtgctcttttagaagaggtttgtggatgggtaaatgccaaagctacagttcctgtttgggccaagatgactcctaacatcactgatatagcactgccagcaagggtggctctaagatcaggatgcgaggggatagctgctattaacacaataatgagtgtaatgggaataaatcttgacaccttacgtccagagccttgtgttgagggatactcaactcctgggggctactcttccaaggccgttcatcctattgcccttgcaaaagtgatgagtattgcaaagatgatgaagtcagagtttggtgacaaggaccactcgctgtctggtattggaggtgttgagacaggtggtgatgctgcagaatttattcttcttggagcaaatactgttcaggtctgtactggggttatgatgcacgggtatggcgttgtgaagaaactatgttctgagctgaaggattttatgaaagcacacaatttctcatcgatagaagatttcaggggggtttctcttcaatattttactactcacacggatttagtacgaaggcaaaaagaagcaattgaacagaggaaagctgtacggaaaggtttacagtccgacaaagattggactggagatgggtttgtgaaagagaccgagagcatggtttctaattgaattgtggtaccattgagaaatttgatgatgaacaaactaggccttcttcgataatgaaagtcaaacttgattcttgtgggctttggggcaatgatgttgggtttttg

SEQ ID NO: 1462 - DNA, 1554 bp, Euonymus alatus
ataataatgttcttatcacgagcataaagacgcaacgttcctttgaatccgggtttttgatatcatacgattactcaatcagattaaaaaatctcatttttttattcattctgattgattttcacttcgtgaactctgaactttcaattcttgatccacatggcgtcgctgagtttgacccagttcagaggcaggaactcggtggctgatattgttcggattcggccttctccgtctgtgaatcggcatggtcgagttgggtttttgagggtggttgcgtcggacactcaggcggagcctgatttgagtgtgactgttaatgggttacacatgcccaatccatttgtgatcgggtcgggtcctcccggaacaaactacacggtcatgaagcgcgcctttgatgaaggctggggtgctgttattgcaaaaacggtatcactagatgcagcgaaagttataaatgtaactcctcgatatgccagactacgagctggtgcaaatggttcagccaaagggcagattattgggtgggagaatatagaactaattagtgacaggccttttgagactatgttgaaagaattcacacaattgaaaaaagaatatcctgatcggattctcattgcttctattatggaggaatacaacaaagctgcgtgggaggaaattattgatcgtgtcgagcaaactgggattgatgccattgaaatcaatttctcgtgccctcatggcatgcctgagcgcaaaatgggtgctgcagtaggtcaagactgtgccttgttggaagaggtttgtggatggataaatgcaaaagctactgttcctgtgtgggcaaagatgactcctaacatcacagatattactcagccagctagggtgtctctaaagtcaggatgtgagggaatagctgccattaacacaatcatgagtgtgatgggcatcaaccttaataccctacgtccagagccctgtgtggaaggatactcaactcctggtggttattcttccaaggcagtccatcctattgcccttgcaaaagttatgagtattgcgaaaatgatgaagacagaatttaacaataaggattattcactttctggtattggaggtgttgagacaggtggtgatgctgctgaatttattcttcttggagcaaacacggtccaggtttgcactggtgttatgatgcatggctatggcctcgtgaagaaactttgtgcagagctgaaggatttcatgaaaatgcacaacttcacatgcgtggaagatttcagaggggcatcactcgagtattttactactcatatggatttggtacaaagacaacaagaagcgattcaacaaaggaaagctatcagaaaaggtctgcagtctgataaagattggacaggagatggttttgtgaaagagtccgaaagtatggtttctaattgacatgtacaaactctagctatcccactcgcgtatgactaaaataaatggttttacttgtgtttcttctgatttgaatgaactgaagaatttttttaaggttgcttgatagcgttttctgac

SEQ ID NO: 1463 - DNA, 1566 bp, Gossypium raimondii
aaaaagtcaaaaatacaactcagactcctagaatatcctcgttgtctggtttccacaatattacgattcagattcactctttttttcttttctaaaaaaggactctcatcttcatccatccatccttcgttagacatccatggcttcgctcaagttcagccacagcaacggcaacccatttgctgtcactcgccatgttactcccaggtcgactcggcccactcggataggatttaagatttttgcttctgataatcattctgaacctgatttgagtgtttgcgttaatgggctgcaaatgcccaacccttttgtaatcgggtcgggtcctcccggtacaaattatactgtgatgaagagagcgtttgatgaaggctggggcgctgtgattgccaaaactgtgtcgctagatgctgccaaggttatcaacgtaactccaaggtatgcccggctacgagcaggagctaacggctctgccaaaggacagataattgggtgggagaacattgaattaatcagtgaccgccctcttgaaactatgttaaaagaatttaagcaactgaaaaaagagtatccagacaggattctgattgcctccattatggaggaatataacaaagctggctgggaagaacttattgatcgagtagagcaaactgggattgatgccattgaagttaatttctcatgccctcatggcatgcctgagcgtaaaatgggtgcagcagttgggcaagattgtgcactattggaggaagtttgtggatggataaatgcaaaagctactgttcctgtatgggcgaagatgactcctaacatcaccgacatcacaatgccagcaagggtggctttgagttcaggttgtgagggggtagctgctataaatactatcatgagtgtgatgggaatcagtcttgatactttacggccagagccctgtgttgagggctactcaactcctgggggttattcttgcaaagcagtccatcctattgcacttgctaaagtgatgagcattgcaaaaatgatgaagtcagagtttaatgacaaggattactcactttcgggcattgggggtgttgagacggggggtgatgctgctgagtttattcttcttggtgcaaatactgtccaggtctgtactggtgttatgatgcatggctatggccttgtgaagaaactctgtgaagagctcaaggattttatgaagaagcacaatttcaaatcaatagaagatttcagaggggtttcccttcagtattttacgactcatacggatttagtgcggaggcagcaagaagcaatacgagagaggaaagctatcaagaaaggtttgcagtccgacaaggaatggaccggagatggcttcgtgaaagagactgagagcatggtttccaattaattgcagtaccaaagtaaggcttctccagcgaatagtgaaaaacagatggtttttagttatgtttggttgcattgtagaaatggttaatcatctgaatgattgaaggtgccgatgtaaaaactaaggttatttaataaaggaagtgcataatgattttgaataag

SEQ ID NO: 1464 - DNA, 1578 bp, Gossypium hirsutum
ctgcaaaaagtcaaaagtacaactcagactcctagaatatcctcgttgtctggtttccacaatattacgattcagattcactctttttttcttttctaaaaaaggactctcatcttcattcatccatccttcgttagacatccatggcttcgctcaagttcagccacagcaacggcaacccgtttgctgtcactcgccatgttactcccaggtcgactcggcccactcggataggatttaagatttttgcttctgataatcattctgaacctgatttgagtgtttgcgtgaacgggctgcaaatgcccaacccttttgtaatcgggtcgggtcctcccggtacaaattatactgtgatgaagagagcgtttgatgaaggctggggcgctgtgattgccaaaactgtgtcgctagatgctgccaaggttatcaatgtaactccaaggtatgcccggctacgagcaggagctaatggctctgccaaaggacagataattgggtgggagaacattgaattaatcagtgaccgccctcttgaaactatgttaaaagaatttaagcaactgaaaaaagagtatccagacaggattctgattgcctccattatggaggaatataacaaagctggctgggaagaacttattgatcgagtagagcaaactgggattgatgccattgaagttaatttctcatgccctcatggcatgcctgagcgtaaaatgggtgcagcagttgggcaagattgtgcactattggaggaagtttgtggatggataaatgcaaaagctactgttcctgtatgggcgaagatgactcctaacatcaccgacatcacaatgccagcaagggtggctttgagttcaggttgtgagggggtagctgctataaatactatcatgagtgtgatgggaatcagtcttgatactttacggccagagccctgtgttgagggctactcaactcctgggggttattcttgcaaagcagtccatcctattgcacttgctaaagtgatgagcattgcaaaaatgatgaagtcagagtttaatgacaaggattactcactttcgggcattgggggtgttgagacggggggtgatgctgctgagtttattcttcttggtgcaaatactgtccaggtctgtactggtgttatgatgcatggctatggccttgtgaagaaactctgtgaagagctcaaggattttatgaagaagcacaatttcaaatcaatagaagatttcagaggggtttcccttcagtattttacgactcatacggatttagtgcggaggcagcaagaagcaatacgagagaggaaagctatcaagaaaggtttgcagtccgacaaggaatggaccggagatggcttcgtgaaagagactgagagcatggtttccaattaattgcagtaccaaagtaaggcttctccagcgaatagtgaaaaacagatggtttttagttatgtttggttgcattgtagaaatggttaatcatctgaatgattgaaggtgcggatgtaaaaactaaggttatttaataaaggaagtgcataatgattttgaataagattaggtt

SEQ ID NO: 1465 - DNA, 1840 bp, Ricinus communis
aaactggagtcctagtcttgatgacagtgagtcatatcagctgcaaaagtctgatccacgtcagtctctttggtgatcttgccgagagacaaaatccacatgcgattcaataattctgaatagaatattcaatcgattcatctgaatccttattctgcttacttactcatagtatgacattttaattcagattcaatcaagaaaaccatttttcttgactacccatctttcttatcatcattctctacccagtttcagaattaagagaaagacacaagtaatttgtcttgatcacccattaatggcttctctgagtttgacccagatcagaggcaagaattcggttgctgagcttgctgctttgagccgtccttgtttcttggcaactcagcgtcttaaaaacagagttggagtgttgagagtggcgtctgatgcttctgagactaaggtagaacccgatttgagtgtcactgtaaatggattaaaaatgcccaacccgtttgttattgggtccggtccacctggcaccaactatacagtcatgaagcgtgcctttgatgaaggatggggtgctgtaatcgctaaaactgtgtcactagatgcagaaaaagttattaatgtaaccccaagatatgcacggctccgagcaggtgttaatggctcagccaaagggcagataattggttgggagaatatagaactcataagtgaccgtcctcttgaaaccatgctgaaagaatttaaacaattgaaagaagaatacccagaacggatcctcattgcttctatcatggaggaatatgacaaagctgcttgggaagaacttattgatcgagtagagcaaactggaattgatgccattgaagtcaatttttcatgtcctcatggtatgcctgaacgtaaaatgggtgctgcagttggccaagactgtggacttttagaagagatttgtggatgggtaaatgcaaaggctactgtcccagtatgggcaaagatgactcctaacatcactgacataacagagccagctagggcagcactcagatcaggatgtgaggggatttctgccattaacacaatcatgagtgtaatgggaatcaatttgaaaaccttacggccagagccctgtgttgagggatactcaactcctggtggttattcttctaaagcagtccatcctattgcacttgggaaagttatgaatattgccaagatgatgaaatctgaatttaatatcgatcagtactcactttctggtattggaggcgtcgaaactggcagtgatgctgccgaatttattcttcttggagcaaatacagttcaggtctgcaccggggttatgatgcatggatatggcctagtgaagaaactcaatgatgaactgaaggattttatgaaaatgcacaacttctcttctattgaagacttcagaggggtatctctcgattatttcacaactcatacagatttggttcgccggcaaaaagaagcaattgaacagaggaaagctgtcaaaaggggtctgcagtctgataaagactggacaggagatggttttgtaaaagagtcagagagcatggtttccaattaatttaccacagtatagtaagttttctctgttgtacgaccgaaataagttggatagctacctcatgttcttttgatacctgaaacaaggagattattacagtaataattaggttgctatttggtgattgtccttttattgtatagaaaaatctgaaactgccacattaaaatggaattaaatgtccctggagtttatacatgtcatatctttatgagaatgagactgtttgtgtccaattctcctttactg

SEQ ID NO: 1466 - DNA, 1761 bp, Populus trichocarpa
cagacaagggaggtcaataacgacaagcagtagaatattcaaaacaaaaccactaaaatcaaatacagatactacaaaagacgcaatcgattcctctgaattatcccatactgaatcgtattaactcagattcaatcacactctttcccatctccgttttcatttaataaaacatttaactaccgaaaacaattctgtatcttctttctctttcttggttgattagttatggcttctttgagtttgacccagatcagggggagcaattctgttactgagtttactcggctccgtttgaaaactcaacgtggcaggagtaaaatcgggttcttgaaggtggtgggttctcaaggacagaatcagggagagcctgatttgagtgtcactgtaaatgggttacatatgcctaacccgtttgttattgggtctggtccacctggtaccaattatactgtcatgaaaagggcttttgatgaaggctggggtgctgtcattgctaaaactgtgtcactagatgcagcgaaagttataaatgtaactcctcgatatgctaggctacgagctggtgcaaatggctcggccaaggggcaaattattggttgggagaatatagaactcataagtgaccggcctcttgaaacaatgttgaaagaatttaagcaattaaaagaagaatatcctgataggattctcattgcttcaatcatggaggagtataacaaagctgcatgggaggaacttattgaccgagtagagcaaactggaattgatgctttagaaatcaacttctcatgtcctcatggtatgcctgagcgtaaaatgggtgctgcagttggccaagattgtgcattgttggaagaggtttgtggctggattaatgcaaaagctactgtcccagtatgggcaaagatgactcctaacatcaccgacataacacagcctgctagggtgtcactaaaatcaggatgcgagggagtggctgctattaacaccatcatgagtgtaatgggaataaatctgaaaactttacggccagagccttgcgtcgaaggatattcaactcctgggggttactcttccaaagcagtccaccctattgcacttgggaaagtaatgaatattgccaaaatgatgaaatcagaatttgatttggagcaatactcactttctggtattggaggtgttgagacaggcagtgatgctgctgaatttattcttgttggagcaaatacagttcaggtatgcactggagttatgatgcatggatatggtcttgtgaagaaactctgcgatgagctgaaggattttatgaaaatgcacaacttctcatcaatagaagatttcagaggagcatctctcgagtatttcacaacgcacatggatttggtgcgccggcaacaagaagcgatacaacagaggaaagctatcaagaaaggtttgcagtctgacaaagattggactggggatggttttgtgaaagagaccgagagcatggtttctaactaaactgaaaaatgaaagcaagtctctctgtacaataaaaataaatgggatttcatcccaccttatgttgatagtttgatagttgaactttgttgttgtttgaatcgagaacagcttaaagcacatgaatttctcagttgcaaatgaaataacctgtgtcatgtttgtcatttctgtttatctaaagtaactcatgaaagccagtagcatcaacagtgaatattatatacatgcccagaaagtcttgcatgcctcttg

SEQ ID NO: 1467 - DNA, 1494 bp, Tropaeolum majus
attttaatccgcgatctctccgatcccaaagaatcttttgtgtctcagattcaattttgcttttatcaacttcatcatcatcatcagaaatacactacacagattgattatcaatggcttcaatgactttgaatttgtcccgtattggaagtggaaaccgcaactcggttgctgagttcgcagcaactcgccagctcagttcaactttttctcgaccgaatagagttgggttcagggtttttgcttctcaggatcaaagggagcctgatttgagtgtcactgtaaatggcatgcatatgcctaatccgttcgttattggatcgggtccaccaggaactaattatactgttatgaagagagcctttgatgaaggttggggtgctgtgattgctaaaactgtgtcacttgatgcagcaaaagtagtgaatgttactcctcgatatgcccggcttcgagctggtgcaaatggctcagccaaaggacaaattattggatggcagaacatagagttaataagcgaccgacctcttgaaactatgctgaatgaattcaaacagctaaaaaaggaatatccagataggattctcattgcctcaataatggaggagtataataaatctgcttgggaggaacttgttgatcgagttgagcaaactggaattgatgcgattgaagtcaatttctcatgccctcacggcatgcctgagcgaaagatgggtgctgcggttgggcaagactgtatgctgttggaagagatttgtggatggataaatgcaaaagctactgttcctgtatgggcaaaaatgactcccaacatcactgacatcacagagccagctagggtttccctgcggtcaggatgtgagggggttgctgccattaataccatcatgagtgttatgggaattgatctcaagaccctacgtcccgagccttgtgttgagggctattcgactcctggtgggtactcttgcaaggctgtccaccctattgctctggcaaaagtaatgaatatcgccaaaatgatgaaatctgaattcaatgacagagactactcactttctggtattggaggcgtggaaactggcagtgatgctgctgagtttattcttctcggagcagatactgttcaggtctgtactggtgttatgatgcatggctacggccttgtgaagaaactttgtgacgagctgaaggaattcatgaaaacacacaatttctcgaaaatagaagacttcagaggggcgtctcttgattatttcacgacacacaccgatctagtacgaagacagcaagaagcgattcagaagaggaaagcaattaagaaagggctgcagtctgacaaagactggaccggagatggattcgtgaaagaaacggagagcatggtttcaaactgaaactgtaaagcacaaaatctgtttttttttacttaaatgttggatattctaaggagtaatgttaataaatgaatattagaacaaatcagtttaa

SEQ ID NO: 1468 - DNA, 2523 bp, Arabidopsis thaliana
atgtctattgcatcatcacttacttcagccacactttgcggcgcctcagtttttcctaaagcattagcctgcagctctgagttccctatcaatcttcccagcccttttgaaagttcaaagatttgtttgacttcgtttcctgcctctagggatctcaagaaaaatgctactttgaatctgactcgaaatgttggtccagtcaggtgtcatgctatgcaagctgggacgagggagttgaagaaatttgaacttagtgatgtgattgaagggaaacagtttgatagagagatgctaagcgctatattcgatgttgcacgcgaaatggaaaagatagaaaagagctcttcacaaagtgaaatcctcaagggttatttaatggctaccctcttttatgagccttctacccgtaccaggctttcatttgaatctgctatgaaacgccttggaggtgaagtcttaactactgagaacgctagagagttttcgtctgccgcgaaaggggaaacacttgaagacacaataagaacagtggagggttattcagatataattgtgatgcgacattttgaaagcggtgctgcaagaaaagctgcagctactgccaatatacctgtcattaatgcaggtgatggtcctggagagcatcctactcaggctctattggacgtctataccatccaaagtgaaattggaaaattagatggcatcagtgtagccttagttggagaccttgccaacggaaggactgtgcggtctcttgcatacttgcttgccaagttcaaagacgtgaagatctactttgtttcccctgaaattgtgaaaatgaaggatgatataaaagactatttgacatcaagcggggttgaatgggaagaaagttcagatttaatggaagtagcatccaagtgtgatgtagtttatcaaacacgaatccaaagagagaggtttggagaaaggctggacctttacgaagcagctcgtgggaagtatatcgtagacaaggatctgttaggagtgatgcagaaaaaagctattatcatgcatcctttaccgagattggatgaaatcaccgcagatgttgatgctgatccaagagctgcctacttcagacaagcaaagaacggtttgttcattagaatggctcttctaaagctactgcttgtcggttgtttttttattgaatttggaaggatgattgggaatccagtaattcaagttccatcatcactaatgccatcatcctccatgattgcttgtcctcgagtttcacccaatggggttccttatcttccaccaaaacctagaactaggcatttagtggtcagagctgcatccaattccgatgctgctcatggtcaaccatcgtctgatggggggaagaatcctctcaccgttgttttggatgtgcccaggaatatatggagacagactttaaaacctttgagtgattttgggtttggtaagagaagtatttgggaaggtggtgttggtttgtttattgtctctggagctactcttcttgctcttagctgggcttggttgcgaggttttcaaatgcggtcgaagtttaggaaatatcagactgtgtttgagcttagtcatgcttctggtatttgcacgggaacaccggttaggatccgtggggttactgttggtacgattatccgtgttaatccttccttgaagaatattgaagctgttgctgagatagaagatgataagattattatcccgaggaattcattggttgaggtgaatcagtctggtcttctaatggaaactatgatcgacattatgcctaggaatccgataccagaaccttcagtaggacctctgcatcctgaatgtggtaaggaaggtctgatcgtttgtgataggcagacaataaaaggagtgcaaggagttagtttagatgaattagttggaattttcactcgtattggacgcgaagttgaggccattggtgttgccaatacgtattcgcttgctgagagagctgcttcggttattgaggaagcaaggccattgctcaaaaagattcaagccatggctgaagatgctcaacctttgctctctgagtttcgtgatagcggcttgctcaaggaagttgagtgtcttactcgaagccttacccaagcttctgacgatttgagaaaggttaattcgtcaattatgactcctgagaatacagaactcatacagaagtcaatctacactctggtttatactttgaagaacgtcgagagtataagctcagatattctgggattcacaggagatgaagccacaagaaaaaaccttaaactactcatcaaatccctaagcaggctactatgatcagcctgtagattttagactggataaataaaatccagaattttatggtaagcaagttttaaaaattcgaaaaatgtgttgtttcttctttagagttatttttgttttcgttttgtgttctgagattggggtttaatggagagacataattcagtttttataagaacaaaaatgtttgtttctcca

SEQ ID NO: 1469 - DNA, 1526 bp, Arabidopsis lyrata
gcgtttcgttttttccctcccctaatattccaaaacgtcttgaattcatcatcattactagtttcctttccttactaaaaccctacgctcctccggccgccgttgattttcccgcggccgtttccgccgtcaatctccgatttaagcagctgattgaggctaattccttctttttttgtgctcatcgctaccggcgttagatcgaccagccagactctacctcatttgactgctctgctgattcaatcgctctttcagattctacaagttgtgactcagtacctccctgcaacgaattagcatcccgccagaatgtctattgcgtcatcactttcttcagccacactttgcggcgcctcagtttttcctaaagcattaggctacagctctgagttcccaagcaatcttcccagtccttctgaaagttcaaagatttgtttgacttcatttcctgcctctagggatcccaagaaaaatgctacttggaatctaacccgaaatgttggtccgatccaaggaatcaggtgtcatgctatgcaagctgggacgagggaattgaagaaatttgaacttagtgatgtgattgaagggaaacaatttgatagggagatgctaagcgctatattcgatgttgcacgagaaatggaaaagatagaaaagagctcttcccaaagtgaaattctcaagggttatttaatggctaccctcttttatgagccttctacccgtaccaggctttcatttgaatctgccatgaaacgccttggaggtgaagtcttaactactgagaacgctagagagttttcgtctgccgcgaaaggggaaacacttgaagacacaataagaacagtggagggttattcagatataattgtgatgcgacattttgaaagcggtgctgcaagaaaagctgcagctactgccaatatacctgtcattaatgcaggtgatggtcctggagagcatcctactcaggctctattggacgtctataccatccaaagtgaaattggaaaattagatggcatcagtgtagccttagttggagatcttgccaacggaaggacagtccggtctctggcatacttgcttgccaagtttaaagacgtgaagatctactttgtttcccctgaaattgtgaaaatgaaggatgatataaaagactacttgacatcaaacggggtcgaatgggaagaaagttcagatttaatggaagtagcatccaagtgtgatgtagtttatcaaacccgaatccaaagagagaggtttggagaaaggcttgacctttacgaagcagctcgtgggaagtatatcgtagacaaggatctgttaggagtaatgcagaaaaaagctattatcatgcatcctttaccgagattggatgaaatcactgcagatgttgatgctgatccaagagctgcctacttcagacatgctgatccaagagctgcctacttcagacaagcaaagaacggtttgttcattagaatggttcatggtcgttaagttaaatcctttagtgaact

SEQ ID NO: 1470 - DNA, 1689 bp, Arabidopsis lyrata
tcccctaatattccaaaacgtcttgaattcatcatcattactagtttcctttccttactaaaaccctacgctcctccggccgccgttgattttcccgcggccgtttccgccgtcaatctccgatttaagcagctgattgaggctaattccttctttttttgtgctcatcgctaccggcgttagatcgaccagccagactctacctcatttgactgctctgctgattcaatcgctctttcagattctacaagttgtgactcagtacctccctgcaacgaattagcatcccgccagaatgtctattgcgtcatcactttcttcagccacactttgcggcgcctcagtttttcctaaagcattaggctacagctctgagttcccaagcaatcttcccagtccttctgaaagttcaaagatttgtttgacttcatttcctgcctctagggatcccaagaaaaatgctacttggaatctaacccgaaatgttggtccgatccaaggaatcaggtgtcatgctatgcaagctgggacgagggaattgaagaaatttgaacttagtgatgtgattgaagggaaacaatttgatagggagatgctaagcgctatattcgatgttgcacgagaaatggaaaagatagaaaagagctcttcccaaagtgaaattctcaagggttatttaatggctaccctcttttatgagccttctacccgtaccaggctttcatttgaatctgccatgaaacgccttggaggtgaagtcttaactactgagaacgctagagagttttcgtctgccgcgaaaggggaaacacttgaagacacaataagaacagtggagggttattcagatataattgtgatgcgacattttgaaagcggtgctgcaagaaaagctgcagctactgccaatatacctgtcattaatgcaggtgatggtcctggagagcatcctactcaggctctattggacgtctataccatccaaagtgaaattggaaaattagatggcatcagtgtagccttagttggagatcttgccaacggaaggacagtccggtctctggcatacttgcttgccaagtttaaagacgtgaagatctactttgtttcccctgaaattgtgaaaatgaaggatgatataaaagactacttgacatcaaacggggtcgaatgggaagaaagttcagatttaatggaagtagcatccaagtgtgatgtagtttatcaaacccgaatccaaagagagaggtttggagaaaggcttgacctttacgaagcagctcgtgggaagtatatcgtagacaaggatctgttaggagtaatgcagaaaaaagctattatcatgcatcctttaccgagattggatgaaatcactgcagatgttgatgctgatccaagagctgcctacttcagacatgctgatccaagagctgcctacttcagacaagcaaagaacggtttgttcattagaatggttcatggtcgttaagttaaatcctttagtgaactgaatctcaagcctatcatcagcacaaggactctgcaataataaaacccgaagctttagggatttttgagtgttaagcacaaaagcggtgtgatcttgatgttacttaaaagaacaaaaagaaggatctgttggtttgttggttaaaagactgatatgaggaagagttgttgaactttatg

SEQ ID NO: 1471 - DNA, 1307 bp, Eutrema halophilum
agattctggaagttgtctctaagcaaatcccttcaacgaatcagcttcctatcagaatgtctatcacatcattacttacttcagccacactttctggtgcctcagtgtttcctaagtcactagcctgcagcactgacttctcaagcaatctctcaagtccctttgacagttcaaagatttgtttgacttcatttcctgcctctaggaatcccaagaaaaatgctacttggaatctgaccccaaacactgctccgatccaaggtatcaggtgtcatgctatgcaagttgagacgagggaatcgtttacggctgggaagaaatttcaacttagtgatgtgattgaagggcaacagtttgatagggagatgctaagtgctatattcgatgttgcacgcgaaatggaaaagatagaaaagagctcttctcagagtgaaatactcaagggctatttaatggctacgctcttttacgagccttctacacgtaccaggctctcgtttgaatctgccatgaaacgcttgggaggggaagtcttaactactgagaacgctagagagttttcgtctgctgccaaaggggaaacacttgaagacaccataaggacggtggagggttattcagatataatcgtgatgcgacattttgaaagcggtgctgcaagaaaagctgcagctactgctaacatacctgtcattaatgcaggtgatggccctggagagcatcctactcaggctctcttggacgtgtataccatccaaagtgaaatcggaaaactggatggcatcagtgtagccttagttggagatcttgccaatggaaggacagtccggtcgcttgcatacttgcttgccaaatttaaagacgtgaagatctactttgtttcccctgaaattgttaagatgaaggatgatataaaagactatttgacatcaaatggggtcgaatgggaagaaagttcagatttaatggaagtagcatccaagtgtgacgttgtttatcaaacccgaatccagagagagcggttcggagaaaggcttgacctttatgaagcagctcgtgggaagtatatcgtagacaaggatctgttaggagtgatgcagaaaaatgctgttatcatgcatcctttaccgagattggatgaaatcactccagatgttgacgctgatccaagagctgcctacttcagacaagcaaagaacggtttgtttattagaatggctcttctaaagctcctgcttgttggctggtgatggatgatcctcaaggtatatcctgaaatgaactgaatctcaagtttgtgacaagag

SEQ ID NO: 1472 - DNA, 2624 bp, Eutrema halophilum
tcttagcagattctggaagttgtctctaagcaaatcccttcaacgaatcagcttcctatcagaatgtctatcacatcattacttacttcagccacactttctggtgcctcagtgtttcctaagtcactagcctgcagcactgacttctcaagcaatctctcaagtccctttgacagttcaaagatttgtttgacttcatttcctgcctctaggaatcccaagaaaaatgctacttggaatctgaccccaaacactgctccgatccaaggtatcaggtgtcatgctatgcaagttgagacgagggaatcgtttacggctgggaagaaatttcaacttagtgatgtgattgaagggcaacagtttgatagggagatgctaagtgctatattcgatgttgcacgcgaaatggaaaagatagaaaagagctcttctcagagtgaaatactcaagggctatttaatggctacgctcttttacgagccttctacacgtaccaggctctcgtttgaatctgccatgaaacgcttgggaggggaagtcttaactactgagaacgctagagagttttcgtctgctgccaaaggggaaacacttgaagacaccataaggacggtggagggttattcagatataatcgtgatgcgacattttgaaagcggtgctgcaagaaaagctgcagctactgctaacatacctgtcattaatgcaggtgatggccctggagagcatcctactcaggctctcttggacgtgtataccatccaaagtgaaatcggaaaactggatggcatcagtgtagccttagttggagatcttgccaatggaaggacagtccggtcgcttgcatacttgcttgccaaatttaaagacgtgaagatctactttgtttcccctgaaattgttaagatgaaggatgatataaaagactatttgacatcaaatggggtcgaatgggaagaaagttcagatttaatggaagtagcatccaagtgtgacgttgtttatcaaacccgaatccagagagagcggttcggagaaaggcttgacctttatgaagcagctcgtgggaagtatatcgtagacaaggatctgttaggagtgatgcagaaaaatgctgttatcatgcatcctttaccgagattggatgaaatcactccagatgttgacgctgatccaagagctgcctacttcagacaagcaaagaacggtttgtttattagaatggctcttctaaagctcctgcttgttggctgctcggaaaaattggaactttactgcataaagtttagttttttaattttgattttggagatgattgggaatccggtaattcaagtcccatcatcactaatgccatcatcttccatgattgcttgccctcgagcttctcccaatgggcttccttatctcccaccgaaacctagaactaggcatttactggtcagagctgcatccaattccgacgccggacatactcaaccatcgtctgatgaagggaagaatccgctcacggttgttttggatgtgcctaggaatatatggagacagactttaagacctctgagtgattttgggtttggtaagagaagcgtttgggaaggtggagttggtttgtttatcgtctctggagcaacacttcttgctcttagctgggcttggttgcgagggtttcaaatgcggtccaagttcaggaaatatcagaccgtgtttgagcttagtcaagcctctggcatatgcacgggaacaccagttaggatccgtggtgtgaccgttggtacggttattcgtgttaatccttccttgaagaacattgaagctgttgctgagattgaggatgataagattatcatccctaagaattcactggttgaggtgaatcagtctggtcttctaatggaaactatgatcgacataacgccgagggatccaataccggaaccttcaatagggcctctgcatccggattgtggtgaagaaggtctgattgtttgtgataggcagaagataaagggagagcaaggagtgagtttagatgcactagttggaatattcactcgtattggacgtgaagtagaggagattggtgttgctaatacttattcgcttgctgagagagctgcgtcagttattgaagaagcaaaaccattgctcagaaagattcaagccatggctgaagatgctcaacctttgctctctgagtttcgtgatagcggcttgctcaaggaagttgagtatctaactcgaagcctgacccaagcttctgacgatttgagaaaggttcattcgtcgattataacacctgagaatacagaactaattcagaagtcaatctacactttggtttacactttgaagaacgtcgagagcataagctcagatattcttggattcacaggcgatgaggccacaagaaaaaaccttaaactgctcatcaaatccctcagtaggctattataatctgcatggagaaacaactaagatttttagcctggttaaaaaaaatgaaggtgagagcaagttgatttgtttttcacaaaaaaaaatgtgtgttcttatttagagaatttatatttcttttaattgaattggattaaaacgagagagtcgaattcagtttatacgaa

SEQ ID NO: 1473 - DNA, 1530 bp, Eutrema parvulum
attctgcaagttgtatctaagcacatcccttcaacaaattagcttcctgccacaatgtctatcacatcatcacttacttcagctaatctttgtggggcctcagtttttcctaaagctttggcctgcagcattgagttcccaagcaatctcgcaagtccttttgagagctcaaagatatgtttgactacatatcccaagaaaaatgctacttggagtctgacccgaaatattgcttcgatccaaggaaccaggtgtcatgctatgcaagttgagacgagggaatcgtttatggctgggaagaaatttcaacttaatgatgtgattgaagggcaacaatttgatagggagatgctaagtgctatttttgatgttgcacgggaaatggaaaagatagaaaagagttcctctcaaagtgaaatactcaagggctatctaatggctaccctcttttacgagccttctacccgtaccaggctctcgttcgaatctgccatgaaacgcctgggaggggaagtcttaactactgagaacgctagagagttttcgtctgctgctaaaggggaaacacttgaagacaccataagaacggtggagggttatacagatataattgtgatgcgacattttgaaagcggtgctgctagaaaagctgcagctactgccaatatacctgtcattaatgcgggtgatggtcctggagagcatcccactcaggctcttctagacgtctacaccatccaacgtgaaattggaaaactagatggcatcagtgtagccttagttggagatcttgccaatggaaggacagttcggtcgcttgcatacttgcttgccaaatttaaagacgtgaagatctactttgtttcccctgaaattgttaagatgaaggatgatataaaagactatttgacatcaaatggggtggaatgggaagaaagttcagatttaatggaagtagcatccaagtgtgacgtagtttatcaaacccgaatccagagagagagatttggagaaaggcttgacctttacgaagcagctcgtgggaagtatatcgtagacaaggcattgttaggagtgatgcagaaaaatgctgttatcatgcatcctttgcccagattggatgaaatcactccagatgttgacgctgatccaagggctgcttacttcagacaagcaaagaacggtttgttcattagaatggctcttctgaagctactgcttatcggttggtgatagatggtctaaaggtataaatcctttgatgaactgaatctcaagcctgtgacacaagagacgtatcatcagtgcaaggatcttgcaataataaaatctgaaactggggtttttttttatgtgtttgtgtacaagagcctgtgatcttgatgttacttgaaagaacataatggtaaaaacagttggtttgttgatcttgacattacattaatccacttaattgtggaagcgtcgttgtcgaacttagtgaataaattgattttgagctattttccccccatttgcggtcaaacgcga

SEQ ID NO: 1474 - DNA, 1267 bp, Eutrema parvulum
tctttgcagatttctggaagttgtacctaagcacatcccttcaacgaagttgcttcctgccagaacatgtctataacatcatcacttactccagccacgctttgtggggcttcggtatttccgaaagctttagcttgcaccacagagttcccaagcaatctctcgagtcctttcgacagttcgaagatttgttttacttcatttcttgtctctaaggagtccaagaaaagtgctacttggagtctgaccagaaatactgctccaatccaaggaatcaggtgtcatgctatgcaagttgagacgagtgaacggtttatggctgggaagaaatttcaacttagtgatgtgattgaagggcaacaatttgataaggagatgctaagtgctatatttgatgttgctcgggagatggaaaagatagagaagagctcttctcaaagtgaaatcctcaagggttatttaatggctaccctcttttacgaaccttctactcgtaccaggctctcgtttgaatctgccatgaaacgccttggaggggaagtcttaactactgagaacgctagagagttttcatctgctgctaaaggggaaacacttgaagacactataagaacagtggagggttattcagatataatcgtgattcgacattttgaaagcggtgctgctagaaaagtagcagctactgccaatatacctgtcattaatgcaggtgatggtcctggagagcatcccactcaggctctcttggacatctataccatccaaagtgaaattggaaaattggatggcatcagtgtagccttagttggagatcttgccaatggaaggacagtccggtcgcttgcgtacttgcttgccaagttcaaagacgtgaggatctatttcgtttcccctgaaattgtgaagatgaaggatgatataaaagactatttaacatcaaatggggtcgagtgggaagaaagttcagatttaatgggagtagcatccaagtgtgatatagtttatcaaaccagaatccaaagagagcggtttggagaaaggcttgacctttacgaagcagctcgtgggaagtatatcgtagacaaggcactgttaggagtgatgcagaaaaaagctgtcatcatgcatcctttaccgagattagatgaaatcactccagatgttgacgctgatccaagagcggcttacttcagacaagcaaagaatggtttgttcattagaatggctcttctgaagctactgcttgtcggttggtgatatgatg

SEQ ID NO: 1475 - DNA, 1312 bp, Eutrema parvulum
ttctggaagttgtacctaagcacatcccttcaacgaagttgcttcctgccagaacatgtctataacatcatcacttactccagccacgctttgtggggcttcggtatttccgaaagctttagcttgcaccacagagttcccaagcaatctctcgagtcctttcgacagttcgaagatttgttttacttcatttcttgtctctaaggagtccaagaaaagtgctacttggagtctgaccagaaatactgctccaatccaaggaatcaggtgtcatgctatgcaagttgagacgagtgaacggtttatggctgggaagaaatttcaacttagtgatgtgattgaagggcaacaatttgataaggagatgctaagtgctatatttgatgttgctcgggagatggaaaagatagagaagagctcttctcaaagtgaaatcctcaagggttatttaatggctaccctcttttacgaaccttctactcgtaccaggctctcgtttgaatctgccatgaaacgccttggaggggaagtcttaactactgagaacgctagagagttttcatctgctgctaaaggggaaacacttgaagacactataagaacagtggagggttattcagatataatcgtgattcgacattttgaaagcggtgctgctagaaaagtagcagctactgccaatatacctgtcattaatgcaggtgatggtcctggagagcatcccactcaggctctcttggacatctataccatccaaagtgaaattggaaaattggatggcatcagtgtagccttagttggagatcttgccaatggaaggacagtccggtcgcttgcgtacttgcttgccaagttcaaagacgtgaggatctatttcgtttcccctgaaattgtgaagatgaaggatgatataaaagactatttaacatcaaatggggtcgagtgggaagaaagttcagatttaatgggagtagcatccaagtgtgatatagtttatcaaaccagaatccaaagagagcggtttggagaaaggcttgacctttacgaagcagctcgtgggaagtatatcgtagacaaggcactgttaggagtgatgcagaaaaaagctgtcatcatgcatcctttaccgagattagatgaaatcactccagatgttgacgctgatccaagagcggcttacttcagacaagcaaagaatggtttgttcattagaatggctcttctgaagctactgcttgtcggttggtgatatgatggatggtcctcaaggtacatcctgtaatgaatttaagtctcaagcccatgacaacag

SEQ ID NO: 1476 - DNA, 1290 bp, Brassica napus
ctcgtagcattgagttcccaagaaaccatctcttgacgcctttcgaaagctcaaagatttgtttgactacacattccagaaaaatgctacttggaatctgaacagaaagattactccgatccaaggaaccaggtgtcatgctatgcaagttgagacgagggaactgtttacagctgggaagaagtttcaacttagtgatgtgattgaagggcaacagtttgacagggagatgctaagtgctatcttcgacgttgcacgagaaatggagaagatagaaaagagctcttctcagagtgaattactcaaaggctatctaatggccaccctcttttacgagccttctacacgtaccaggctctctttcgaatccgccatgaaacgtttgggaggagaagtcttgaccactgagaacgccagagagttttcatctgctgctaaaggggaaacacttgaagacaccataagaacggtggagggttactcagatataatcgtgatgcgacattttgaaagcggtgctgctaaaagagctgcagctactgcaaatatacctgttattaatgcaggtgatggtcctggagagcatcccactcaggcactcttggatatctataccatccaaagtgaaattggaaaactagatgacatcagtgtagctctggttggtgatcttgcaaatggaaggacagtccggtcccttgcgtacttacttgccaaatttaaagacgttaagatctactttgtttctcctgaaattgttaagatgaaggatgatataaaagactatttgacagcaaatggggtggaatgggaagaaagttcagatctaatggaggtagcatcaaagtgtgacgtagtttaccaaacccgaatccaaagagagcgatttggagaaaggcttgacctttacgaagcagctcgtgggaagtatatcgtagacaaggcactgttaggagtgatgcggaaaaatgctgttatcatgcatcctttaccgagattggatgaaataactccagatgtagacgctgatccaagggctgcctacttcagacaagcaaagaacggtttattcataagaatggctcttctgaagctactgcttgtcggttggtaataagattggtctaaggtagaagttcctttagtgaactgaatatcaagcttgtgacacaagagacgtatcgtatcgtcagtgcaaggacccagcaataaataaaatctgaaactcgagtgtgtttagtgtgcttagcagatgttacttcaaagaacataatggtggttggtttgttg

SEQ ID NO: 1477 - DNA, 2070 bp, Arabidopsis lyrata
aaagaaaaaaagaaaagaaagaagagagagaggaagaagaatcgtggagatggcttcgactccgaagcttactagtacaatttcatattctccatctcttcaaatcctctgcaaaaagctcccaatcgcaattcatctaccatcatcatcatcatcatcttcttcctctagctttctctcactccctaaaaccctaacctctctctattctctgcgtccccgtatcgccgtactctcaaaccaccggtattaccactctcgccggttttctgttcgtgccagtaccgataatggagctgactccgagcgccactacgattttgatctcttcactatcggtgctggaagcggcggcgtccgcgcttctcgcatctcaactagcttcggtgcatccgccgccgtttgcgagcttcctttttccaccatctcctctgatacagctggaggcgtcggaggaacgtgtgtactgagaggatgtgttccaaagaagttgcttgtgtatgcgtccaaatacagtcacgagtttgaagacagtcatggatttggttggaagtatgagactgagccttctcatgattggactactttgattgctaacaagaatgctgagttgcagcggttgactggtatttataagaatatacttagcaaagctaatgtcaagttgattgaaggtcgtggaaaggttatagacccacacactgttgatgtagatgggaaaatctatactacgaggaatattctgattgcagttggtggacgtccgttcattcctgacattccaggaaaagagtttgctattgattctgatgccgctcttgatttgccttccaagcccaagaaaattgcaatcgttggtggtggctacatagccctggagtttgcaggcatctttaatggtcttaacagtgaagttcatgtatttataaggcaaaagaaggtgctgaggggatttgatgaagacgtcagggattttgttggagagcagatgtctttaagaggcattgagtttcacactgaagaatcccctgaagccatcatcaaagctggagatggctcgttgtctctgaagaccagcaagggaactgttgagggattttcgcatgttatgtttgcaactggtcgcaagcccaacacaaagaacttagggttggagaatgttggcgtaaaaatggcgaaaaatggagcaatagaggttgacgaatattcgcagacctccgttccatccatttgggctgttggggatgtcactgaccgaatcaatttgactccagttgctttgatggagggaggtgcattggctaaaactttgtttcaaaatgagccaacaaagcctgattatagagctgttccttgcgccgttttctcccagccacctattggaacagttggtctaaccgaagagcaggccatagaacaatatggtgatgtcgatgttttcacatcaaactttaggccattaaaggctacgctttcaggacttccagaccgggtgttcatgaaactcattgtctgtgcaaacaccaataaagttctcggtgttcacatgtgtggagaggattcaccagaaatcatccagggatttggggttgcagttaaagctggtttaactaaggccgactttgatgcaacagtgggtgttcaccccacagcggctgaggagtttgtcactatgaggactccaaccaggaaaatccgcaaagactcctctgagggaaaggcaagtcctgaagctaaaacagctgctggggtgtagagaaggttgcaaaaaagattgtatttacggcattggagctccctgacaaggagaacattgtgtctgtgaagaagaagaactttttttttttctggcagagaataatttttgataatgtcgcgtggagatatgatcgccgtcctgcaatacttttgatcggttgacctacgcgaccaaattcctcgagagaggttgtaacttatatcgaaagagctctaaaaactgaagctttcagttcttgtgacatcgtaaagaaggctgtatagataaaacagtttcgagtgttctttggatttgtagtttttttcttttct

SEQ ID NO: 1478 - DNA, 2168 bp, Arabidopsis lyrata
taaagaaaaaaagaaaagaaagaagagagagaggaagaagaatcgtggagatggcttcgactccgaagcttactagtacaatttcatattctccatctcttcaaatcctctgcaaaaagctcccaatcgcaattcatctaccatcatcatcatcatcatcttcttcctctagctttctctcactccctaaaaccctaacctctctctattctctgcgtccccgtatcgccgtactctcaaaccaccggtattaccactctcgccggttttctgttcgtgccagtaccgataatggagctgactccgagcgccactacgattttgatctcttcactatcggtgctggaagcggcggcgtccgcgcttctcgcatctcaactagcttcggtgcatccgccgccgtttgcgagcttcctttttccaccatctcctctgatacagctggaggcgtcggaggaacgtgtgtactgagaggatgtgttccaaagaagttgcttgtgtatgcgtccaaatacagtcacgagtttgaagacagtcatggatttggttggaagtatgagactgagccttctcatgattggactactttgattgctaacaagaatgctgagttgcagcggttgactggtatttataagaatatacttagcaaagctaatgtcaagttgattgaaggtcgtggaaaggttatagacccacacactgttgatgtagatgggaaaatctatactacgaggaatattctgattgcagttggtggacgtccgttcattcctgacattccaggaaaagagtttgctattgattctgatgccgctcttgatttgccttccaagcccaagaaaattgcaatcgttggtggtggctacatagccctggagtttgcaggcatctttaatggtcttaacagtgaagttcatgtatttataaggcaaaagaaggtgctgaggggatttgatgaagacgtcagggattttgttggagagcagatgtctttaagaggcattgagtttcacactgaagaatcccctgaagccatcatcaaagctggagatggctcgttgtctctgaagaccagcaagggaactgttgagggattttcgcatgttatgtttgcaactggtcgcaagcccaacacaaagaacttagggttggagaatgttggcgtaaaaatggcgaaaaatggagcaatagaggttgacgaatattcgcagacctccgttccatccatttgggctgttggggatgtcactgaccgaatcaatttgactccagttgctttgatggagggaggtgcattggctaaaactttgtttcaaaatgagccaacaaagcctgattatagagctgttccttgcgccgttttctcccagccacctattggaacagttggtctaaccgaagagcaggccatagaacaatatggtgatgtcgatgttttcacatcaaactttaggccattaaaggctacgctttcaggacttccagaccgggtgttcatgaaactcattgtctgtgcaaacaccaataaagttctcggtgttcacatgtgtggagaggattcaccagaaatcatccagggatttggggttgcagttaaagctggtttaactaaggccgactttgatgcaacagtgggtgttcaccccacagcggctgaggagtttgtcactatgaggactccaaccaggaaaatccgcaaagactcctctgagggaaaggcaagtcctgaagctaaaacagctgctggggtgtagagaaggttgcaaaaaagattgtatttacggcattggagctccctgacaaggagaacattgtgtctgtgaagaagaagaactttttttttttctggcagagaataatttttgataatgtcgcgtggagatatgatcgccgtcctgcaatacttttgatcggttgacctacgcgaccaaattcctcgagagaggttgtaacttatatcgaaagagctctaaaaactgaagctttcagttcttgtgacatcgtaaagaaggctgtatagataaaacagtttcgagtgttctttggatttgtagtttttttcttttctttttgtgttgaactcgtctcgttgaagccaccatttgggacttcatattagcatcgttgcgaatgaaataaacttttgagaactcaacacgatcacc

SEQ ID NO: 1479 - DNA, 2169 bp, Eutrema parvulum
gccacaaagtaaaatgatcgaaaaaaagcatatgcacaaaaacttgaaaggaaaaacaaaaaaagagagagagaagaagaaacgcgaagatggcttcgactccgaagcttactactacaatttcatcttctccatctcttcaaatcctctgtagaaaactcccaatcgcaattcatctaccatcatcatcatcatcttctagctgtcgttctctccctaaaaccttatcctttttctcttctctccgtccccgtgtcgccttagtgtcaaacaaccgatattatccatctcgccggttttctgttcgtgcccagaacgataacggagcagactcggaacgccagtacgatttcgatctcttcactatcggcgccggaagcggcggcgtccgcgcctctcgcttcgccacgagcttcggagcatccgccgccgtctgcgagctccctttttccaccatctcttctgagacagccggaggcgtcggaggaacgtgtgtactaagaggatgtgtcccaaagaagttacttgtgtatgcatcgaagtacactcacgagtttgaagatagccacggatttggttggaagtatgatactgagccttctcatgaatggagtacgttgattgccaacaagaacgctgagttgcagcggctgactggtatttataagaatatactgaaaaatgctaatgtcaagttgattgaaggtcgtggaaaggttatagacccacacactgttgatgtagatgggaaaatctatacaacgagaaatatactgattgcagtcggtggacgacccttcattcctgacattccaggaagtgagtttgccatagattcagatgccgcactcgatttgccttccaagcccaagaaaattgcaatagttggtggtggctacatagccgtggagtttgctggcatctttaatggtcttaacagtgaagttcatgtatttataaggcaaaagaaggtgctgagaggatttgatgaagacgtcagggattttgttggagagcagatgtctttaagaggcattgagttccacacagaggaatcgcctgaagccatcatcaaatctggagatggctcgttctctctgaagaccagcaagggaactgttgatgggttttcgcatgttatgtttgcaactggtcgcaagcccaaaacaaagaatttaggattggagaatgccggcgtaaaaatggccaaaaatggagcaatagaggttgatgaatattcacggacatctgttccttccatctgggctgttggggatgtcactgatcggatcaatttgactccagttgccttgatggagggaggtgcattggctaaaaccttgtttcaaaatgaaccaacaaagcctgattatagagctgttccctgcgccgttttctcccagccacctattggaacagttggtctaacagaagagcaggccatagaacaatatggggacatcgatgttttcacatcaaactttaagccattaaaagctacgctttcaggacttccagaccgggtgtttatgaaactcattgtctgtgcaagcaccaataaagttctcggtgttcacatgtgtggagaggattcacctgaaatcatccagggatttggggttgcagtaaaagctggcttaactaaggccgactttgatgctacagtgggtgttcaccccacagcggctgaggagtttgtcacaatgaggactccaaccagaaaaatccgcaaggactcctctgagggaaaagcaagtactgaggctaaaacagctgcaggagtctagaaaggttgcgaatagattggatttacgcccattggagcttcctgagaaggagaacattatccgtgaagaagaagaagctttttttgggtcgacaatgatcgaattttactcaacttttttttattatgtcgcgtggagatgtcataaccgtagtgcaatactgttgatcatttaacctacacgaccaaatgctcgggagaggttatagctattcggaaaatgattttgacaacagctctaaaactgaaggttttcaattcttgtgccatagtagtggtggctgtatagatacaaggctctcccaatatctcattaccctggttgaataaaatttaaaaaaattctatgtcgagagtttgattgagttttagcccatgttttt

SEQ ID NO: 1480 - DNA, 1905 bp, Brassica napus
agagacgcgaagatggcttcgactccgaagctaaccactacaatttcatcttccccatctcttcaaatcctctgcagaaaactcccaatcgcaatcaacctaccatcttcttcaacctctcgttccctccctaaaaccttatcccatctctcctctctccgtccccgcgtcgcctcagtctcaaaccaccgctactactcctcctctcgccgcttttccgtccgtgcgcaaaacgacaacggagcagactcggatcgccactacgactttgatctcttcaccatcggcgccggaagcggcggcgtccgcgcctcccgcttcgccacgagctacggagcgtccgccgccgtctgcgagctccccttttccaccatatcttccgataccgccggtggcgtcggaggaacgtgtgtacttagaggatgtgtaccaaagaagctactagtgtatgcatccaaatacactcacgagtttgaagacagtcacggctttggttggaagtatgacactgagccttctcatgactggagtacattgattgccaacaagaacgctgagctgcagcgccttactggtatctacaagaacatactcaacaatgctaatgtcaagttgatcgaaggtcgtggaaaggttatagacccacacactgttgatgtagatgggaaaatctatactacgagaaacattctgattgcagttggtggacgtcccttcattcctgacattccgggaagagagtttgccatagattcagatgcagcactcgatttgccttccaagcccaagaagattgcaatcgttggtggtggctacatagccctggagtttgcgggaatttttaatggtcttaacagtgaggttcatgtttttataaggcaaaagaaggtgctgagggggtttgatgaagacgttagggattttgttggagagcagatgtctttaagaggcattgagttccacacagaagaatcacctgaagccatcatcaaagctggagatggctcattctctctgaagaccagcaagggaactgttgatgggttttcgcatgttatgtttgcaactggtcgcaagcctaatacaaagaacttagggttggaaaatgttggcgttaagttggcaaaaaatggagcaatagaggttgatgaatattcaaggacatctgttccttccatctatgctgttggggatgtcactgaccggatcaatttgactccagtcgccctgatggagggaatggcattggccaaaaccttgttccaaaatgatccaacaaagcctgattatagagctgttccctgcgccgttttcgcccagccacctattggaacagttggtctaactgaagagcaggccatagaacaatatggagacatcgatgttttcacatcaaactttaagccattgaaggccacgctttcaggacttccagacagggtgtttatgaaactcattgtctgtgcaaacactaataaagttctaggtgtacacatgtgtggagaggattcacccgaaatcatccagggatttggagtggcagtaaaagctggcttaactaaggccgactttgacgctacagtgggtgttcaccccacagcggctgaagagttcgtcactatgaggactccaaccaggaagatccgcaaagaatcctctgagggaaaggcaaatgttgaggctaaaacagctgtctagagaaagttgcagagtaatttggatttacgacattggagctccctgacaaggagaacattatccgtgaagaagaagaagcttttttttgtcaagagtgatcgagttctagccaacgtttttagttatttatgtcgcgtggagatgtcataaccatcgtgcatactgttaatcgtttaacctacacgaccaaattctgatattcggaaa

SEQ ID NO: 1481 - DNA, 1836 bp, Eutrema parvulum
aggccacaaagtaaaatgatcgaaaaaaagcatatgcacaaaaacttgaaaggaaaaacaaaaaaagagagagagaagaagaaacgcgaagatggcttcgactccgaagcttactactacaatttcatcttctccatctcttcaaatcctccgcagaaaactcccaatcgcaatccatctaccatcatcatcatcatctcagagctgtcgttcgctccataaaaccctatcctatttctcttccctccgtccccgtgtcgccttaatgtcaaacaacggatataatccatctcgccggttttctgtgagtgcccagaacgataacggagcagaatcggaacgccagtacgatttcgatctcttcactatcggcgccggaagcggcggcgtccgcgcctctcgattcgccacgagctacggagcttccgccgccgtttgcgagctccctttttccactatctcttccgagacaaccggaggcgtcggaggaacgtgtgtactaagaggatgtgtcccaaagaagttacttgtgtatgcatccaaatacagtcacgagtttgaagacagtcacggatttggttggaagtatgatactgagccttcccatgactggagtacattgattgccaacaagaacgctgagttgcagcggctgactggtatttataagaatatactgaaaaatgctaacgtcaagttgattgaaggtcgtggaaaggttatagacccgcacactgttgatgtagatgggaaaatctatacaacgagaaatatactgattgcagtcggtggacgacccttcattcctgacattccaggaagtgagtttgccatagattcagatgccgcactcgatttgccttccaagcccaagaaaattgcaatagttggtggtggctacatagccgtggagtttgctggcatctttaatggtcttaacagtgaagttcatgtatttataaggcaaaagaaggtgctgagaggatttgatgaagacgtcagggattttgttggagagcagatgtctttaagaggcattgagttccacactgaagaatcccctgaagccatcatcaaatctgcagatggctcgttgtctctgaagaccaccaagggaactattgaggggttttcgcatgttatgtttgcaactggtcgcaagcccaacacaaagaatttaggattggagaatgccggcgtaaaaatggccaaaaatggagcaatagaggttgatgaatattcacggacatctgttccttccatctgggctgttggggatgtcactgatcggatcaatttgactccagttgccttgatggagggaggtgcattggctaaaaccttgtttcaaaatgaaccaacaaagcctgattatagagctgttccctgcgccgttttctcccagccacctattggaacagttggtctaacagaagagcaggccatagaacaatatggggacatcgatgttttcacatcaaactttaagccattaaaagctacgctttcaggacttccagaccgggtgtttatgaaactcattgtctgtgcaagcaccaataaagttctcggtgttcacatgtgtggagaggattcacctgaaatcatccagggatttggggttgcagtaaaagctggcttaactaaggccgactttgatgctacagtgggtgttcaccccacagctgctgaggagtttgtcactatgagaactccaaccagaaaaatccgcaaggactctgagggaaaggcaagtactgaggctaaaacagctgcaggggtatagagaaggtttcaaaaagattggatttactctattggagctccctgacaagg

SEQ ID NO: 1482 - DNA, 2425 bp, Brassica napus
gattcaccaagttataaaatcaagtactttctaaagctctgacttctctctaaaagtattcacactttctctctctaagtgctgatcgagtttgtccgaaaggctgacttagtaaccacaagggtggaaaggtactaaggccgcacgtcctgattgttgtgaagaaatcagtccgtgacaatacgcacagaaacctcacaggaacaaacaaaaaaattaagacagagagaaaagagacgcgaagatggcttcgactccgaagctgaccactacaatctcatcatccccatctcttcaaatcctctgcagaaaactcccgatcgcaatcaacctaccatcttctccaacctctcgttccctccctaaaaccttatcctatctctcctctctccgtccccgcgtcgcctcagtctcaaaccaccgctactactcctcctcctctcgccgcttttccgtccgtgcgcaaaacgacaacggagcagactcggaccgccactacgactttgatctcttcaccatcggcgccggaagcggcggcgtccgcgcctcccgattcgccacgagctacggagcgtccgccgccgtctgcgagctccccttttccaccatctcttccgataccgccggtggcgtcggaggaacgtgtgtactaagaggatgtgtaccaaagaagttacttgtctatgcatccaaatacactcacgagtttgaagacagtcacggctttggttggaagtatgacaccgagccttctcatgattggagtacattgattgccaacaagaacgctgagctgcagcgccttactggtatctacaagaatatactcaacaatgctaatgtcaagttgatcgaaggtcgtggaaaggttatagacccacacactgttgatgtagatgggaaaatatatacttcgaggaatattctgattgcagttggtggacgtcccttcattcctgacattccaggaagagagtttgccatagattcagatgcagcgcttgatttaccttccaagcccgagaagattgcaatcgttggtggtggctacatagctctggagtttgcgggaatctttaatggtcttggcagtgaagttcatgtatttataaggcaaaagaaggtgctgagggggtttgatgaagatgttagggattttgttggggagcagatgtctttgagaggcattgagttccacacagaggaatcacctgaagccatcatcaaagctggagatggctcattctctctgaagaccagcaagggaactgttgatgggttttcgcatgttatgtttgcaactggtcgcaagcctaatactaagaacttaggtttggagaatgttggcctaaaattggcgaaaaatggagcaatagaggttgatgaatattcaaggacatctgttccttccatctttgctgttggggatgtcactgaccggatcaatttgactccagtcgccttgatggagggaatggcattggcgaaaaccttgttccaaaatgatccaacaaagcctgattatagagctgttccctgcgccgttttctcacagccacctattggaacagttggtctaactgaagagcaggccatagaacaatatggagacatcgatgttttcacatcaaacttcaagccattaaaggctactctttcaggacttccagacagggtgtttatgaaactcattgtctgcgcaaacaccaataaagtcctcggtgttcacatgtgtggagaggattcacctgaaatcatccagggatttggagtggcagtaaaagctggcttaactaaggccgactttgacgctacagtgggtgttcaccctacagcagctgaggagtttgtcactatgaggactccaaccaggaagatacgcaaagaatcctctgagggaaaggcaagtgttgaggctaaaacagctgtctagagaaggccgcaagagaatttggattgacgacattggagctccctgacaaggagcacattatccgttaagaagaagctttttttggtcaggagtgatcgagttctctagccaacgtttttaagttatttatgtcgcgtggagatgtcataaccatcgtgcatactgttaatcgtttaacatacacgaccaaattctgatattcggaaagtgatttttacgagagctcctaaaattgaaggttttcaattctttttccgttgtagtggtggctgtattgcccttccagtatcgcattttcgtggttgaataagtaaaacaattttatacgtcgactgatgattgaaaatttgagttcttagccaacgttttttcttgggaggagtcataattattttgaaagggggttttggatagagcaataaaaccgatgacttttgagttattgtgcattgtaatgagggattctctttacatcttagctaatcctagctg

SEQ ID NO: 1483 - DNA, 2304 bp, Brassica rapa
tacaagggattgtattaaacaattaggccacaagtagtctggtcgaataaagcatacgcacaggaacaaacaaaaaaattaagacagagagaaaagagacgcgaagatggcttcgactccgaagctgaccactacaatttcatcatccccatctcttcaaatcctctgcagaaaactcccgatcgcaatcaacctaccatcttctccaacctctccttccctccctaaaaccttatcccatctctcatctctccgtctccgcgccgcctcagtctcaaaccaccgctactactcctcctcctcctctcgccgcttttccgtccgtgcgcaaaacgacaacggagcagactcggaccgccactacgactttgatctcttcaccatcggcgccggaagcggcggcgtccgcgcctcccgattcgccacgagctacggagcgtccgccgccgtctgcgagctccccttttccaccatctcttccgagactgccggtggcgtcggaggaacgtgtgtactaagaggatgtgtaccaaagaagctacttgtctatgcatccaaatacactcacgagttcgaagacagtcaggggtttggttggaagtatgacaccgagccttctcatgattggagtacattgattgccaacaagaacgctgagctgcagcgcctgactggtatctacaagaatatactcaacaatgctaatgtcaagttgatcgaaggtcgtggaaaggttatagacccacacactgttgatgtagatgggaaaatctatacttcgaggaatattctgattgcagttggtggacgtcccttcattcctgacattccaggaagagagtttgccatagattcagatgcagcgcttgatttaccttccaagcccgagaagattgctatcgttggtggtggctacatagctctggagtttgcgggaatctttaatggtcttggcagtgaagttcatgtatttataaggcaaaagaaggtgctgagggggtttgatgaagacgttagggattttgttggggagcagatgtctttgagaggcattgagttccacacagaggaatcacctgaagccatcatcaaagctggagatggctcgttctctctgaagaccagcaagggaactgttgatgggttttcgcatgttatgtttgcaactggtcgcaagcctaatactaagaacttaggtttggagaatgttggcctaaaattggcgaaaaatggagcaatagaggttgatgaatattcaaggacatctgttccttccatctttgctgttggggatgtcactgaccggatcaatttgactccagtcgccttgatggagggaatggcattggcgaaaaccttgttccaaaatgatccaacaaagcctgattatagagctgttccctgcgccgttttctcacagccacctattggaacagttggtctaactgaagagcaggccatagaacaatatggagacatcgatgttttcacatcaaacttcaagccattaaaggctactctttcaggacttccagacagggtgtttatgaaactcattgtctgcgcaaacaccaataaagtcctcggtgttcacatgtgtggagaggattcacctgaaatcatccagggatttggagtggcagtaaaagctggcttaactaaggccgactttgacgctacagtgggtgttcaccctacagcagctgaggagtttgtcactatgaggactccaaccaggaagatacgcaaagaatcctctgagggaaaggcaagtgttgaggctaaaacagctgtctagagaaggccgcaagagaatttggattgacgacattggagctccctgacaaggagcacattatccgttaagaagaagcttttttggtcaggagtgatcgagttctctagccaacgtttttaagttatttatgtcgcgtggagatgtcataaccatcgtgcatactgttaatcgtttaacatacacgaccaaattctgatattcggaaagtgctttttacgagagctcctaaaattgaaggttttcaattctttttccgttgtagtggtggctgtattgcccttccagtatcgcatttccgtggttgaataagtaaaacaattttatacgtcgagtgatgattgaaaatttgagttctaagccaacgttttttgttgagagtagtttataactattttgaaaggtggttttggttagagctctaaaaccgatgacttttgcgttattgtgcattgtaatgagggattcacctaacatcttagctagctgaataaaatatacgatttcaa

SEQ ID NO: 1484 - DNA, 2095 bp, Eutrema halophilum
aaatcaaagccacaagtagaattgacgaaaaaagcatacgcacagaaacattagaagaaacgaaaaaaactaaaaaagagagagatagagagaaaaaaacgcgaagatggcttcaactccgaagctgactactacaatttcatcttctccatctcttcaaatcctccgcagaaaactcccaatcgcaatccctctaccatcttcatcatctcagagctctcgttcgtttcatagaaccctatcctatttctcttccctccgttcccgtgtcgccttaatgtcaaaccacgggtataatccctctcgccggttttctgtgagtgcccagaacgataatggagcagaatctgagcgtcactacgattttgatctcttcactatcggcgccggaagcggcggcgtccgcgcctctcgattcgccacgagctacggagcttccgccgccgtttgcgagctccctttttccactatctcttccgagacaaccggaggcgtcggaggaacgtgtgtactcagaggatgtgtcccaaagaagttacttgtgtatgcatccaaatacagccacgagtttgaagacagtcacggatttggttggaagtatgatactgagccttcccatgactggagtacattgattgccaacaagaatactgagttgcagcgtctgactggtatttataagaatatactgaaaaatgctaacgtcaagttgattgaaggtcgtggaaaggttatagacccgcacactattgatgtagatgggaaaatctatacttcgagaaacatcctgattgcagttggtggacgtcccttcattccagacattccaggaagagagtttgccatagattcggatgccgcacttgatttgccttccaaacctaaaagaattgcaatagttggtggtggctacatagccctggagtttgcgggcatctttaatggtcttaacagtgaagttcatgtgtttatcaggcaaaagaaggtgctgaggggatttgatgaagacgtcagggattttgttggagagcagatgtctttaagaggcattgagtttcacactgaagaatcccctgaagccatcatcaaatctgcagatggctcgttgtctctgaagaccaccaagggaactattgagggtttttcgcatgttatgtttgcaactggtcgcaagcccaacacaaagaatttagggttggagaatgctggcgtaaaattggcgaaaaatggagcaatagaggttgatgaatattcacggacatctgtaccttccatctgggctgttggggatgtcactgaccggatcaatttgactccagtcgccttgatggagggaatggcattggctaaaaccgtgtttcaaaatgagccaacaaagcctgactatagagctgttccctgcgccgttttctcccagccacccataggaacagttggtctaaccgaggagcaggccatagaacaatatggggacatcgatgtttacacatcaaactttaagccattaaaggctacgctttcaggacttccagaccgggtgtttatgaaactcattgtctgtgcaaacacaaataaagttctcggtgttcacatgtgtggagaggattcacccgaaatcatccagggatttggggttgcagtaaaagctggcttaaccaaggccgattttgatgctacagtgggtgttcaccccacagcttctgaggagtttgtcactatgagaactccaaccaggaaaatccgcaaagactctgagggaaaggcaagtcctgaggctaaaacagctgcaggggtatagagaaggtttcaaaaagattggatttactttattggagctccctgacaaggagaacaatatccttgaagaagaagaagcctttttttggtcgagagtgatagagttttagcccaatgtttttatttatgtcgcatggagacaaggccgtgcccatgttaagaaaatggaaacactcagcccatgttaaggtcctcattttgtaatgtaatataactaattgttttaatgtaaaacaaataaaattacagtttcttgataatgaaatatttgtttttgattaaaaatatgatgttaagc

SEQ ID NO: 1485 - DNA, 2089 bp, Eutrema halophilum
aagccacaagtagaattgacgaaaaaagcatacgcacagaaacattagaagaaacgaaaaaaactaaaaaagagagagatagagagaaaaaaacgcgaagatggcttcaactccgaagctgactactacaatttcatcttctccatctcttcaaatcctccgcagaaaactcccaatcgcaatccctctaccatcttcatcatctcagagctctcgttcgtttcatagaaccctatcctatttctcttccctccgttcccgtgtcgccttaatgtcaaaccacgggtataatccctctcgccggttttctgtgagtgcccagaacgataatggagcagaatctgagcgtcactacgattttgatctcttcactatcggcgccggaagcggcggcgtccgcgcctctcgattcgccacgagctacggagcttccgccgccgtttgcgagctccctttttccactatctcttccgagacaaccggaggcgtcggaggaacgtgtgtactcagaggatgtgtcccaaagaagttacttgtgtatgcatccaaatacagccacgagtttgaagacagtcacggatttggttggaagtatgatactgagccttcccatgactggagtacattgattgccaacaagaatactgagttgcagcgtctgactggtatttataagaatatactgaaaaatgctaacgtcaagttgattgaaggtcgtggaaaggttatagacccgcacactattgatgtagatgggaaaatctatacttcgagaaacatcctgattgcagttggtggacgtcccttcattccagacattccaggaagagagtttgccatagattcggatgccgcacttgatttgccttccaaacctaaaagaattgcaatagttggtggtggctacatagccctggagtttgcgggcatctttaatggtcttaacagtgaagttcatgtgtttatcaggcaaaagaaggtgctgaggggatttgatgaagacgtcagggattttgttggagagcagatgtctttaagaggcattgagtttcacactgaagaatcccctgaagccatcatcaaatctgcagatggctcgttgtctctgaagaccaccaagggaactattgagggtttttcgcatgttatgtttgcaactggtcgcaagcccaacacaaagaatttagggttggagaatgctggcgtaaaattggcgaaaaatggagcaatagaggttgatgaatattcacggacatctgtaccttccatctgggctgttggggatgtcactgaccggatcaatttgactccagtcgccttgatggagggaatggcattggctaaaaccgtgtttcaaaatgagccaacaaagcctgactatagagctgttccctgcgccgttttctcccagccacccataggaacagttggtctaaccgaggagcaggccatagaacaatatggggacatcgatgtttacacatcaaactttaagccattaaaggctacgctttcaggacttccagaccgggtgtttatgaaactcattgtctgtgcaaacacaaataaagttctcggtgttcacatgtgtggagaggattcacccgaaatcatccagggatttggggttgcagtaaaagctggcttaaccaaggccgattttgatgctacagtgggtgttcaccccacagcttctgaggagtttgtcactatgagaactccaaccaggaaaatccgcaaagactctgagggaaaggcaagtcctgaggctaaaacagctgcaggggtatagagaaggtttcaaaaagattggatttactttattggagctccctgacaaggagaacaatatccttgaagaagaagaagcctttttttggtcgagagtgatagagttttagcccaatgtttttatttatgtcgcatggagacaaggccgtgcccatgttaagaaaatggaaacactcagcccatgttaaggtcctcattttgtaatgtaatataactaattgttttaatgtaaaacaaataaaattacagtttcttgataatgaaatatttgtttttgattaaaaatatgatgttaagc

SEQ ID NO: 1486 - DNA, 2010 bp, Brassica napus
ggagagagcgagaacgcaaaagatggctacgactccgaagctgaccactacactttcatcttctccatctcttcaaaccctctgcagaaaactcccaatctcaacccatctaccatcatcttcatcatcatcatctatctctcgttatctctcgtctctccgtccccgtctcaccttactctcaaaccaccgctacaatccctctcgccgcttctctctccgtgcccaaaacgacaacgtagcagactctgaccttcgctacgacttcgacctcttcactatcggcgccggaagcggcggcgtccgtgcctcccgcttcgccacgagcttcggagcatccgccgccgtctgcgagctccctttctccaccatctcctccgatacagccggaggcgtcggaggaacgtgtgtactaagaggatgtgtgccaaagaagttactagtgtatgcatccaaatacactcacgagtttgaagacagtcacggctttggttggaagtatgacaccgacccttctcatgactggaggacattgattgccaacaagaacgctgagttgcagcttctgactggtatctataagaatatactcaacaatgctaatgtcaagttgatcgaaggccgtggaaaggttatagacccacacactgttgatgtagatgggagaatctatactactagaaacattctgattgcagttggtggacgtcccttcattcctgacattccaggaagagagtttgctattgattcagatgccgcgcttgatttgccctcatgccaagaagattgccatcgttggtggtggctacatagccctggagtttgcgggaatctttaatggtcttaacagtgaagttcatgtgtttattaggcaaaagaaggtgctaaggggatttgatgaagacgttagggattttgttggagagcagatgtctttgagaggcattgagttccacacagaggagtcccctgaagccatcatgaaatctggagatggatcgttgtctctgaagactagcaagggaactgttgatgggttttcacatgttatgtttgcaactggtcgcaagcccaatacaaagaacttaggattggaaaatgttggagtaaaattggcgaaaaatggagcaatagaggttgatgaatattcacggacatctgttccttcgatatgggctgttggggatgtcactgaccggattaacttgactccggtcgccttgatggagggaggtgcattggctaaaactttgttccaaaatgaaccaacaaagcctgatcatagagctgttccatgcgctgtcttctctcaaccacctattggaacagttggtctaactgaagagcaggccatagaacaatatggggacatagatgttttcacatcaaattttaagccattgaaggctacgctttcaggacttccagaccgggtgtttatgaaactcattgtctgtgcaaacaccgataaagttcttggtgttcacatgtgtggagatgattcaccagaaataatccagggatttggggttgctgtaaaagctggactaactaaggctgactttgacgcaacagtgggtgttcaccccacagcggctgaggagtttgtcacaatgaggactccaaccaggaaaattcgcaaaggctcctctgaggggaaaggcaagtcctgaggctaaaacagctgcaggggtctagagaaggttgcaaaataagattgaatttacaccattggagcttcctgacaaggagaacaatatccatcaagagccaacgtttttatcaatggagatgtcataaggctcataaccatggtgcaaaactgtttgatcgtgtaacttactcgacctgtcgaccagattctcaggagagcttatattgaccagagctctaaaactgagctctcccaatatctcactatcctagttgaataaagttctacgattgttatcattccctggactagtataattaaatcctcagttcaacatctacttgaaattattt

SEQ ID NO: 1487 - DNA, 1679 bp, Brassica rapa
cagaaacttaaaacgaagaaaagtagagagagcgagaacgcaaaagatggctacgactccgaagctgaccactacaatttcatcttctccatctcttcaaaccaccctctgcagaaaactcccaatctcaatccatctaccatcatcgtctctccgtccccgtctcaccttactctcaaaccaccgctacaatccctctcgccgtgcccaaaacgactacggaacagactctgaccttcgctacgacttcgacctcttcactctcggcgccggaagcggcggcgtccgtgcctcccgcttcgccacgagcttcggagcgtccgccgccgtctgcgagctccctttctccaccatctcctccgatacagccggaggcgtcggaggaacgtgtgtactcagaggatgtgtgccaaagaagttactagtgtatgcatccaaatacactcacgagtttgaagacagtcacggctttggttggaagtatgacaccgacccttctcatgactggactacattgattgccaacaagaacgctgagttgcagcgtctgactggtatctacaagaatatactcaacaatgctaatgtcaagttgatcgaaggccgtggaaaggttatagacccacacactgttgatgtagatgggagaatctatactactagaaacattctgattgcagttggtggacgtcccttcattcctgacattccaggaagagagtttgctattgattcagatgctgcgcttgatttgccttccaagcccaagaagattgcgatcgttggtggtggctacattgccctggagtttgcgggaatatttaatggtctcagcagtgaagttcatgtgtttattaggcaaaagaaggtgctgagggggtttgatgaagacgttagggattttgttggagagcagatgtctttgagaggcattgagttccacacagaggagtcccctgaagccatcatcaaatctggagatgggtcgttttctttgaagactagcaagggaactgttgatgggttttcacatgttatgtttgcaactggtcgcaagcccaatacaaagaacttaggattggaaaatgttggagtaaaattggcgaaaaatggagcaatagaggttgatgaatattcacggacatctgttccttcgatatgggctgttggggatgtcactgaccggattaacttgactccggtcgccttgatggagggaggtgcattggctaaaactttgtttcaaaatgaaccaacaaagcctgatcatagagctgttccatgcgctgtcttctctcaaccacctattggaacagttggtctaactgaagagcaggccatagaacaatatggggacatagatgttttcacatcacattttaagccattgaaggctacgctttcaggacttccagaccgggtgtttatgaaactcattgtctgtgcaaacaccgataaagttcttggtgttcacatgtgtggagaggattcaccagaaataatccagggatttggggttgctgtaaaagctggcctaactaaggctgactttgacgcaacagtgggtgttcaccccacagcggctgaggagtttgtcacaatgaggactccaaccaggaaaattcgcaaaggctcctctgaggttttgtttctgaacaaacaaaaaaaaaaagcttatc

SEQ ID NO: 1488 - DNA, 2095 bp, Cleome gynandra
aaagaaagcagaagcagagggacgcgaacatggcgtcgactcctaagcttactacaacaatatcgtcttctccatctctgcaactcctcttctgcaagaagcttccgatctctctgcctctctattcttcttcttcttctgctgctgcttcttcttcttcttctagctttccctctctccctaaaaccctaccttctctctattcccagcaccgccgcatcagctttatctcacagccatgtcgtcggttcacagttcgtgcggagaatgaaaatggcgctgaaactggccgtcaatacgattttgacctcttcacgatcggtgccggaagcggcggcgttcgggcgtcccgtttcgccgcgaatttcggggcctccgtcgctgtctgtgagctccctttctctaccatctcttcggagactgccggaggtgtcgggggaacgtgtgtgctcaggggttgtgtcccaaagaagttactcgtgtatgcatccaaattttctcatgagtttgatgagagtaatggctttggttggaaatatgagactgagcccactcatgagtggagaaccttgattgccaataaaaatgccgagctgcagcggctgactggtatttataagaatatactgaacaatgctaatgtaacgttgattgaaggacgtggaaagattattgatccacatactgttgatgttgatggaaaaatctacaccgcgagaaatatcctgattgcagttggtgggcgccccttcattcctgatattccaggaaaggagtatgtcattgattcagatgctgcccttgatttgccgtccaagcctgagaaaattgcaataattggtggtgggtacatagctttggaattcgccggtatctttaatggattaaaaagtgaagtccacgtatttatacggcaaaagaaggtgctaaggggatttgatgaagaggtcagagatttcgtcggagagcagatgtctttgaggggtattgagtttcatgtggaagaatcacctcaggccgtcattaagtctggagatggctcgttgtctctgaagaccaacaagggcattgtggagggtttctcacacattatgtttgccactggtcgcagggccaacacaacgaacttagggttggagagtgttggtgtcaaaatgaccaagaatggagcgattgaggttgacgaatattcacagacatctgttccttccatctgggctatcggggatgtcactgacaggatcaatttgactccagtcgccttgatggagggaggagcattggcaaaaacaatgtttcagaatgaacctacaaagcctgattatagagctgttccctctgctgttttctcccagccacctattggtcaagttggtctaactgaagaacaggccatagaacaatatggtgatattgacgttttcacagcaaacttcaggccgttaaaggctactctttctgggcttccagatcgtgtgtttatgaaactcattgtttgtgcaaagactaacaaagttcttggtgttcacatgtgtggagaggattcacctgaaatcatccaggggtttgcggttgctgtaaaagctggcttaaccaagactgactttgacgctaccgtgggtgttcacccgacagcagcagaagagtttgttactatgaggactccaaccaggaagatacggagaaattcctctgagggcaaggcaagtcccgagattaaagctgctacaggggtgtagaagaagtggtaagaagatcaggttcatggcataggagctcaatgtaaaggagagtatctattttcgcctgttcaagagtgaccgagttttagaaagtgcatgttcctttcacatggagatgtcataccctcttgtggtgcttctgattaatcaaacatgacacgactaagtaccccgatgaattattcatcctcgtgtgttccttttgtttaattttttcaccccctcacattgcaaataattgggcagagtcttaaatgagaaatcgcttggaaaatgttccatacttattaagatcttatgttgctgtaataacaaactcattatagacaagttctctatctttgttcctctta

SEQ ID NO: 1489 - DNA, 2087 bp, Cleome spinosa
cgaagcagaagaagagagaagaacgcgaacatggcgtctgctcctaagctcactactacaatcacgtcttctccatctatgcaattgctcctctgcaagaaacttccgatctctatccctctcccttcttcttcgtctttttcttcttctagatttctctctttacctaaatccctaacctccctctcttcccggcaccgccgcttcagctttgtctcacagccatgtcgcaggttgacagttcgcgccaacagcgaaaatggagctgataccggccgccaattcgattttgacctcttcaccatcggcgctggaagcggcggcgtccgcgcctcccgcttcgccgcgaatttcggggcctccgtcgctgtctgcgagctccctttctccaccatctcttccgagactaccggaggcgtcggaggaacatgtgtactcaggggatgtgtcccaaagaagttacttgtgtatgcatccaaattttctcatgagtttgatgagagtaatggcttcggttggaaatatgagactgagcccactcatgagtggagtaccttgattgccaacaaaaatgctgagttgcagcggctgactggtatttataagaacatactgaacaatgctaatgtcacattgattgaaggacgaggaaaggttatcgatccacatactgttgatgttgatggtaaaatctatactgcgagaaatattctgattgctgtcggtggacgccccttcattcctgagattcctggaagagagtatgttattgattcagatgctgctcttgatttgccttccaagccagagaaaattgcaatcattggtggtgggtacatagccttggagtttgctggtatctttaacggcctaaaaagtgaagtccatgtatttatacggcaaaagaaggtgctaaggggatttgatgaagagatcagagattttgttggagagcagatgtctttgaggggtattgagtttcataccgaagaatcacctcaagctgtcgtcaaatctgcagatggctcattgtctctgaagaccaacaagggaactgtggagggcttttcacaaattatgtttgctactggtcgtagggccaacacaaagaacttaggattggaggatattggtgtaaaaatgaccaagaatggagcgatagaggttgatgaatattcacggacatccgtttcttccatctgggctattggggatgtaactgacagaatcaacttgactccagtcgccttgatggagggaggtgcattagcaaaaaccttgttcgagaatgaacctacaaagcctgattatagagctgttccctctgctgttttctcccagccacctattggacaagttggtctaactgaagaacaagccatagaacaatacggtgatatagatgttttcacagcaaacttcaggccattaaaggcaactctttcagggctgccagaccgggcgtttatgaaactcattgtttgtgcgaagacaaacaaagttcttggtatccacatgtgtggagaggattcacctgaaatcatccaggggtttgcagttgctgtaaaagctggattgaccaaagctgactttgacagtaccgtgggtgttcacccaacagcagcagaagagtttgttactatgaggactccgaccagaaagattcggagagattctcctgaggggaagacgaatcccgaggctaaagctgctgcaggggtgtagaagaggttgtaaaacaatcagggttcatggagtaggaactctctgacaaggtgatccttgttttggctgttagaaaatgcctttctccttcgcttcttggagatgtgatagatggatatcctcttgtgatgattttgatgtttcaacataaactcaaccaaatacccagatgggtaaatcattcattcccaggtgtgttttcctttttttctgcatttctctctctctatgttgccaataatttgttaaaggggaaatctttcatgattcttctgattagggttttctccatctttgttttttcttattattgtctcaccgttttgcttgaaagagaatccgaataatgcacgaacgcgttc

SEQ ID NO: 1490 - DNA, 1787 bp, Arabidopsis lyrata
ttatattttggaggaggaaaatggagtgtgttggggctcggaatttcgcagcaatggcggtttcaacatttccgtcatggagttctcgaaggaaatttccggtggttaatagatacagctttaggaatattcgtttcggtttatgtagtgtcagagctagcggcggcggaagctccggtagtgagagttgtgtggtggtgagagaagatttcgccgacgaagaagattttgtgaaagctggtggttctgagattctattcgttcaaatgcagcagaacaaagatatggatgaacagtctaagcttgttgataagttgcctcctatatcaattggtgatggtgctttggatctagtggttattggttgtggtcctgctggtttagccttggctgcagaatcagctaagcttggattaaaagttggactcattggtccagatcttccttttactaacaactacggtgtttgggaagatgaattcaatgatcttgggttgcaaaaatgtattgagcatgtttggagagatactattgtgtatctggatgatgacaatcctattaccattggccgtgcttatggaagagttagtcgacgtttactccacgaggagcttttgaggaggtgtgtcgagtcaggtgtctcgtaccttagctcgaaagttgacagcataacagaagcttctgatggtcttagacttgttgcttgtgacgacaataacgtcattccgtgcagacttgccactgttgcttctggagcagcttcgggaaagctcttgcaatacgaagttgggggacctagagtctgtgtccaaactgcatacggcgtggaggttgaggtggaaaacagtccatatgatccagagcaaatggttttcatggattacagagattatacgaatgagaaagttcggagcttagaagctgagtatccaacgtttctgtacgctatgcctatgacaaagacaagactattctttgaggagacgtgtttagcctcaaaagatgtcatgcccttcgatttgctaaaaaagaagctcatgttaagattagatacactcggaattcgaattctaaagacttacgaagaggaatggtcctatatcccagttggtggttccttgcctaacaccgaacaaaagaatctcgcctttggtgctgcggctagcatggtacatcccgcaacaggctattcagttgtgagatctttgtctgaagctccaaaatatgcatcagtcatagcggagattctagaacaagagactcagactacttccttcaccaaacagatcaatagtaatatttcaagacaagcttgggatactttatggccaccagaaaggaaacgacaaagagcattctttctctttggtcttgcactcatagttcaattcgataccgaaggcattagaagcttcttccgtactttcttccgccttccaaaatggatgtggcaagggtttctaggatcaacattaacatcaggagatcttgttctctttgctttatacatgttcatcatctcaccaaacaatttgagaaaaggtctcatcaatcatctcatctctgatccaaccggagcaaccatgataaaaacctatctcaaagtatgattttcttatcaactcttaggtttgtgtatatatatgtgatttatctgaataatcgatcgaagaatggtatgtgggttactaggaagttggaaacaaacatgtatagaatctaaggagtgatcgaaatggatacgaaaagaaaaatcagtctttgttttgtggcaagtgactgaaaat

SEQ ID NO: 1491 - DNA, 1978 bp, Arabidopsis lyrata
ttttatgatttttttccaaatatcacaaaaggaaaaaattagattcctctttctgctacaccttaataaaactataacaatggtgtgagagattttcttcttcgtgcagattctttttataatatctatttcgaaattattattattatattttggaggaggaaaatggagtgtgttggggctcggaatttcgcagcaatggcggtttcaacatttccgtcatggagttctcgaaggaaatttccggtggttaatagatacagctttaggaatattcgtttcggtttatgtagtgtcagagctagcggcggcggaagctccggtagtgagagttgtgtggtggtgagagaagatttcgccgacgaagaagattttgtgaaagctggtggttctgagattctattcgttcaaatgcagcagaacaaagatatggatgaacagtctaagcttgttgataagttgcctcctatatcaattggtgatggtgctttggatctagtggttattggttgtggtcctgctggtttagccttggctgcagaatcagctaagcttggattaaaagttggactcattggtccagatcttccttttactaacaactacggtgtttgggaagatgaattcaatgatcttgggttgcaaaaatgtattgagcatgtttggagagatactattgtgtatctggatgatgacaatcctattaccattggccgtgcttatggaagagttagtcgacgtttactccacgaggagcttttgaggaggtgtgtcgagtcaggtgtctcgtaccttagctcgaaagttgacagcataacagaagcttctgatggtcttagacttgttgcttgtgacgacaataacgtcattccgtgcagacttgccactgttgcttctggagcagcttcgggaaagctcttgcaatacgaagttgggggacctagagtctgtgtccaaactgcatacggcgtggaggttgaggtggaaaacagtccatatgatccagagcaaatggttttcatggattacagagattatacgaatgagaaagttcggagcttagaagctgagtatccaacgtttctgtacgctatgcctatgacaaagacaagactattctttgaggagacgtgtttagcctcaaaagatgtcatgcccttcgatttgctaaaaaagaagctcatgttaagattagatacactcggaattcgaattctaaagacttacgaagaggaatggtcctatatcccagttggtggttccttgcctaacaccgaacaaaagaatctcgcctttggtgctgcggctagcatggtacatcccgcaacaggctattcagttgtgagatctttgtctgaagctccaaaatatgcatcagtcatagcggagattctagaacaagagactcagactacttccttcaccaaacagatcaatagtaatatttcaagacaagcttgggatactttatggccaccagaaaggaaacgacaaagagcattctttctctttggtcttgcactcatagttcaattcgataccgaaggcattagaagcttcttccgtactttcttccgccttccaaaatggatgtggcaagggtttctaggatcaacattaacatcaggagatcttgttctctttgctttatacatgttcatcatctcaccaaacaatttgagaaaaggtctcatcaatcatctcatctctgatccaaccggagcaaccatgataaaaacctatctcaaagtatgattttcttatcaactcttaggtttgtgtatatatatgtgatttatctgaataatcgatcgaagaatggtatgtgggttactaggaagttggaaacaaacatgtatagaatctaaggagtgatcgaaatggatacgaaaagaaaaatcagtctttgttttgtggcaagtgactgaaaattcagtgaacaagagtaaaaatgttcaaacatgtttctatccatttt

SEQ ID NO: 1492 - DNA, 1949 bp, Eutrema parvulum
aaggctcttttcccagtcattgtgaaaaagccagattcctttctcttctgctaaaccctcaatagaacagcaacaatggtgtgagagatttttgtcttcgcgctgaagattcttttttttttttcttatctgaggagtaaaatggagtgtgttggtgctcgtaatttcgctgcaatggcggtcacagcttttccgtcttggagttcccgaaggagatttccggtggtcaagagatacagctttaggaattttcgttgcggtctgtgtagagtcagagctagcggcggcggagcaggttccggtagcgagagttgcgttgcggtgagagaggatttcgccgacgaggaagatttcgtgaaggctggtggttcggagattctattcgttcaaatgcagcagaacaaagacatggatgaacagtctaagcttgctgataagttgcctccaatatcacttggtgatggtgctttggacctcgttgttattggttgtggtcctgctggtttagccttggctgcagaatcagctaagcttggactgaaagttggactgattggtccagatcttcctttcacaaacaactacggcgtttgggaagatgaatttaacgatcttgggctgcaaaaatgcattgagcatgtttggagagatacacttgtgtatctggacgatgacaatcccattaccatcggccgtgcttatggaagagttagtcgacgattactccacgaggagctcttgaggaggtgtgtcgagtcaggtgtctcttatctttgctcgaaagttgagagcataacagaagcttctgatggccttaggcttgttgcctgtgaacaaaacaccgttattccttgcaggcttgccactgttgcttctggagcagcttcggggaagctcttgctatacgaagttgggggacctagagtctctgtccaaactgcatacggtgtggaggttgaggtggaaaacagtccatatgatccagagcagatggtgttcatggattacagagattatacaaaccagaaagttcggagcttagaagctgagtatccaacgtttctgtatgccatgcctatgacaaagacaagagtgttctttgaggagacatgtttggcctcaaaagatgtcatgccctttgatttgctgaaaaagaagctcatgttgagattggagactctcggaattcgaatactaaagatttacgaagaggaatggtcttatatcccagtcggtggttccttgccaaacactgaacaaaagaatctcgcttttggtgctgccgctagcatggtacatcccgcaacaggctattcagttgtgagatctttgtctgaagctccgaaatacgcatcggtcattgcggatatactaaaacaagagactacttccttcgccaaacacattaacagcaatatttcaagacaagcttgggatacattatggccacaagaaaggaaacgacaaagagcattctttctcttcggccttgcactcatacttcaacttgatatcgaaggcattagaagcttcttccacactttcttccgccttccaaaatggatgtggcaagggtttctaggatcaacattaacatcaggagatctcgttctctttgctttctacatgttcatcattgcaccaaacaatttaagaaaaggtctcattaatcatctcgtctctgacccaacaggagcaaccatgattcgaacctatctcagagtatgattctctcctccactcttgggtttgtatatatataaataaacgatcagcgaatggtatgtgggttagtaggaaaattggcaacaaacgtatatagaatctacgggatgatggaaatggaaaagaaaggaaacaaagaaaaaaacagtcttggtttgtggtaagtgactacaaaaattgagagaaggatcttgtggattgtcatagtctttgattgtttatga

SEQ ID NO: 1493 - DNA, 1957 bp, Eutrema parvulum
tcgtctttaaggctcttttcccagtcattgtgaaaaagccagattcctttctcttctgctaaaccctcaatagaacagcaacaatggtgtgagagatttttgtcttcgcgctgaagattcttttttttttttcttatctgaggagtaaaatggagtgtgttggtgctcgtaatttcgctgcaatggcggtcacagcttttccgtcttggagttcccgaaggagatttccggtggtcaagagatacagctttaggaattttcgttgcggtctgtgtagagtcagagctagcggcggcggagcaggttccggtagcgagagttgcgttgcggtgagagaggatttcgccgacgaggaagatttcgtgaaggctggtggttcggagattctattcgttcaaatgcagcagaacaaagacatggatgaacagtctaagcttgctgataagttgcctccaatatcacttggtgatggtgctttggacctcgttgttattggttgtggtcctgctggtttagccttggctgcagaatcagctaagcttggactgaaagttggactgattggtccagatcttcctttcacaaacaactacggcgtttgggaagatgaatttaacgatcttgggctgcaaaaatgcattgagcatgtttggagagatacacttgtgtatctggacgatgacaatcccattaccatcggccgtgcttatggaagagttagtcgacgattactccacgaggagctcttgaggaggtgtgtcgagtcaggtgtctcttatctttgctcgaaagttgagagcataacagaagcttctgatggccttaggcttgttgcctgtgaacaaaacaccgttattccttgcaggcttgccactgttgcttctggagcagcttcggggaagctcttgctatacgaagttgggggacctagagtctctgtccaaactgcatacggtgtggaggttgaggtggaaaacagtccatatgatccagagcagatggtgttcatggattacagagattatacaaaccagaaagttcggagcttagaagctgagtatccaacgtttctgtatgccatgcctatgacaaagacaagagtgttctttgaggagacatgtttggcctcaaaagatgtcatgccctttgatttgctgaaaaagaagctcatgttgagattggagactctcggaattcgaatactaaagatttacgaagaggaatggtcttatatcccagtcggtggttccttgccaaacactgaacaaaagaatctcgcttttggtgctgccgctagcatggtacatcccgcaacaggctattcagttgtgagatctttgtctgaagctccgaaatacgcatcggtcattgcggatatactaaaacaagagactacttccttcgccaaacacattaacagcaatatttcaagacaagcttgggatacattatggccacaagaaaggaaacgacaaagagcattctttctcttcggccttgcactcatacttcaacttgatatcgaaggcattagaagcttcttccacactttcttccgccttccaaaatggatgtggcaagggtttctaggatcaacattaacatcaggagatctcgttctctttgctttctacatgttcatcattgcaccaaacaatttaagaaaaggtctcattaatcatctcgtctctgacccaacaggagcaaccatgattcgaacctatctcagagtatgattctctcctccactcttgggtttgtatatatataaataaacgatcagcgaatggtatgtgggttagtaggaaaattggcaacaaacgtatatagaatctacgggatgatggaaatggaaaagaaaggaaacaaagaaaaaaacagtcttggtttgtggtaagtgactacaaaaattgagagaaggatcttgtggattgtcatagtctttgattgtttatga

SEQ ID NO: 1494 - DNA, 1990 bp, Eutrema halophilum
gagaaaatattacttcagaaaaaaaattaagtaaataaaaggaaaaagccagattcctttaaacctcaatagaacagcaacaatagtgtgacagattttcgtcttcgcggtgaagatttttttctttgtttttttcttcttgggaggaaaatggagtgtgttggtgctcggaatttcgctgcaatggcggtgacagcttttccctctcgaagctcccggaggaattttccggtggttaagagatacagctttaggaatttccgttgcggtctgtgtagagtcagagctaaaggcggcggagcaggttccggtagtgagagttgcgtggcggtgagagaggatttcgccgacgatgaagatttcgtgaaggctggtggttcagagattctattcgttcaaatgcagcagaacaaagacatggatgaacagtctaagcttgtcgataagttgcctcctatatcagtcggtgatggtgctttggaccttgtggttattggttgtggtcctgctggtttagccttggctgcagaatcagctaagctaggactaaaagttggactgattggtccagatcttcctttcacaaacaattacggtgtttgggaagatgaattcaacgatcttgggctgcaaaaatgtattgagcatgtttggagagatactattgtgtatctagacgatgacaatcccattaccattggccgtgcttatggaagagttagtcgacgtttactccacgaggagctcttgaggaggtgtgtagagtcaggtgtctcgtatcttagctccaaagtcgagagcataacagaggcttctaatggccttagacttgttgcctgtgaagagaataccgtcgttccgtgcaggcttgccactgttgcttctggagcagcttcggggaagctcttgcaatacgaagtcgggggaccaagagtctctgtacaaactgcttacggcgttgaggttgaggttgaaaacagtccatatgatccagagcagatggttttcatggattacagagattatacaaaccaggaagttcggagcttagaagctgagtatcctacgtttctgtacgccatgcctatgaccaagacaagagtgttctttgaggagacgtgtttggcctcgaaagatgtcatgccttttgatttgcttaaaaagaagctcatgttaagattagatacactcggtattcgagttctaaagacttacgaagaggaatggtcttatatccctgttggtggttctttgccaaacaccgaacaaaagaatctcgcttttggtgctgccgctagtatggtacatcccgcaacaggctattcagttgtgagatctttgtctgaagctccaagctacgcttcagtgatcgcggatatactaaaacaagagactacttcctacacaaaacacatcaacagtaatatttcaagacaagcttgggatactttgtggccacaagaaagaaaaaggcaaagagcattctttctctttggtcttgcgctcatacttcaactcgatatcgaaggcattagaagcttcttccacactttctttcgccttccaaaatggatgtggcgagggtttttaggatcaacattaacatcaggagacctcgttctctttgctttctacatgttcatcattgcaccaaacaatttgagaaaaggtctcattaatcatctcgtctctgatccaactggagcaaccatgattcgaacctatctcagagtatgatcctcttctccactctttggtttgtatataaatataaataatcgatcgaagaacggtatgtgggtttactaggaaaatgtgtatagagaagaatctaagggatgatggaaatggaaaagagaaaaaaaaaaccagtcttgttttgtggtaagtgactgagaattgagagaaagaccttggtgaattgtgatagttcttcaattctgattgtttatgatacttagtaactcacttttctcattaagagttagat

SEQ ID NO: 1495 - DNA, 2000 bp, Brassica napus
agggaaacataacgaaggaaaaagccagattctccttcccttctctgctacttatactcttcaatagaacagcaacaatggtgtgaagagagatcttcttcgtcttcttctcgctgaagaacttgtaaaatggagtgtgttggtgctcgcaatttcgctgcaatggcggtcactgcttttccttctcggagctcccggaggaggtttccggcggtgaagagatacagttttaagaatcttcgctgcggtttgtgtagtagagtcgtcagagctagcgtcggcggcggaggaggaggctccggtggcgagagttgcgttgcggtgagggaggattacgctgacgaagaagatttcgtgaaagctggtggttcggagattatgttcgttcaaatgcagcagaacaaggacatggatgaacagtctaagctcgttgataagttacctcctatatcagttggtgatggtggtgctttggacctagtggttattggttgtggtccagctggtttagccttggctgcagaatcagctaagcttggattaaaagttggactgattggtccggaccttcctttcactaacaactacggtgtttgggaagatgagttcaacgatcttggcttgcaaaaatgtattgagcatgtttggagagataccattgtgtatctggacgatgacaatcccattaccatcggtcgtgcttatggaagagttaatcgacggttactccacgaggagctcttgaggaggtgtgccgagtcaggtgtctcgtatcttagctcaaaagttgagagcataacagaagctcctaatggccttaggctcgtttcctgtgaaagaaacaccgttgttccgtgcaggcttgccactgttgcgtctggagcagcttcagggaagctcttgcagtacgaacttggaggacctagagtctgtgtccaaactgcatatggcgtggaggttgaggtggaaaacagtccatatgatccagagcagatggttttcatggactacagagattatacgaaccagaaagttcggagcttagaagctgagtatccaacgtttctgtacgccatgccgatgacaaagactagagtattctttgaggagacatgcttagcctcaaaagatgtcatgccatttgatttgctaaagaagaagctcatgttaagattagaaacactcggaatcagaattctaaagacttatgaagaggaatggtcttatatcccagtaggtggttccttaccaaacactgaacaaaagaatctcgcctttggcgctgcagctagcatggtacatcccgctacaggctattcagttgtgagatctttgtctgaagctccaaattacgcatcagtcatcgcggatatactaaaacacgacactacttccttcaccaaacacatcaacatttcaagacaagcttgggatacattatggccatcagaaaggaaacgacaaagagctttctttctcttcggccttgcgctcatagttcaactcgatatcggaggcattaggagcttcttccacactttcttccgtcttccaaaatggatgtggcaagggtttctaggatcaacgttaacatcaggagatctggttctgtttgctttctacatgttcatcattgcaccaaacaatttaagaaaaggtcttattaatcatctggtctctgatccaaccggagcaaccatgattaaaacctatctcagagtatgactctctctcatccactcttgggtttgtatataacaaattattgatctaaggataaaggatggtattgtatgttggttgttaggaaaactggttacatttgtgtatagaatctacgggtcatttttctttttgtgctgcattctcattaagagttagattcaaagtaatgtatgccaatcactagtcaccaatgagtaatacagtaatttatttgtactgttatataatgcttaaaatgattaaattaattttgatccacgcttttaaggctaaac

SEQ ID NO: 1496 - DNA, 2019 bp, Brassica rapa
aaagcccttttccaagtcattgtgaaaaggaaacataacgaaggaaaaagccagattctccttcccttctctgctacttatactcttcaatagaacagcaacaatggtgtgaagagagatcttcttcgtcttcttctcgctgaagaacttgtaaaatggagtgtgttggtgctcgcaatttcgctgcaatggcggtcacagcttttccttctcggacctcccggagggggtttccggtggtgaagagatacagttttaagaatcttcgctgcggtttgtgtagtagagtcgtcagagctagcgtcggcggcggaggaggaggctccggtagcgagagttgcgttgcggtgagggaggattacgctgacgaggaagatttcgtgaaagctggtggttcggagattatgttcgttcaaatgcagcagaacaaggacatggatgaacagtctaagctcgttgataagttacctcctatatcagttggtgatggtggtgctttggacctagtggttattggttgtggtccagctggtttagccttggctgctgaatcagctaagcttggattaaaagttggactgattggtccggaccttcctttcactaacaactacggtgtttgggaagatgagttcaacgatcttggcttgcaaaaatgtattgagcatgtttggagagataccattgtgtatctagacgataacaatcccattagtatcggtcgtgcttatggaagagttaatcgacggttactccacgaggagctcttgaggaggtgtgccgagtcaggtgtctcgtatcttagctcaaaagttgagagcataacagaagctcctaatggccttaggctcgtttcctgtgaaagaaacaccgttgttccgtgcaggcttgccactgttgcgtctggagcagcttcagggaagctcttgcagtacgaacttgggggacctagagtctgtgtccaaactgcatatggcgtggaggttgaggtggaaaacagtccatatgatccagagcagatggttttcatggactacagagattatacgaaccagaaagttcggagcttagaagctgagtatccaacgtttctgtacgccatgccgatgacaaagactagagtattctttgaggagacatgcttagcctcaaaagatgtcatgccatttgatttgctaaagaggaagctcatgttaagattagaaacactcggaatcagaattctaaagacttatgaagaggaatggtcttatatcccagtaggtggttccttaccaaacactgaacaaaagaatctcgcctttggcgctgcagctagcatggtacatcccgctacaggctattcagttgtgagatctttgtctgaagctccaaattacgcatcagtcatcgcggatatactaaaacacgacactacttccttcaccaaacacatcaacatttcaagacaagcttgggatacattatggccatcagaaaggaaacgacaaagagcattctttctcttcggccttgcgctcatagttcaactcgatatcggaggcattaggagcttcttccacactttcttccgtcttccaaaatggatgtggcaagggtttctaggatcaacgttaacatcaggagatctggttctgtttgctttctacatgttcatcattgcaccaaacaatttaagaaaaggtcttattaatcatctggtctctgatccaaccggagcaaccatgattaaaacctatctcagagtatgattctctctcatccactcttgggtttgtatataacaaattattgatctaaggatggtattatatgttggttattaggaaaactggttacattcgtgtatagaatctacgggtcatttttctttttgtgctgcattctcattaagagttagattcaaagtaatgtatgtcaatcactagtcaccaatgagtgatacagtcatttatttgtattggtatataatgcttaaaatggttaaattaaatcttgatccaggtttttaaggctcat

SEQ ID NO: 1497 - DNA, 1879 bp, Brassica napus
tttatttaaattacggttttttttctgagtagaattatactactatggagtgtgttggtgctcgcaatctcgctgcaacggcggtcacagattttccgtcctggagttcttcgcgtaaaaactatcccgtggttaatagatacagctttagtaatctccggtgcggtttgtgtagagtcaaagctagcggcggcggagcaggttccggtatagagagttgcgtggcggtgagagaggacttcgccgacaaggaagacttcgtgaaggctggtggttcggagattctatacgttcaaatgcagcagaacaaagacatggatgaacagtctaagcttgttgataagttacctcctatatcaactggtgaaggtggtggtgctttggacctagtggttattgggtgtggtcctgctggtttagccttggcggctgaatcagctaagttaggacttaaagttggactgattggtcctgaccttcctttcactaacaactacggtgtttgggaagatgagttcaacgatcttggcttgcaaaaatgtattgagcatgtttggagagatacccttgtgtatctggacgatgacaatcctattaccattggtcgtgcttatggaagagttagtcgacgtttacttcacgaggagttcttgaggaggtgtgtggagtcaggtgtctcgtatcttagctccaaagttgagagcataacagaagctcctgatggccttaggcttgtttcctgtgaacaaaacacccttgttccgtgcaggcttgccactgttgcttctggagcagcttctgggaagctcttgcaatacgaagttggagggcctagagtctgtgtccaaactgcttacggcttggaggttgaggtggaaaagagtccatatgatccagagcagatggtgttcatggattacagagattatacaaacgagaaaatccggagcttagaagctgaatatccaacgtttctctacgccatgcctatgacaaagaccagagtcttctttgaggagacatgtcttgcttcaaaagatgtcatgccctttgatttgcttaaaaagaagctcttgttgagattagagacactcggaatccgaatactaaagacttacgaagaggaatggtcttatatcccagtaggtggttccttgccaaacacggaacaaaagaatctcgcctttggtgctgcagctagcatggttcatcctgcaacaggctattcagttgtgagatctttgtctgaagctccaaaatacgcatcagtcatcgctaatatactaaaacatgagaccactacttccttcaccagacacatcaacaccaatatttcaagacaagcttgggatactttatggccaccagaaaggaaacgacaaagagcattctttctctttggccttgcgctcatagttcaactcgacatcgaaggcattagatgcttcttccacactttcttccgccttccaaaatggatgtggagagggtttctaggatcaacattaacatcaggagacctcgttctgtttgctttctacatgttcatcattgcaccaaacaacttgagaaaaggtctcatcaatcatcttatctctgatccaaccggagcaaccatgattaaaacctatcttaaagtatgattctctcctccactcttgggtttttatatatatgaataatccatcgacgaatggcatgtgggttactaggaaaatttgtaacaaacgtttatagaatctattattcacaaaggtgcgtgccttaaaagattgagagaaggatagtctttagtagatttagattgccatttattaatcgatccattctcgttgttacattagtgcaaatctcggtaatctatatacactctcacttc

SEQ ID NO: 1498 - DNA, 1783 bp, Brassica napus
ttcgtctccgcgcagaagatttttatttatttatattacggtttttcttctgagtagaattatactactatggagtgtgttggtgctcgcaatctcgctgcaacggcggtcacagcttttccgtcctggagttcttcgcgtaaaaactatcccgtggataatagatacagctttagtaatctccggtgcggtttgtgtagagtcaaagctagcggcggcggagcaggttccggtatagagagttgcgtggcggtgagagaggacttcgccgacgaggaagacttcgtgaaggctggtggttcggagattctatacgttcaaatgcagcagaacaaagacatggatgaacatgaacagtctaagcttgttgataagttacctcctatatcaactggtgaaggtggtggtgctttggacctagtggttattgggtgtggtcctgctggtttagccttggcggctgaatcagctaagttaggacttaaagttggactgattggtcctgaccttcctttcactaacaactacggtgtttgggaagatgagttcaacgatcttggcttgcaaaaatgtattgagcatgtttggagagatacccttgtgtatctggacgatgacaatcctattaccattggtcgtgcttatggaagagttagtcgacgtttacttcacgaggagctcttgaggaggtgtgtggagtcaggtgtctcgtatcttagctccaaagttgagagcataacagaagctcctgatggccttaggcttgtttcctgtgaacagaacacccttgttccgtgcaggcttgccactgttgcttctggagcagcttctgggaagctcttgcaatacgaagttggaggacctagagtctgtgtccaaactgcttacggcttggaggttgaggtggaaaagagtccatatgatccagagcagatggtgttcatggattacagagattatacaaaagagaaaatccggagcttagaagctgaatatccaacgtttctctacgccatgcctatgacaaagacaagagtcttctttgaggagacatgtcttgcttcaaaagatgtcatgccctttgatctgctaaaaaagaagctcatgttgagattagagacactcggaatccgaatactaaagacttatgaagaggaatggtcttatatcccagtaggtggttccttgccgaacacggaacaaaagaatctcgcctttggtgctgcagctagcatggtacatcctgcaacaggctattcagttgtgagatctttgtctgaagctccaaaatacgcatcagtcatcgctaatatactaaaacatgagaccactacttccttcaccagacacatcaacaccaatatttcaagacaagcttgggatactttatggccaccagaaaggaaacgacaaagagcattctttctctttggtcttgcgctcatagttcaactcgacatcgaaggcattagatgcttcttccacactttcttccgccttccaaaatggatgtggagagggtttctaggatcaacattaacatcaggagacctcgttctgtttgctttctacatgttcatcattgcaccaaacaacttgagaaaaggtctcatcaatcatcttatctctgatccaaccggagcaaccatgattaaaacctatcttaaagtatgattctctcctccactcttggggttttatatatatgaataatccatcgacgaatggcatgtgggttactaggaaaatttgtaacaaacgtttatagaatctattattcaca

SEQ ID NO: 1499 - DNA, 1685 bp, Brassica napus
ttttacttctgagtagaattatactacaatggagtgtgttggtgctcgtaatttcgctgcaacggcggtcacatcttttccgtcttggagttcttcgcgtaaaaactttccggtggctaatagatacagctttagtaatctccggtgcggttttgttaaagtcagagctagcggcggcggagcaggttccggttgcgtggcggtgagagaggattacgccgacgaggaagacttcgtgaaggctggtggttcggagattctatacgttcaaatgcagcaaaacaaagacatggatgaacagtctaagcttgttgataagttacctcctatatcaactggtggtgaaggtggtggtgctttggacctagtggttattgggtgtggtcctgctggtttagccttggcggctgaatcagctaagttaggtctcaaagttggactgattggtcctgaccttcctttcactaacaactacggtgtttgggaagatgagttcaacgatcttggcttgcaaaaatgtattgagcatgtttggagagatacccttgtgtatctggacgatgacaatcctattaccattggtcgtgcttatggaagagttagtcgacgtttacttcacgaggagctcttgaggaggtgtgtggagtcaggtgtctcgtatcttagctcgaaagttgagagcataacagaagctcctgatggccttaggcttgtttcctgtgaacaaaacacccttgttccctgcaggcttgccactgttgcttctggagcagcttcagggaagctcttgcaatacgaagttggggggcctagagtctgtgtccaaactgcttacggcttggaggttgaggtggaaaacagtccatatgatccagagcagatggtgttcatggattacagagattatacaaacgagaaaatccggagcttagaagctgagtatccaacgtttctctacgccatgcctatgacaaagacaagggagacatgtcttgcttcaaaagatgtcatgccctttgatttgcttaaaaagaagctcatgttaagattagatacactcggtatccgaatactaaagacttatgaagaggaatggtcttatatcccagtaggtggttccttgccgaacacggaacaaaagaatctcgcctttggcgctgcagctagcatggttcatcctgcaacaggctattcagttgtgagatctttgtctgaagctccaaaatacgcatcagtcatcgctaatatactaaaacatgagactactacttccttcaccagacacatcaacaccaatatttcaagacaagcttgggatactttatggccaccagaaaggaaacgccaaagagcattctttctctttggtcttgcgctcatagttcaactcgacatcgaaggcattagatgcttcttccacactttcttccgccttccaaaatggatgtggagagggtttctaggatcaacattaacatcaggagacctcgttctgtttgctttctacatgttcatcattgcaccaaacactttaagaaaaggtctcatcaatcatcttatctctgatccaaccggagcaaccatgattaaaacctatcttaaagtatgattctctcctccactcttgggtttgtatataaatgaataatccatcgacgaatggcatgtgggttactaggaaaatt

SEQ ID NO: 1500 - DNA, 1890 bp, Raphanus sativus
  misc_feature (68)..(68): n is a, c, g, or t
  misc_feature (143)..(143): n is a, c, g, or t
  misc_feature (186)..(186): n is a, c, g, or t
  misc_feature (473)..(473): n is a, c, g, or t
  misc_feature (619)..(619): n is a, c, g, or t
  misc_feature (719)..(719): n is a, c, g, or t
  misc_feature (731)..(731): n is a, c, g, or t
  misc_feature (787)..(787): n is a, c, g, or t
  misc_feature (851)..(851): n is a, c, g, or t
  misc_feature (875)..(875): n is a, c, g, or t
  misc_feature (881)..(881): n is a, c, g, or t
  misc_feature (1019)..(1020): n is a, c, g, or t
  misc_feature (1070)..(1070): n is a, c, g, or t
  misc_feature (1073)..(1073): n is a, c, g, or t
  misc_feature (1801)..(1801): n is a, c, g, or t
aatggtgtgagaggttttcgtcttcgcgctgaagattttttatttatttatattttcggttttattcngagtagaattatactactatggagtgtgtcaatttcgccgcaacggcggtcacagcttttccgtcttggagttcntcgcgtagaatcttcccggtggttaatagatgcagctttagtnatctccggttgtgcacagtcagagctagcggcggcggagcaggttccggttgcgttgcggtgagagaggattacgccgacgaggaagatttcgtcaaggctggtggttcggagattctttacgttcaaatgcagcagaacaaagacatggatgaacaacagtctaagcttgttgataagctacctcctatatcaattggtgatggtggtggtactttggacctagtagttattggttgtggtcctgctggtttagccttggctgctgaatcagctaagttaggtctnaaagttggactcattggtccggatcttccttttacaaacaactacggtgtttgggaagatgaattcaacgatcttggtcttcaaaaatgtattgagcatgtttggagagatactattgtctatctggatgatggcaatcctatcancatcggtcgtgcttatggaagagttagtcgacgtttacttcacgaggagctcttgaggaggtgtgtggagtcaggtgtctcgtatcttagctccaaagtngagagcataacngaagctcccgatggccttaggcttgtttcctgtgaacacaacaccgttgttccgtncaggcttgccactgttgcttctggggcagcttcagggaagctcttgcaatacgaagttgggggncctagagtctgtgtccaaaccgcntacggngtggaggttgaggtggaaaacagtccatatgatccagagcagatggtgttcatggactacagagattatacaaacgagaaagtccggagcttagaagctgagtatccaacgtttctctacgctatgcctatgacaaanncaagagtgttctttgaggagacatgtcttgcttcaaaagatgtcatgccnttngatctgctaaaaaataagctcatgttaagattagatacactcggaatccgaatactaaagacttacgaagaggaatggtcttatatcccagtaggtggttccttgccagacactgaacaaaagaatctcgcctttggtgctgcagctagcatggtacatcccgcaacaggctattcagttgtgagatctttgtctgaagctccaaaatacgcatcagtcatcgcggatatactaaaccaagagtctactacttccttcaccagacacatcaacaccaatatttcaagacaagcttgggatactttatggccaccagaaaggaaacggcaaagagcattctttctctttggtcttgcgctcatagttcaactcgatatcgaaggcattagatgcttcttccacactttcttccgccttccaaaatggatgtggcgagggtttctaggatcaacattaacatcaggagacctcgttatgtttgctttctacatgttcatcattgcaccaaacgctttgagaaaaggtctcattaatcatcttatctctgatccaaccggagcaaccatgattaaaacttatctcagagtatgattctctcatatcccacttttgggtttgtatatatatgtgattatatgaataatcatcaatcgaccaaaaaaaagaagtataaaatctacatcatgatggaaataaacaaaacgaaacaggttcttgcctttggtttntgtcgtcaagtgactaaaaagaaagatagtctttgtggattacaattgccattttatttaaatacaatcattctcgttgttagtaaaca

SEQ ID NO: 1501 - DNA, 2061 bp, Brassica rapa
ttctatcctccttccttatcgtcctctcgtcttcaacgctctcttcctcagtcatcatcgtgaaacatttattgattacaaaacaaaaaaaaagaaaatatttaccaaggaacaatggtgtgagaggttttcgtctccgcgcagaagatttttatttatttatatttcggtttttacttctgagtagaattatactacaatggagtgtgttggtgctcgtaatttcgctgcaacggcggtcatagcttttccgtcttggagttcttcgcgtaaaaactatccggtggttaatagatacagctttagtaatctccggtgcggttttgttaaagtcagagctagcggcggcggagcaggttccggttgcgtggcggtgagagaggattacgccgacgaggaagacttcgtgaaggctggtggttcggagattctatacgttcaaatgcagcaaaacaaagacatggatgaacagtctaagcttgttgataagttacctcctatatcaactggtggtgaaggtggtggtgctttggacctagtggttattggttgtggtcctgctggtttagccttggctgcagaatcagcaaggttaggtctcaaagttggactcattggtcctgatcttcctttcactaacaactacggtgtttgggaagatgagttcaacgatcttggcttgcaaaaatgtattgagcatgtttggagagatacccttgtgtatctggacgatgacaatcctattaccattggtcgtgcttatggaagagttagtcgacgtttacttcacgaggagctcttgaggaggtgtgtggagtcaggtgtctcgtatcttagctccaaagttgagagcataacagaagctcctgatggccttaggcttgtttcctgtgaacaaaacacccttgttccctgcaggcttgccactgttgcttctggagcagcttcagggaagctcttgcaatacgaagttggggggcctagagtctgtgtccaaactgcttacggcttggaggttgaggtggaaaacagtccatatgatccagagcagatggtgttcatggattacagagattatacaaacgagaaaatccggagcttagaagctgagtatccaacgtttctctacgccatgcctatgacaaagacaagagtcttctttgaggagacatgtcttgcttcaaaagatgtcatgccctttgatttgcttaaaaagaagctcttgttgagattagagacactcggtatccgaatactaaagacttatgaagaggaatggtcttacatcccagtaggtggttccttgccgaacacggaacaaaagaatctcgcctttggcgctgcagctagcatggtacatcctgcaacaggctattcagttgtgagatctttgtctgaagctccaaaatacgcatcagtcatctcggatatactaaaacaagagtctacgacttccttcaccagacacatcaacaccaatatttcaagacaagcttgggatactttatggccaccagaaaggaaacgacaaagagcattctttctctttggtcttgcgctcatagttcaactcgatatccaaggcattagatgcttcttccacactttcttccgccttccaaaatggatgtggagagggtttctaggatcaacattaacatcaggagacctcgttctatttgctttctacatgttcatcattgcaccaaacaacttgaggaaaggtctcattaatcatcttatctctgatccaaccggagcaaccatgattaaaacctatctcagagtatgattctctcctccactcttgggtttgtatataaatgaataatccatcgacgaatggcatgtgggttactaggaaaatttgtaacaaacgtgtatagaatctattattcacaaggtatgtgcctaaaaagattgagagaaggatagtctttgccattttatttaagtacaatccattctcgttgttacattagtgcaaatactcgttaatctatacactttcacttcaacttttgtgcaaaagtataatcggaaacaccgggactattgcat

SEQ ID NO: 1502 - DNA, 1784 bp, Brassica napus
ttcgtctccgcacagaagatttttatttatttatattacggtttttcttctgagtagaattatactactatggagtgtgttggtgctcgcaatctcgctgcaacggcggtcacagcttttccgtcctggagttcttcgcgtaaaaactatcccgtggataatagatacagctttagtaatctccggtgcggttttgttaaagtcagagctagcggcggcggagcaggttccggttgtgtggcggtgagagaggattacgccgacgaggaagacttcgtgaaggctggtggttcggagattctatacgttcaaatgcagcagaacaaagacatggatgaacatgaacagtctaagcttgttgataagttacctcctatatcaactggtgaaggtggtggtgctttggacctagtggttattgggtgtggtcctgctggtttagccttggcggctgaatcagctaagttaggacttaaagttggactgattggtcctgaccttcctttcactaacaactacggtgtttgggaagatgagttcaacgatcttggcttgcaaaaatgtattgagcatgtttggagagatacccttgtgtatctggacgatgacaatcctattaccattggtcgtgcttatggaagagttagtcgacgtttacttcacgaggagctcttgaggaggtgtgtggagtcaggtgtctcgtatcttagctccaaagttgagagcataacagaagctcctaatggccttaggctcgtttcctgtgaaagaaacaccgttgttccgtgcaggcttgccactgttgcgtctggagcagcttcagggaagctcttgcagtacgaacttggaggacctagagtctgtgtccaaactgcatatggcgtggaggttgaggtggaaaacagtccatatgatccagagcagatggttttcatggactacagagattatacgaaccagaaagttcggagcttagaagctgagtatccaacgtttctgtacgccatgccgatgacaaagactagagtattctttgaggagacatgcttagcctcaaaagatgtcatgccatttgatttgctaaagaagaagctcatgttaagattagaaacactcggaatcagaattctaaagacttatgaagaggaatggtcttatatcccagtaggtggttccttaccaaacactgaacaaaagaatctcgcctttggcgctgcagctagcatggtacatcccgctacaggctattcagttgtgagatctttgtctgaagctccaaattacgcatcagtcatcgcggatatactaaaacacgacactacttccttcaccaaacacatcaacatttcaagacaagcttgggatactttatggccatcagaaaggaaacgacaaagagctttctttctcttcggccttgcgctcatagttcaactcgatatcggaggcattaggagcttcttccacactttcttccgtcttccaaaatggatgtggcaagggtttctaggatcaacgttaacatcaggagatctggttctgtttgctttctacatgttcatcattgcaccaaacaatttaagaaaaggtcttattaatcatctggtctctgatccaaccggagcaaccatgattaaaacctatctcagagtatgactctctctcatccactcttgggtttgtatataacaaattattgatctaaggataaaggatggtattgtatgttggttgttaggaaaactggttacatttgtgtatagaatctacgggtcatttttctt

SEQ ID NO: 1503 - DNA, 1229 bp, Brassica napus
atggcgactgctttgaatgctgctgtctctctcacttcttcaaaatcttcttctcttccagccactagctgtgccattgctcctgataggatcaggtttggtaagggtgctttttactacaaaagcaacagtgtagtgacaagcagaagagttgtttcggtaagagctgaggtcacaacagatactcctcctgctgtgaagaaagtagagaaagagtcaaagaagaacgaggaaggtgtgatcaccaacaagtacagaccaaaagagccttacacaggcaaagtccttctcaacaccaagatcacagctgatgatgcccctggagagacctggcacatggttttcagccatcaaggtgaaataccgtacagagagggacaatctgttggtgtgattgcagatgggattgataagaatgggaagcctcacaaggtcaggctttactccattgcaagcagcgctcttggagatcttggcaactctgaaaccgtttccttgtgtgtgaaaagacttgtctatactaatgatgcaggagaggttgttaaaggagtttgctcaaatttcttgtgtgacttgaaaccagggagtgatgttaagctcactggtcctgtagggaaagaaatgcttatgccaaaggatccaaacgccactgttattatgcttgccacagggacaggaatagctcctttcaggtctttcttgtggaagatgttcttcgagaaacatgatgactacaagtttaatggcttagcttggctgttcttgggtgtaccaaccactagctcattgctctacacagaggagtttgataagatgaaagcaaaggcacctgagaatttcagggttgattacgctataagcagagaagaaactaacgataaaggagagaaaatgtatattcagaccagaatggcgcagtacgcaccagaactatgggagttgttgaagaaagacaacacgtttgtctacatgtgtgggctcaagggaatggagaaaggaattgatgacattatggtctcattagctgctaatgacggtattgactggtttgattataagaagcagttgaagaaggcagagcaatggaacgttgaagtctactgattaacgtttggtggcaagtatagtggagcaacaagtgtaatttttgcatccaagtttctgtaatctgaagataagctttgttttagatatattatactaaagaaaagtgtttttttttaaaaaaa

SEQ ID NO: 1504 - DNA, 1610 bp, Brassica rapa
gctggttctagtcaagtaaaccgtaaccacaagtttgatcaaagaagatactctcttcttctacttcaaatcaaacctcatccacccaaacacacaaaaattgtcttgtaatcctcttctcttatcttttctccttctgattcctttttatactcccttgatattttatcccagtttcatttcatttcctctgcaatggcgactgctttgaatgctgctgtctctctcacatcttcaaaatcttcttctcttccagctacaagctgtgccattgctcctgaaaggatcaggtttggtaagggtggtttttcctacaaaagcaacaatgtagcgacaagcagaagagtgttttcggtaagagccgaagtcacaacagatactcctcctgctgtgaagaaagtagagaaagagtcaaagaagaacgaggaaggtgtgattaccaacaagtacagaccaaaagagccttacacaggcaaagtccttctcaacaccaagatcacagctgatgatgcccctggagagacctggcacatggttttcagccatcaaggtgaaataccttacagagaaggccaatctgttggtgtgattgcagatgggattgacaagaatgggaagcctcacaaggtcaggctttactccattgcaagcagcgctcttggagacctcggcaactctgaaaccgtttctttgtgtgtgaaaagacttgtttacactaatgatgcaggagaggttgttaaaggagtttgctcaaatttcttgtgtgacttgaaaccagggagtgatgttaagctcactggtcctgtagggaaagaaatgcttatgcctaaggatccgaacgccactgtcattatgcttgccacagggacaggaatagctcctttcaggtctttcttgtggaagatgttcttcgagaaacatgatgactacaagtttaatggcttagcgtggctgttcttgggcgtaccaaccactagttcattgctctacacagaggagtttgataagatgaaagcaaaggcacctgagaatttcagggttgattacgctataagcagagaagaaactaacgataaaggagagaaaatgtatatccagaccagaatggcgcagtacgcaccagagttatgggagttgttgaagaaagacaacacgtttgtctacatgtgtgggctcaagggcatggagaaaggaattgatgacattatggtctcattagctgctaatgacggtattgactggtttgattataagaagcagttgaagaaggcagagcaatggaacgttgaagtctactgatttaacattcagtggcaagtatagtggagaaacaagtgtaattttcgcatccaagtttctgtaatttgacgataaagctatgttttagatatatatcatactaaagaaaatggtttttcattagtcttttatcattatttcattgcctgtattttgctctgatataagagttacattgatagggagagttgtcctcaattgactgacagcaatctgtatattatggtaggggtgggcgttcgggtacccgttcgggttcggatcgggtatttcggattttcgggtatttcggtatagaggtctagaacccg

SEQ ID NO: 1505 - DNA, 2173 bp, Brassica juncea
atttcatttcctctgcaatggcgtctactttgaatgctgccgtttctctcacatcttcaaaatcttcttcccttccagctacaagctgtgccattgctcctgaaaggatcaggtttggtaagggtgctttttactacaaaagcaacaatgtggcgacaagcagaagagtggtttcagtaagagctgaagtcacaacagatactcccccagtgaagaaagtagagaaagagtctaagaagaacgaggaaggtgtgattactaacaagtacagaccaaaggagccttacaccggcaaagtcctcctcaactccaaaatcacagctgatgatgctcctggagagacctggcacatggttttcagccatgaaggagaaataccctacagagagggacaatctgttggtgtgattgcagatggtattgacaagaacggaaagcctaataaggtcaggctttactccattgcaagcagcgctcttggagatcttggcaactctgaaaccgtttctctgtgcgtgaagaggcttgtttatactaatgacgcaggagaggttgttaaaggagtctgctcaaacttcttgtgtgacttgaaaccaggaagtgatgtcaagctcactggtcctgtaggaaaagaaatgcttatgcctaaggatccaaacgccactgttattatgcttgccacagggacaggaatagctcctttcaggtctttcttgtggaagatgttcttcgagaaacatgatgactacaagtttaatggcttagcttggctgttcttgggtgtaccaaccactagttcattgctctacacagaggagtttgataagatgaaagcaaaggcacctgagaatttcagggttgattacgctataagcagagaagaaacgaacgataaaggagagaaaatgtatatccagaccagaatggcgcagtacgcacctgaactatgggagttgttgaagaaagacaacacgtttgtctacatgtgtgggcttaagggcatggagaaaggaattgatgacattatggtctcattagctgctaaagacggtattgactggcttgattataagaagcagttgaagaaggcagagcaatggaacgttgaagtctactgattttaacattccatatggcaagtattagtgtaattttttttttttcagatccaagtttctgtaatctgaacataagtttatgttttagataatacattacagtatactgaaaagggttcttaaatctttaccattacattcattgcaattactttgctcttatataaatggtacattcatacagagttgtcctcacttgaatactagtatgagtaggctcatgtttttaaccccttgtgcattgttataacatcaataaacatgaaaccaaactcaattgccaagtctaatgatgttctcaaggaatgagaaggaaactcattgcagaaaagaaactctgctaaagaaaatattttgcagaaaacaaagcaaacatcaaaaccacaaaagggaccatagactagaatcttggaaagagtttggccttctaacggattttcttcttcatctttgtctccacaccattggcactttcacagatcttgttccagcaacggtaagaaatgagcaaaggaatcaaaacccaccatccattagccccaacgtagtaggagtaatagtagaaggagttggttgcaaagttatctccttccaagaaagcagtaatgaaatagacaagacatccgtagagctggcctagcgagatcgcaagctgaagcacgtagctgtacgacttccccttagcaatagcatacacagcaagaagacaagcagggccttcaataacagcagtgatgccttcaacagctataactgcagaatctctgcctgcgtatcttgaatcacctttgctgtattctttccaaacttcagcgagataacaagaagtgttgtctttgaaaaagtcaggggagaaaacgaaatagccttcaagaaccatgtgagtgagacccgtgaaagcccaccagcacattagcaatctgtcaagatgcgctttcttcctcccgagtagaaaccagacgaaggtgacgacaaagagggaagcaccgaggtagacagcgaggatagttgacatggacatggagatgggaacgtatccaggcagtttcagatct

SEQ ID NO: 1506 - DNA, 1391 bp, Raphanus sativus
  misc_feature (24)..(24): n is a, c, g, or t
  misc_feature (62)..(62): n is a, c, g, or t
  misc_feature (92)..(92): n is a, c, g, or t
acagtttcattttcatatcctctncaatggcgactactctgaatgctgctgtctctctcacntgttcaaaatcttcttctcttcctgctacnagctgtgccattgctcctgaaagggtcaggtttggtaagggtgctttttactacaaaagcaacaatgtagtgacaagcagaagagtggtttccgtaagagctgaggtcacaacagatactcctcctccagtgaagaaagtagagaaagagtcaaagaagaacgaggaaggtgtgatcaccaacaagtacagaccaaaagagccttacaccggcaaagtccttctcaacaccaagatcacagctgatgatgcccctggagagacctggcacatggttttcagccatcaaggtgaaataccgtacagagagggacaatctgttggtgtgattgcagatggggttgacaagaatgggaagcctaacaaggtcaggctttactccattgcgagcagcgctcttggagattttggcaactctgaaaccgtttctttgtgcgtgaaaaggcttgtttatactaatgacgcaggagaggttgttaaaggagtttgctcaaacttcttgtgtgacttgaaaccagggagtgatgttaagctcactggtcctgtagggaaagaaatgcttatgccaaaggatccaaacgccactgttattatgcttgccacagggacaggaatagctcctttcaggtctttcttgtggaagatgttctttgagaaacatgatgactacaagtttaatggcttagcttggctgttcttgggcgtaccaaccactagttcattgctctacacagaggagtttggtaagatgaaagcaaaggcacctgagaatttcagggttgattacgctataagcagagaagaaacaaacgataaaggagagaaaatgtatatccagaccagaatggcgcagtacgcacctgagttatgggagttgttgaagaaagacaacacgtttgtctacatgtgtgggctcaagggcatggagaaaggaattgatgacattatggtctcattagctgctaatgacggtattgactggtttgattataagaagcagttgaagaaggcagagcaatggaacgttgaagtctactgattttacaattcggtggcaagtatagtggaacagcaagtgtgattttcacatctaagtttgtgtaacctgaagataagctatgtttttttgatatatactatactatcattttcatcattcattgttggtattagatgttacattgacggagagagttgtcctcagtttatagcaatctcatgtatcttatgatggtagataaccaaaccaatgacaatgtgctgaggactgataaaaatcaatcctatagctctccatcca

SEQ ID NO: 1507 - DNA, 1370 bp, Brassica oleracea
  misc_feature (1195)..(1195): n is a, c, g, or t
  misc_feature (1221)..(1221): n is a, c, g, or t
  misc_feature (1307)..(1307): n is a, c, g, or t
atcttctccaacattttcattttcatttcctctccaatggcgtctactttgaatgctgctgtctccctcaccgcttcaaaatcttcttcccttccagctacaagctgtgccattgctcctgacaggatcaggtttgctaagggtgctttttactacaaaagcaacaatgtggtgacaagcagaagagtggtttcagtaagagccgaagtcacaacaacagacactcctccagtgaagaaagtagggaaagagtctaagaagaacgaggaaggtgtgattactaacaagtacagaccaaaagagccttacacaggcaaagtcctcctcaacaccaaaatcacagcagatgatgctcctggagagacctggcacatggttttcagccatcaaggagaaatcccctacagagagggacaatctgttggtgtgattgcagatggtattgacaagaacgggaagcctcacaaggtcaggctttactccattgcaagcagcgcacttggagatctcggcaactctgaaactgtttctttgtgtgtgaagaggcttgtttatactaatgatgcaggggaggttgttaaaggagtctgctcaaacttcttgtgtgacttgaagccagggagtgatgtcaagctcactggtcctgtaggaaaagaaatgcttatgcctaaagatccaaacgccactgttattatgcttgccacagggacaggaatagctcctttcaggtctttcttgtggaagatgttctttgagaaacatgatgactacaagtttaatggattagcgtggctgttcttgggtgtaccaaccactagctcattgctctacacagaggagtttgataagatgaaagcaaaggcaccagagaacttcagggttgattacgcgataagcagagaacaagcaaacgacaaaggagagaaaatgtatatccagacaagaatggcgcagtacgcacctgagctatgggagttgctcaagaaagacaacacatttgtgtacatgtgtgggcttaagggcatggagaaaggaattgacgacatcatggtctcattagctgctaatgacggtattgactggtttgattataagaagcagttgaagaaggcagagcaatggaacgttgaagtctactgattttaacattctattgtgtcatttttttcagatcaaagtttctgtaatctgaacntaagttttatgttttagatatatacnttatactgaaaagaggttctttttatctttaccattttcattcattgccattacattgctctaaaataaaatggttctttgattcngattttcaataagtacgatcctactcggatgtttcagttgtggactcttgtaaaaggggggcc

SEQ ID NO: 1508 - DNA, 1223 bp, Brassica napus
gaaatcttctccaacattttcattcctctccaatggcgtctactttgaatgctgctgtctccctcaccgcttcaaaatcttcttcccttccagctacaagctgtgccattgctcctgacaggatcaggtttgctaagggtgctttttactacaaaagcaacaatgtggtgacaagcagaagagtggtttcagtaagagcagaagtcacaacaacagacactcctccagtgaagaaagtagagaaagagtctaagaagaacgaggaaggtgtgattactaacaagtacagaccaaaagagccttacacaggcaaagtcctcctcaacaccaaaatcaccgcagatgatgctcctggagagacctggcacatggttttcagccatcaaggagaaatcccctacagagagggacaatctgttggtgtgattgcagatggtattgacaagaacgggaagcctcacaaggtcaggctttactccattgcaagcagcgctcttggagatctcggcaactctgaaactgtttctttgtgtgtgaagaggcttgtttatactaatgatgcaggggaggttgttaaaggagtctgctcaaacttcttgtgtgacttgaagccagggagtgatgtcaagctcactggtcctgtaggaaaagaaatgcttatgcctaaagatccaaacgccactgttattatgcttgccacagggacaggaatagctcctttcaggtctttcttgtggaagatgttctttgaaaaacatgatgactacaagtttaatggattagcgtggctgttcttgggtgtaccaaccactagttcattgctctacacagaggagtttgataagatgaaagcaaaggcaccagagaacttcagggttgattacgcgataagcagagaacaagcaaacgacaaaggagagaaaatgtatatccagacaagaatggcgcagtacgcacctgagctatgggagttgctcaagaaagacaacacatatgtgtacatgtgtgggcttaagggcatggagaaaggaattgacgacatcatggtctcattagctgctaatgacggtattgactggtttgattataagaagcagttgaagaaggcagagcaatggaacgttgaagtctactgattttaacattctattgtgtcattttttcagatcaaagtttctgtactctgaacataagttttatgttttagatatatacattatact

SEQ ID NO: 1509 - DNA, 1213 bp, Brassica napus
tctcctctccaatggcgtctactctgaatgctgctgtctccctcacctcttcaaaatcttcttcccttccagctacaagctgtgccattgctcctgacaggatcaggtttgccaagggtgcttttaactacaaaagcaacaatgtggtgacaagcagaagaatggtttcagtaagagccgaagtcacaacaacagatactcctccagtgaagaaagtagagaaagagtcaaagaagaacgaggaaggtgtgattacaaacaagtacagaccaaaggagccttacactggcaaagtccttctcaacaccaaaatcacagcagatgatgctcctggagagacctggcacatggtgttcagccatcaaggagaaatcccctacagagaaggacaatctgttggtgtgattgcagatggtattgacaagaacgggaagcctaacaaggtcaggctttactccattgcaagcagcgctcttggagatctcggcaactctgaaactgtttctttgtgtgtgaagaggcttgtttatactaatgatgcaggagaggttgttaaaggagtctgctcaaacttcttgtgtgacttgaagccaggaagtgatgtcaagctcactggtcctgtaggaaaagaatgcttatgcctaaggatccaaacgctactgttattatgcttgccacagggacaggaatagctcctttcaggtctttcttgtggaagatgttctttgagaaacatgatgactacaagtttaatggcttagcttggctgttcttgggtgtaccaaccactagttcattgctctacacagatgagtttgataagatgaaagcaaaggcaccagagaacttcagggttgattacgcgataagcagagaacaagcaaacgataaaggagagaaaatgtatatccaaaccagaatggcgcagtacgcacctgagctatgggagttgctgaagaaagacaacacgtttgtgtacatgtgtgggcttaagggcatggagaaaggaattgacgacatcatggtctcattagctgctaatgacggtatcgactggtttgattataagaagcagttgaagaaggcagagcaatggaatgttgaagtctactgattttaacattccatagtgtcatctttcagatccaaatttctgtaatctgaacataaagtttatgttttggataatacattatactgaaaaggggttctt

SEQ ID NO: 1510 - DNA, 2139 bp, Brassica rapa
gtaaccacaacttagatcaaaggaaagatacactcttcatcaaacctcatccacccaaaacacatacaacaaatgtctcgcaatccatctcttatctctctctccttatgattccttttcttatactcccttgaaatcttctcctacattttcattttcatctcctctccaatggcgtctactttgaatgctgctgtctccctcacctcttcaaaatcttcttcccttccagctacaagctatgccattgctcctgacaggatcaggtttgccaagggtgcttttaactacaaaagcaacaatgtggtgacaagcagaagattggtttcagtaagagccgaagtcacaacaacagatactcctccggtgaagaaagtaaagaaagagtcaaaaaagaacgaggaaggtgtgattacaaacaagtacagaccaaaggagccttacactggcaaagtccttctcaacaccaaaatcacagcagatgatgctcctggagagacctggcacatggttttcagccatcaaggagaaatcccctacagagaaggacaatctgttggtgtgattgcagatggtattgacaagaacgggaagcctaacaaggtcaggctttactccattgcaagcagcgctcttggagatctcggcaactctgaaactgtttctttgtgtgtgaagaggcttgtatatactaatgatgcaggagaggttgttaaaggagtctgctcaaacttcttgtgtgacttgaaaccaggaagtgatgtcaagctcactggtcctgtaggaaaagaaatgcttatgcctaaggacccaaatgccactgttattatgcttgccacagggacaggaatagctcctttcaggtctttcttgtggaagatgttctttgagaaacatgatgactacaagtttaatggcttagcttggctgttcttgggtgtaccaaccactagttcattgctctacacagatgagtttgataagatgaaagcaaaggcaccagagaacttcagggttgattacgcgataagcagagaacaagcaaacgataaaggagagaaaatgtatatccagacaagaatggcgcagtacgcacctgagctatgggagttgctgaagaaagacaacacgtttgtgtacatgtgtgggcttaagggcatggagaaaggaattgacgacatcatggtctcattagctgctaatgacggtattgactggtttgattataagaagcagttgaagaaggcagagcaatggaacgttgaagtctactgattttaacattccatagtgtcattttttcagatccaagtttctgtaatctgaacataaagtttatgttttagataatacattatactgaaaaggggttcttaaatcttttaacatttcattcattaccattactttgctataatataaattggtacattgatatagagttgtcctaaattaacagcaatttgtatattatggtagataaccaaatccaataactattatggtttcttaggaagacacttgaatactactcagagtaggctcatgtttccaaccccttgttcattgttataacatcaatcaataaacatgaaaccaaattcaattgccaaaggtgaacaacagtctaatgatgttctcaagtaatgaggaaacaactcattgcagaaaacaaactctgccaaaagaaaaacctttgcagaaaacatccaaagccacaaatgaaatgatactagaatctttgaaaagagtagagcattttctaacggattttcttcttcatctttgtctccacaccattggcactttcacagatcttgttccagcaacggtaagaaatgagcaaaggaatcaaaacccaccatccattagccccaatgtagtaagagtaatagtagaacgagtttgtagcaaagttatctccttccaagaaagcagtaatgaaatagacaagacatccgtagagctggcctagcgagatcgcaagctgaagcacgtagctgtacgacttccccttagcaatagcttacacagcaagaagacaagcagggccttcaataacagcagtgatgccttcaacagctataactgcagaatctctgcctgcgtatctcgaatcacctttgctgtattctttcc

SEQ ID NO: 1511 - DNA, 1139 bp, Raphanus sativus
  misc_feature (594)..(594): n is a, c, g, or t
  misc_feature (829)..(829): n is a, c, g, or t
  misc_feature (840)..(840): n is a, c, g, or t
tcccttgattatcttctcctacagtttcatttcattacctctccaatggcgtctactttgaatgctgctgtgtctctcacatcttccaagtcttcttcatttccagctacaagctgtgccattgctcctgaaaggatcaggtttggtaagggtgcttttaactacaaaagcaacagtgtggtgacaagcagaagagtggtttcagtaagagctgaagtcacaacagatgctcctccagtgaagaaagtagagaaagagtctaagaagaacgaggaaggtgtgattactaacaagtacagaccaaaagagccttacaccggaaaagtcctcctcaacaccaaaatcacagcagatgatgctcctggagagacctggcacatggttttcagccatgcaggagaaataccgtacagagagggacaatctgttggtgtgattgctgatggagttgacaagaacggaaagcctaacaaagtcaggctttactccattgcaagcagcgctcttggagatcttggcaactctgaaactgtttctttgtgcgtgaagaggcttgtttatactaatgacgcaggagaggttgttaaaggagtntgctcaaacttcttgtgtgacttgaaaccaggaagtgatgtcaagctcactggtcctgtagggaaagaaatgcttatgcctaaggatccaaacgccactgttattatgcttgccacggggacaggaatagctccttttaggtctttcttgtggaagatgttcttcgagaaacatgatgactacaagtttaatggcttagcttggttgttcttgggtgtaccaaccactagttcantgctctacacngaggagtttgataagatgaaagcaaaggcaccagagaacttcagggttgattacgcgataagcagagaacaagcaaatgataaaggagagaaaatgtatatccagacaagaatggcacaatacgcacctgagctatgggagttgctgaagaaagacaacacgtttgtctacatgtgtgggcttaaggggatggagaaaggaattgacgacatcatggtctccttagctgctaatgacggtattgactggtttgattataagaagcagttgaagaaggcagagcaatggaacgttgaagt

(The sequence listing continues in the following parts.)

What is claimed is:

1. A method of increasing growth rate, biomass, seed yield, and/or photosynthetic capacity of a plant, comprising:
   (a) transforming plants with a nucleic acid construct comprising an exogenous polynucleotide comprising a nucleic acid sequence encoding a polypeptide having an amino acid sequence which is at least 95% identical to the amino acid sequence as set forth in SEQ ID NOs: 738, wherein said exogenous polynucleotide is operably linked to a heterologous promoter for directing transcription of said polynucleotide in said plants; and
   (b) selecting a transgenic plant obtained from step (a) transformed with said nucleic acid construct which overexpresses said polypeptide, and exhibits increased growth rate, biomass, seed yield, and/or photosynthetic capacity as compared to a wild type plant of the same species which is grown under the same growth conditions.

2. A method of producing a crop of plants comprising growing a crop plant transformed with a nucleic acid construct comprising an exogenous polynucleotide comprising a nucleic acid sequence encoding a polypeptide having an amino acid sequence which is at least 95% identical to the amino acid sequence as set forth in SEQ ID NO: 738, wherein said exogenous polynucleotide is operably linked to a heterologous promoter, wherein the crop plant is obtained from plants which have been transformed with said nucleic acid construct which overexpresses said polypeptide in said plants, and which have been selected for increased growth rate, increased biomass, increased seed yield, and/or increased photosynthetic capacity as compared to a wild type plant of the same species which is grown under the same growth conditions, and thereby producing the crop of plants.

3. The method of claim 1, wherein said exogenous polynucleotide comprises the nucleic acid sequence selected from the group consisting of SEQ ID NOs: 420 and 29.

4. The method of claim 1, wherein said polypeptide has the amino acid sequence of the SEQ ID NO: 738.

5. The method of claim 2, wherein said nucleic acid sequence encodes the amino acid sequence as set forth in SEQ ID NO: 738.

6. The method of claim 2, wherein said nucleic acid sequence is selected from the group consisting of SEQ ID NOs: 420 and 29.

7. A method of growing a crop, the method comprising seeding seeds and/or planting plantlets of a plant transformed with a nucleic acid construct comprising an exogenous polynucleotide comprising a nucleic acid sequence encoding a polypeptide having at least 95% amino acid sequence identity to SEQ ID NO: 738, wherein said polynucleotide is operably linked to a heterologous promoter, wherein the transformed plant is obtained from plants which have been transformed with said exogenous polynucleotide and which have been selected for at least one trait selected from the group consisting of: increased biomass, increased growth rate, increased seed yield, and increased photosynthetic capacity as compared to a wild type plant of the same species thereby growing the crop and wherein said seeds and said plantlets comprise said nucleic acid construct.

8. The method of claim 1, wherein said selecting is performed under non-stress conditions.

* * * * *